United States Patent 7,745,391 (HUMAN THROMBOSPONDIN POLYPEPTIDE) - sequence listing, part 231

SEQ ID NO: 615342 - DNA, 769 bp, Homo sapiens
  misc_feature (97)..(97): n is a, c, g, or t
  misc_feature (137)..(137): n is a, c, g, or t
  misc_feature (622)..(623): n is a, c, g, or t
ggcatcacgtatccctcaaagagagaaacctggacacatgtaccaaaacgaagattatcctgtcagaagcgggcttgcgaagcagaaatccatccgnttctgtgggcttaggcgattaactggatcccatcgtcaangttatctctggagaaacgaagtcacactcagagccctgttgacactgagcagcgttgaccgtcaaactgcacgtgacgttcctgttacatgcgaggagtcaggccgtctgtcgcgtccttgcgtgaacagcactggtcagccgctgacggactggctctactcagacattgtaggcgtcagagaactggagttagtctgatccgtctagttgctcttagttcgggacgtacatattgatcgcgaagtatatggacaatccaaaggattgtgtcgtccgtgacacagttgtcagcgttctaacaaggtagtccgtcaagtgcgtgactgctgcagtctgtcagcatgtgactggtgagcatctgtattacgctggctatacaagtatctgtctttttgagtggaagacaggctcctagttctcaagcaagcacctgaggagttgccgattttccatcggaccacagtcaagcaagatccatatccnnaacaggtcaacaaagacgttccttgcacggtctgtggatactaagctaacgtcttggctctcatgaggacaggaaaatgcaacttcaacacatcatggctcaagctgtgattagaactttcctgagaatctctgccatttgagata

SEQ ID NO: 615343 - DNA, 425 bp, Homo sapiens
  misc_feature (1)..(1): n is a, c, g, or t
nccccggcccgctatccggttcaatcctcccacttcagcctcccaaggagctatgtctataggtgcgtaccaccgcgcccaattaatttttgtatttttgtgtgtgtgttacacgaagggttgcccaggctggtctcaaactcatgggctcaagtgattctcctgcctcagcctcccgagtagctgggattacaggcgcctgccaccacacctggctaattttttatatttttagtagagacggggtttcactatgttggccgggctggtcttgaactcctgaccttgtgatccaccagcttcggcctcccaaaatgctgggattgcaggtgtgagccacctcgaccagactcaaaaatgttttaaaaaatccggaaaaatctgcaactggacattttgatagattaattgaaccggatagcttg

SEQ ID NO: 615344 - DNA, 255 bp, Homo sapiens
  misc_feature (100)..(100): n is a, c, g, or t
tggaccgtgtgtgtgtggttggcgtggtactgcaccatggcagcgtcggagcgacgtcgtcgtcgtggtccaactcggttggaaacgcagatggcgcggnctgccacttccccttcatcttcgagggccgctcctactctgcctgcagcacctgacggtcgcgtccgacggcttgccctggtgcagtaccacggccaactacgacaccgacgaacggttcggcttctgccccagcgagaaatctacaccgggagg

SEQ ID NO: 615345 - DNA, 375 bp, Homo sapiens
gagggtatactgatccgggtctcagacaagggtgttccagtacgtcagcgatctagatgaatggactcgctggctctcatgaacatgcaacgtcgagcagcccggttcaacctggcggaacccagcaagaacacagcaagtcctaggaatttgctcagtgtgaattagaaaaccgttgtgtggtagcgtgaagtgaaattctagtttctctccggaagcccaggagagacccagcagtaaaagaaaagcagacatcacaaaagcaaagctgatgctggggtgggagcccgtggtcccgctggaggaaagtttagacagagccattgactacttccgtaaagaactcgagtaccaggccaatgattcagtttccgt

SEQ ID NO: 615346 - DNA, 743 bp, Homo sapiens
gctggaggcggcggcggtggccagcgcggctggcgcctggccgtattctccgggctgcggaggggttgccattaggggactcctgagtgtcctatctccagtgctgcgtgtgacttgcactttccctgtgatgtgtgaatgctgctgtgaatgtgctggacctggcctgccatgtccagcgttcagggcacgtgatgtgactgtggatgtgaccatatatgacgattgggggacgtgagccttgggcatgctggccagttttgcgatctgttgccggacagtgcctggccatgaaaggtggcactgtgtgctaatgtgcatgtactgcaggcccaacgttcatcaactgatagctgcctgcctgtactatccatgcctggctagtgggtgttgatgcctgcgtgagtgatgatctgatggctgggtgaggtgttgaaccatacctcgcgtgtgatggatcctggccagcctccaaagcatcaatcacaccccttggctactcgactactcttctctagaccgacactaatgaccgagacctcgttgggttaccatacaatgccttcggtgcaggcctctgggtccttcctcgtgccagtgttggatgcctcctttctgcacttacccttagtggctgagactgacatcctgatcgtctgctttgacctgtgatgcgacctgacgtggcccactctcaggtttccttgccaactgcagactaccctgcggactggcggttcaac

SEQ ID NO: 615347 - DNA, 427 bp, Homo sapiens
acaggcttgtgtggcacaaacaggtgccattagttaggtacaaccagatgtttttgatggtgcttgagatgaaccatgagcctctacaaagacaggctggtcacttctgatgaaaactccaccctctagccaaggatgatgctactcccatgcaggtccccaatgtgggggacactggaaatagcaaccagggttcaccttctgctcaaccaaactttaatcagacaaaagcagacagcagcagctgaggagacactaggatttttgcatctatgcagtaacaggtattgtggaattatatggaaagcaatctatttgtccataatccaatacagagcaaattaaaatactgccaataaacccactaaaacaaacattatgtaagatgaaaacagggagaatttcaaagaaacaatgtcacataaaa

SEQ ID NO: 615348 - DNA, 1620 bp, Homo sapiens
agcggattctcaagcttgaaaacccacctgcaatcatttgggcgggggggggggggcttcttataagcgcccaggtaaacttggtctgaaggcagaattgcccttttctctggaatcttctgctaaggtctacggaaggtgtgaataaggtgatcacgtgcattttgggttggcgaggaactccctttagagccaactcccgtgatctctccggggggaaggaggcctctgtgggaagaaaaccgagttattcaagaagaaaatcttggttagttgtgcactgtgtgtggaagaaagatatccgaacccgaaaaagctgtggagccaaaaaaccccaagtcttctccagaacgacaattcgtggtttgtgaaaaacttctccgaagagaaaaactctatacgctctcttggaagagacattatcaccaacatgtggagacactgtggcgacaaacaccgcttctttctccaaatataaagacaccggtggtgtctgcagtgacatagacatgtgggtgtctcctgtgagaagaccccggcagagggtctccaagggccgtgtaacacagagagtctcacacagacaaacccgaggccacagagcgtgaaacagaacactctttgagcgagaactcttcgtgtgtctcccccctttgtgaacaaccccgtgtgtgtgtgggaaacgctgtgataatccaaaaacccttcgagagggggaaacaaacgcaaagtgtgtatcacccccggttggtgttaaacctccgagggtggggcctctccaacctaacaatttctgtggctgtggagacagaaatataactctccatgttgcgataacaccacttttaacaacaatatacaggggaaggaactcaggttacccatatttaaagacacttaattccttttcaaaggcagtttcactctatggtgggacagaaactatttaaccatattcagggggcaaaacacaactgttgggggcacatagaagacaactttccacgggagaaaatagagacacaggcccagaaataaaatttgggtaggcttataccaccaacgagttggggggggagaaaccaccaaaaatttcgcccgttggggtatcccaggcatgtgtatatgatgaaaaagcgccccagaaagataagctaattttttgtgcgaagaaaagcgaggtggtatgtataacacagttagtcgagtatttatatcgagggagaagaacaaacaaaagaaggcacgcactcctgttgtaatagtttacccccaagcagaatcaacaaacggtgagttacttattaacacagcagactttaaaatagtactctttttgaaaagcaacacatgggggtgttgagtgggaacaccaaaaaaacattcgatcgatatagagagcagcaggaagaaaaagaactaagcagaaaccataacaagtatatagaaagatacagaagagacaagacggtaaagacaatagtagtgttgtgcacacagcagacataataaaggaggaggagggatattagtatgcacagactaggtgtgtactactcaaaactacaagaggcatgaagtatgaataacaaagaagcatatgtgattgatgtagaacgg

SEQ ID NO: 615349 - DNA, 209 bp, Homo sapiens
gaactacatcctttcccactttttcgggtttacgacgacaccaagttggtccgttctagtaggccactttcttggtcagggacccggggttcctacggcccctttgtcctggaagaggaaaggacctcgaccaaatcgacctataccctcccccaaaccgacggacacgggtcctcgtactgacggaactccgacgacaggaaagtgtc

SEQ ID NO: 615350 - DNA, 379 bp, Homo sapiens
ctgaactcattacagctcatagcaatgatggtcttaacccactgagcaaggccaggcatcgaacctgcatcctcatggttgctagtcagatttgtttctgctgtacatgatgggaactccagactgagttttatttaagaggtgttgatataacagaaaagaagtcaaaggagaagtgaggtgcgcccattgatccagagagttttggagttacctagatccttgatgtgacccaggccagtgctttgagaatatgttccacagatcatgggtgtctgaatcacttgtgacaggtgttatatatagggagggctgggctccaccatcacctgctaaaccagactcaacaagacaggaattcttgacctaatgttgcacc

SEQ ID NO: 615351 - DNA, 685 bp, Homo sapiens
  misc_feature (292)..(292): n is a, c, g, or t
  misc_feature (339)..(339): n is a, c, g, or t
ggtttgtgagatggccttcctttgacggttttggaatttttttccggccgccgaaaagattctaaagtgaagcaaaattaccctcttgggcctgtttttcggcccctcttttaagtgagcctttagtccaggggggggctccataatacaaccaccgtggccatcaccatacctgtggggaccccaacctaaaagaagcttaaagcctttttgtgggccccaatcccaacaggaaattaagcggcccggcgggaaaaatttggggttgtttgtgggctcccgaaaatctctntgctggtgtcaaaatcagtttggaagggccttttttagtgcgcaagnccgagcgttccaagcaggggaaaaaccccttcccacccagggcctttaagaactgggggttttgctttcaacccaaatggcccattccaagtggggaaagcaaggtgagctttaaccttggggcttgggcttttgcccctccaaaccaaccggtggtttccctggaaagggcccttgttgttttccccattgcattcaccaccaccgaaaatcccaggtggtccttgtgcctggcccggttaatgtgcttttgcgggcaagggccttcgtggttttgtacattgcggtaccaagaggcctacacccatccttgcaaaataagggtgcccaataaccacttgtaaac

SEQ ID NO: 615352 - DNA, 121 bp, Homo sapiens
ccagaccgtaggactgggagagataggagaagtaggagcgctgtgattagggcggatcagacgaagaggggcgtatggtattgggttatggcagtggtcctacgtgtgactgacactctgt

SEQ ID NO: 615353 - DNA, 295 bp, Homo sapiens
ggggagccccgcgcggaggtggtgccccactcgtccccccgggagcggtaataggctacaagaccgcgtcgctcacctgtacctcgaccgcccatcgcgcgtattggtgccgacgcttccacgacttccgcagctccgcagtcgcccgggcccggcagccccgcccctggccgaacacccctaaacccggggacatcctcctaccgcgtccgcgtcctgagccgccggcagcgccacgcccacgccagcggcgcagcgaggcagcctggagtgaccgcgaccaaggagcggtcgc

SEQ ID NO: 615354 - DNA, 356 bp, Homo sapiens
gtcgatcagaggatcccccggtacgggagtggcgtcatcttggcgatgacaggccctttcggcccatgtacttcttggccaggcatgttgtacacgggctctagctgcttgcagttcccgcaccatggcgcgtagaactcgatgaggacgtccttcttggggtcaatcacaatggagtcaaaggtctttcccaccacgaccttgacgggtcccttgttgttcttgggcactggctgggatttgatgactggcttcagttttccttttttgaaagcagtgacaaactcgcggagggtgtcagagtcaaactcctctggctccatggcgaacttcttcccactcccgtaccaggggta

SEQ ID NO: 615355 - DNA, 657 bp, Homo sapiens
tagatgctagtacataaaaccacctgaaattcttaaaatcagcgcgccggcccgtaaaaacaaggctcgagagaggctggtatgagcggcccgagatggcgccgctgcactgggtcacagaggctggctagttgacccctcgacaatcgaaacaagtcacgcacaagctgggtaaaaacaagcccggacagcacaacggtaacgactctgacgattgccctcgcacggacggcgccgcacttatacaccagcgtatctgcaccttggagggctactagcgccgacagcttgtacgggcgcgggcttcgctggcagctagatgaaaaatctgctaacaatgcacacggtgcgtataacggcagctacgcccatcatgcgcgccgagataagaggagcatccaatgagcagcaccgcacaaactgctgaaggcgaaaacattctcaatcgttgatgacgatccgggggctgagcagcctgatggagcgtattacaactccaagggctatcgtgcccgcgccggtgccgaacaccgaacagatggatcgtctgaaagggcgtgaagtttcaacctggtcgtaccgaactgatgttgcccggcgaagacggcacactgactgcagcgcctgcgcgtgcgaacatcagatcccgacatcatg

SEQ ID NO: 615356 - DNA, 386 bp, Homo sapiens
tatcttggatttacatgtgccacccattgcatagtgaccttacccagatgcgttatcaaaaaaaacattgattcgtttatttatagagccaggtgctaagctatgttgctatgctggatatgaactcgggctcaagtcctacctcagcctcctaagtaagctgtgactacaggcgtgtgctactgagcccagcccagatgctttaataagtacagtcctatctgagtctttcatgaatttatttagtaaaatagaatttagattgtttgtcttacatccacgtttttattctttcatacatggcacctatagaagacctaaggttagtataagtaacatgaaaccattctcctccgcataagcctgcgtcagatgaaaacactgcc

SEQ ID NO: 615357 - DNA, 210 bp, Homo sapiens
  misc_feature (1)..(1): n is a, c, g, or t
ntccatgcatacccgacggagcagctaaaacttaaaaacctgacagtaccaacgctatccagtgaactctcacccattgcttggtgtgtgaatacaaaagtgctaaagcctgctttagaagacagtttcacagactctcacagaactaaatataaatatattcttggggcctggactgttggttgtgtacaacggccttgttcattccca

SEQ ID NO: 615358 - DNA, 1142 bp, Homo sapiens
ccttgtacttgtcttgaattccctttgatattgttgacccactgctgtctgaaaaaaaaaaaaaaaaaaaaaaaaaaaaaaaaaaaaaaaaaaaaaaaaaaaaaaaaaaaaaaaaaaaaaaaaaaaaaaaaaattttttttttttttttttattttatttattttgtgtttaaaataacacttcacacacacaccaccatctcattcattatatatataaaacatagtactactcatctatatatttagttttcacttatattattattattccttctgttttatttcttttttcattctatctcatttattttttctcaacatagtcttttccaattctctgttttctatccctttcttctctccttttcgccccttctctatcttttctttttcttttttgtccacccactttattgtttaacatcatctatccactctcttctctatctccatactcacttccctttcctcctctctcttctacaatcaactctttttcttctctctttcttttgcttttgatgttgtgcgtccatccaactcctctccttcacttttccatttcgtcgaatacgaatattctttcgcttactctttctctcttaaatctcatcgtcttcacccttttcatttcattcttatgtttacttctttctctaaaaagcggttggtctcactccacctctcttcatctcatcactatcgtactatatgattataaccctcactttagatgttactatccttatattcgtctatgtttaaccttactttttttattttaattttttgtatcacgacttagtaccaattatattttgtactttcatgagtttgtatatctcataatattacttaactcacactcctagattattccagactgtcatcttgagttacttgattcattcttctgtcgtaattcaactaaccttcatcaaactcacctttttcataccttatccatcgtccctcctaactcacactatccccaacagtgttaactaatgtattttaccatttacatcttccatctttttaaatgcttacagtcctctttctatctccgatatctcctagctatcgactatcatgccataccttcatcctcctccccaacacttaccacacgctatacc

SEQ ID NO: 615359 - DNA, 165 bp, Homo sapiens
tcctgtgccatatgcaaagcctgccatttgttacttggactgcccccatgcagcagtctgtgttccaagacacactagtgtccccatttgcacactaagagttcctagccagcatcaagacctgatgtggtataagagtagcaggagtagaggaaccgagcgggt

SEQ ID NO: 615360 - DNA, 158 bp, Homo sapiens
  misc_feature (80)..(80): n is a, c, g, or t
tcagggcaaatcttttgcgccaagatctgatgagacgacaggaagaattacgacgcatggaagaacttcacaatcaaganatgcagaaacgtaaagaaatgcaattgaggcaagaggaggaacgacgtagaagagaggaagagatgatgattcgtcac

SEQ ID NO: 615361 - DNA, 512 bp, Homo sapiens
ctgcacattgtgaagaagggagtccgatggacgacatgctggatgctgatcaaacaaaccctacaacatgcaaccttgtgtgacaaaagcattctccatctccctaatgatggttgcttaaacattcatgccaagaaccagaacctcggactgtctctatgcccgtagcacgagagtgtgcgactccattcatcctgcggtcacgctggagcgactcgcgcaagtaacggagccctgaccacccacgttgcttacgcttccagtcaccagacaggaaccaacagaaacccgctctctacctacgcaacctgcaatgtccacttcatctctttccaaaacacacgtcctcccatctattatcaccaaacagcacctcagtctctcccatccccgttcccgctgaaaattccgacgcaaaccttgggtcacaacccttccccttcccccaactacggcccattgcatcaccaacaccacggttcctctgctccctcatctcctccctccttccc

SEQ ID NO: 615362 - DNA, 677 bp, Homo sapiens
agcagcgcccaaggtggagctgatgccagaatgcggtgtgcagagtctgtggacacgcgctgcgtgtacattctggactgttgtgtccgacgtgttcatctggtcggcgcaagtcccgcgctggtgcggcgctgcgcctcaagctgggtcaggagctgtgcgggatgctgcaccgggcacgccatgccacggtcagccgcagcctcgagggcaccgaggcgcaggtgttcaaggccaagttcaagaattgggacgatgtgtttgacggtggactacacacgcaatgcggaggccgtgctgcagaagcccgggtctctccgggaaggtgaaacgcgacgccgagaagaaagaccagatgaaggctgacctcactgcggcttttcctgccgggaagccgccatgtcgcttggccgagggcgggagcagttgatggaggagtggaaccgaagacctagacggcatggacgggtttcgtgctgggagtggcaagaagtttgcgcggggtgccggaaagaggagtttggccacttctacacgcgaggagttgtaggtcttcctctgcagggtactgggttgctgtggagtacgaggaggaggaaaagaaggacggaccacggaggagaatggtcgagtgcaaaagatggcgagggaagcaaccggttgaggcaatagggaaa

SEQ ID NO: 615363 - DNA, 151 bp, Homo sapiens
caagcagttaatacatgactcacggtgaagtgctatgctaagcccaatgagggtgctatcgtggaggttgcacttggaagggtactacaagtgacaatgctctttgacacagcgggtacctccgtctttgagaattggcgaggggagagaa

SEQ ID NO: 615364 - DNA, 471 bp, Homo sapiens
gccggtccccaattcggttttgcagagccgacgtcaccggaaagaatgaccaaaggaggtcggcgcagtacggaatcaagcagcgttgcggcacctgggtgatggcgctggcccacaattccaggccagctgggtggactagcaggccgagaatcttcgacaagcgagccttctgatcgtccacgccaatcagccgatccaatcgggtgcgggcgtcgatgtccggatagatgcgacgttgatcaaacaactcgtcaagggttggctttgagtgcattagtagctcctgacactgaggcggtcgagtgccttgccacccgcagagtagctgcggtcagacaccaggcttccgctgataccaggctcggctgccccggtacgctgaaatggaagcgacttttcaaatgactcccgctgaggagccgacagcgtgaaccaggcagaggaatacgtcaggtagttgtagaagct

SEQ ID NO: 615365 - DNA, 390 bp, Homo sapiens
ttcttttatctctctctttttaaaacagacaggtctccctctgtcacccaggctggagtgcatggcaccatcatagttcactgcagccttgaactcccgggctcaagcaatcctatttcagcctcgcaggtagctgggaccacaggccctcaccaccacgcctggccagttttaaaattgtttgtagaacgacgtctcactatgttgcccaggttggtgttgaactcctgggcttatcagcaggccttggcctcccaaagtgctgggattacaggcatgagccaccgaggtcggcctattccttactctagattaggggtgtccaatcttttggcttccctgggccacactggaagaattgccttgggccacacataaaatacactaaac

SEQ ID NO: 615366 - DNA, 235 bp, Homo sapiens
tacagtgatcttaacggctgttacctacaggttcaaacaggtaatgattagccaacgccagtgaagcgccggttgaagattcgatccttgccgacaagatctgcatccactgcggttttaaggttgtcgtagataacccgctgcggtacgccgccaaagaacgccaagggcgcgggttatgcgcatctgagcacccatctcctgggtcccctcgcgggatagggcccaccacaaa

SEQ ID NO: 615367 - DNA, 218 bp, Homo sapiens
attatttataaattttagtgagcaccaccaaagttaggattcaattgagtttgaattcaaattcattcaaaagttgcacaaatttatttcttttttcctgaacattcctttacttcagattgacaattcattctatttagagcgctattttaagaaaccttgatgaatcgcccttgactaaaggaaacaaagtagaattttatacagatggaaaaaga

SEQ ID NO: 615368 - DNA, 469 bp, Homo sapiens
aaagttagtctttgagaagataacaaaatcaacaaaacgttagtgaaactcagaaaaaacagaaaaaaagagactcaaatttgaaaaaatcataaacggaagtagtgatatgtcacaatggacaccatagaaatataaaggatcattagagagtactatgaacaacaatatgccaataaatttgaaaatttaaaggaaatgaataaattcctggacacatacaacctataaagattgaacccagaaggaaaagaaaacacaaatagaccaattacaagtctatgagagagaatcagtagtaaaaggtctttcaacaacaaaaaaatccaaaaccagacggctttactgctgaattctaccaaacctttaaagaagaattaataccaattctttccaaactatcccagaaaataaaagaggagggaattcttcctaattcattctacaaggccagcagaaccctgatacc

SEQ ID NO: 615369 - DNA, 161 bp, Homo sapiens
  misc_feature (21)..(21): n is a, c, g, or t
tggcactagactgtagagtantacaactgcatccaaagaaaattccctgaagcttgcagcctgtggcacaccatgtccctcagatgtagagctgatgggaggccatgctgtccatgaacggccgcaccaggttgtcctgtggagaagtaaaagatgagccc

SEQ ID NO: 615370 - DNA, 770 bp, Homo sapiens
gagccagaacacagcgtgttgtgaaaactaccccttaagagccaaaaggggaacaggaaaagcactcatatcaacattgtcgtcaattggacagcatagatgcgagcaagtccatccaggtactggccactctgagtctatagagagtgcggtggcatcgagcaaaatgaacccatttgcacatgacattgtgaagcataggcgagggctgactgagtactgcggtagataggggtcgtcccattcatggatatggcctgtggctctgtaggagtaaccctagaacaagtctgcagccgtgtagagctggttgaggtattcgaccattgtgaataatctcccgtatgtctcgaggaaaagtatgtagacgtaacccacgtctaaagttgaccatcattgggttgagcattaattctaatgttgtaatgtctcacccgacgcgaacgatcgaggaagaagctctatatgcaaataaagcacttggaatttacaacggggtacagtctcagggcgtgcatctgggtgctggtccctgacttgttttgctcgctggatgttgggtgagagttttggagaggcatgggcttattttgcgcaagagaaactcggggcatgcacctccgagcacactattgcccctatcctgtgcattagcacctcatgggggttgttgaaagagcaaacttaacattctgctcgcgcgcttgaacccaacaaataggagttcccaccttgaacccagccctaacagtccagaaacgagattcttg

SEQ ID NO: 615371 - DNA, 373 bp, Homo sapiens
tgtgttttatagtttcacatattttcattatggtgattattgttgtcatttccacatgtaagaccccctgtagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactggaatagtgc

SEQ ID NO: 615372 - DNA, 949 bp, Homo sapiens
  misc_feature (363)..(363): n is a, c, g, or t
gctggcctggccaatgcctggacctgcttcggcaccgcccgcccgatccctccacccgtgtggcctggcaatggctgggcgcagtttctgctcttgtggtgtggtggggctgctgcttgtgtcttgcgctgtcctggggtcctatgtgatgacctgctgccaatccctgactctcctgtgtgcacatcccatgtggcaactgcagcccacccctggctctggagccactggaagcccctgtgctggctgaccacctgctcaatggatcaactgctgagctggaccctggtgcctgggtcgctgcctctgtgtgtgtgcgcttgtacacctgctggcctgtctgcgtgctttttgttgcttgtnaccaatgttggttttgcatgggtgaaacatgattgaacacttgctgtcgttctccagctgatggatgtgcaatgcaatgcatgcagccacttgcatgtcatgatgcaacatgctgtgcccagttgacacaacatgctggcccatgacagagcagcacctgaacaacctgatggcccagctggaccccctttttgagctgtgtgactactctggctggagcccagcagtgagcttctgaacatgaagctatggaccatccacgaagctgctgcaagatagcaagccggacaagggatatgggaggcttcagaaccagaggccatgcagacctcttcctgaggactttctggttacacggaggcaccaggaggacattgggtgacagtcagtgcctgcgaaggagcccaaaattggagcacagatgacctttcacctagctaattcctggcagtggggcgggaacaacggcaacgtgcgccagctctggcgcagggcgccgttacagagccttggctggggcatagggtgcatcaaggtgataggtcgctaaaaaacacgctgtgcttcctgacaccaacacacatgt

SEQ ID NO: 615373 - DNA, 403 bp, Homo sapiens
aggcaggccaggcttaggaactgctgagcaatgagaagactgtgcagttagtgtaagctaggaacatgccttattcccttaagcccatatggaggggatggcaagcctagtgcctacttaccaacctcctctgaaaggacagggcaaggctgctgccactgccacctctgcgggcgaatgagcgtggctcccaggcagaggaaggacaaggaacttggacaagatgctctttaagttgccttccagttgtggtggcttctgtggttttcttatctttgttaacttacctctgagtcacctacttccagaaataatcttggcaagtttcccgtaacagcatacatacctcaagacaaaaacccattagcaaaatatcaagaaaaaaaatcagtaaattaaaaaa

SEQ ID NO: 615374 - DNA, 670 bp, Homo sapiens
  misc_feature (459)..(459): n is a, c, g, or t
ccaatgccgcagacgtgattttggcacgggctgcgagaattagcggatcaccgcaagcgagccggaccgcttgcacaaggacatgaggatcacgttactgatcgataactagatctggtccgagtctatcaatagattcacgtgcagtggtaactttctagtcaactccgtaaagcttgcacgagtgatgataatgccactgcatgttctgacacgctactatgagcgaaccaggtccctggcatcacgttgctatcagatacaacaattttcgcgtgaaagtgggtaacattggcaaattgcaggtggacgtctacatgtagctagaaattaaactgcgcacgctgtatcatagtcagggtcgcatatgtaactacagtctacagaatgtagatgctgacgcgatgccttgtagcatgcagagctactacggttactaggtgctacgaatccaccagnccatgcagagaagcggaactgggtcaccgaatttgaccaatgtcctacaaacccgtcacccacggagcagggattgaccgatcactgattacagctcttatactggaactatgaaagggccactttggttctacttgtcaaggccaacatttccgtcccccggctcctctcaagactcccggtttcccccaacccttctcacgttccccgc

SEQ ID NO: 615375 - DNA, 717 bp, Homo sapiens
  misc_feature (631)..(631): n is a, c, g, or t
  misc_feature (633)..(633): n is a, c, g, or t
atcagccggtaccttcagcgacgccaacacatgtggatgaggtgaaaatcagaattgccaacatgcatgttcccatctgaagtcatcaagacaacactctgccttctttttttttgagacagggtctcactcagttgcccagggtggagtgcagtggcacaatctccgctcactgcaacctccgctcactgcaacctctgcctcccgggctcaagcaatccccccacctcagcctcccgagtagctgggactacaggcccctgccagcacactcagctaattgttgtattttcagtagagacggagcttcaccatggtggccaggctggtctcggaacttctgatgtcaggtgatccaattgcctcagtctcccaaagtgctgggattataggcatgagccaccgaacctggcccttggcccacttttcaatggggtttctcttgtaaaatttgcttaagttccttgtagatgctggatattagacctttgttagatgcatagttcgcaaaaattttctcccattctgtaggtggtctgctcactcggttgatagtttcttttgctgtgcaaaagctcttaaagttaatgggatatcacttgtcaatggtgggtctgggtatgattgcttntngggtctttgtcatgaaatctttgcccatcctgtctcaggatggattgctaagtgtctccaggtttatagttggggtggggggac

SEQ ID NO: 615376 - DNA, 920 bp, Homo sapiens
ccaaatcatgttatggtgtgattcatgtgagaagtagagctgtggtcattggacccttaggctaaggataatccggtgtctttataatcaggtaagatcggctaacgaatgtatattacatcgagctctagagttatcgatctcctctcacatctcacatgctacgttactttcatataagattggacgcgaaccgtactggatacatgatcacgaaatagtcatatagcagcattctaacttgtagattggaaatgcgcttctaagtcactcttcagtttacagggctattctgaaaaaaataggtgtattcatagtcgaagaatgaatatctcagtccagtgagtcgagtagtctctagtaattgttaccctaggccaatttatctatacctgtttaatgcactgagttttccccgaacaccctatgctagagagtcacgctgtgaccgatggaggttgtcgttgtcgtagttgtagtagtgtttctagtgggtgttgaggtctcgcgattgcgcgtagcttggctaggtgtgcacataagtgccatattgataaagtacctctagactcctagcaatctattcattctcaccaagtctcaagctcagagaaaggtaagaaaaaatgctcctaatttccttgtatccccactactctgaatctcgtggtcataaacgcagtgctacccacatgtgatcggatggttatcaatctctttgggtgccataaaacagcgtactccctgagattaatcctaccccaatactaagtttcggcctttttccttaacatactgtgtaaatttcaaaaagtcctcaattaagtgcaattattcaatagtaatacgtcagcagtaccttaataagtcctggggtaaaagaatggcccccccaggaattactttctaagatgatgggc

SEQ ID NO: 615377 - DNA, 938 bp, Homo sapiens
gcatgctcgctgccaagccatgtgtcttccatcggtctggaagggggatgatgctgtgtctcgcatggtgccagcgtgtacaactgttcggccatgagcactagatgacctgagtgcatattacttcgtgtctagtatgcatcttcattggtatggcgggatcggtggtacgtgctgctctattgatgcgccagccatttcggttaggcattgaagggagcgagtatgtcttgattccctcgagcgcagtggaagtagagcttttgacatcaccgcaggtgcacgtcatcttctggataactcaacaatgatctcgagttgcaatgaacccaagcagcattgtggaatggagagtgtatctctgtttgctatcctcttgagtcttggtggaacttgacattcgtctgtgtgtcgttattcaggtaataggaatggatggtgcttggagtgccatatgtgtgcttttgcgtgctctcaccaacagcaatatgacggtgctaaaagagccaacccaggacgagagccaccaatcttcctcttatttcatctgtcaattctattatattgcactttgttattcatctgggtcaaaacttgtgtatttagtagttaaccatgattccccaacagtcttacttttccagcaaacgcctgtaaaaggactgcccttctttcacatggattgtccaggtcgctaaaaatcaagtaaaaacaaccttggcgtatgtccgttacccttcggcaagcgtccacttttcaagggaattgaggaaatggtatagcaacccttcttgggggtaagttttccggcactcgagtgacccgggccctcacgtatgaactgggaataaactctataatggttgggggaaataataactttgcaatcccctattgaaattattcgcttgttttgctttacacttaagaccggccac

SEQ ID NO: 615378 - DNA, 1326 bp, Homo sapiens
  misc_feature (839)..(839): n is a, c, g, or t
tccctgccggcgagggccaagcgctgtggaactatataacgcagtgctgcactgttttcacattgctgctcctaaagtagacaactgtgtggtcccgcacatgtatcgttggtactgatgagtgctgtcatctacggaatggtgacaatgggctacggagctgatcgtcacgccatcgtagtctcagcgctcatatgatcaacgtccaacaggtaggtcctcgccagccagaagaccggggaggggataaatatgggcctcctcgaacaaattgtaggtgatacacacatgcaacacacattatacacaactaagggcttcgcaatcatattaattgcttacaagctctatctggggactatagaaccgtatattggcattgtgcaagagacatatagggtatgaccaggcggcacagcagagaccacccgttggcccgagactagagacctggcgattgagcgtccttcccctacctttcgtagcccagcacgcatttgcctcaacgtattgcatgaagatcgttgcgtggaatactctcgacgctcaaaggagatattgaatactaactctgttgtgtgtggcaagcttatagcgaaagattaacaccttgaaacggattgccacttacacttacgttcgcaaaaaaaatgacaacacagggacaccctatagacacacagacaagggacacacacaagaaaaccgggcactttggggcgtggtgccgctgcattacatccattgtttgaaacctgccccgttcagtcagttcgcctttgggcgcaatcaagggaacccgttgaaaccttcgggcaatgttgtgaatgttgccacgncgaggggaggacgcgaaaccaaagaagggacggagggcaaaacctgtgacaaaactgttaaagcccctggtgggcctccaacttgttgcctaagagaggagccacccgtggctggtggatttcccttacccaaccgagaacgcaagggcaggggggggaaccctaagtttcctgagggaaaccacgcacccactgcgacattgtttctgggcggcgacacggcggacttacacacggaacggtgtgacggatgtaggccccaacttttcctttccaacattacaacacccaattttaaaccacagtgccaaagagactttcagaaggaaattgggtcccccccatggatagaaagaagacgctcttgacacaaaggaagcggcgacacggcgacagagggggactgcgtggacacatcttttggcaacatttgttgtggcaataaagaggccagctgggggtggccccttaggagcgcgaaagaccc

SEQ ID NO: 615379 - DNA, 347 bp, Homo sapiens
atagaatcaaaaacgtgacctgacacactactatggcatcatatataaagtggtagcatagacttgtcatcagactacgtatacctaatcccaacaaagttgtactcagtagtacaaaggctaagacaacgttgtcgtcttcatttacacatagctcacgcaaggaaacactgatagatctaatggtgagtgcaaaatccttcaacaaataataagcatctccttcattcatcctgttatcctggactaatcctatcaaggaaccatgtaagtagacatccagtgcataggcattaagcgacattttccttcctcggttatcaaatttctgtgacaacagcactgga

SEQ ID NO: 615380 - DNA, 698 bp, Homo sapiens
  misc_feature (407)..(407): n is a, c, g, or t
ggagtcactcctctcaaatcctgctgctgctttatcaactaagagtatgtaatgttctaaatcctttgttgtcatgtgaacaaagttcagagtgcctccaccaggagtaggttccatcttaacacatcattttctttgcttatccataagaaatacctcatcattggttacagtttattatgagattgtagcaattcagtcatgtcttcagactccactgctaattctagttctcttgccgtttctaccacatctgcacttacttcttccactgcaatgctgaacccctcaaactcacccatgaggcgtggagtcagcttctcccaaactcctgttaatgttgatattttgacctcctctcatgaatcccgaatgttcttgatggcatctagaatgatgaatgcttntcagaaggtttttgattgactttttcaagaccatcagaggagtcatcatccgtggcagctatagacttacaaaatgcatttcttaaatagtaagacgtgaaagtcaaatttactccttgattcataggctgcagaatggatgctgtggcatgaaaccaacattcatctccatgaggactcttgggtacccggtgcatgatgtattttataaatatgaaactggagagaaaatccagcatgataattgaaatttgcaaccatgtgaccagaattcctagtaaatgtgggtcc

SEQ ID NO: 615381 - DNA, 863 bp, Homo sapiens
agggcttgaggaacccgcgccgatgacagtgcgtgttgttaccgtagggaccaccagctttgacgacctcatgcgtgtgtgtcggggcccgaagtctgcaacaaaattcggagagccttggatacaaccgacgttatcctgcgaagatttggtcagagggaacggtggtagctgaacccgttcaggtactgagtctgttgtactctggatgtgccacaggtacaaggattccttgatacgaaggcgattcagaaagcagatcttgtaattagtcacgcaggtgcaggaagctgttgtgagactctggacaaaaggaaagccactcgtagtggttataaagcgacaacgttgagtgaaacaaatcatcatgctgtgaagcgtggcagaagcaggctagcactcacacacgaggtgtcatctcttctattgttgccgtgcagcacgcttgcctgtggctgttcacacgtccaatggacgtttatcaacacctgagatgttgtccttcctgggcaggcctgcacgaaatgctgctgcattgtggattaagtggtggattgcaacatatatactgctaaactcctcaaacgactttaactgtgaagaccccaaattacgagctgatgtaggatgtacttcagatttaaattcatatatatgtttacgtaggaatatacttaggaatgtcttacatactatggatgctgtgaagtttatgttggtggccatggaggggtccaatcgcaatgggttatggatacaagaatgaatcaacatagatgttggggatcaggttaacaaaaatatggagtgaaaaatgtgaaaggaaaaagataaagggggtggaacaagagggtgaaagttta

SEQ ID NO: 615382 - DNA, 372 bp, Homo sapiens
atgatacgagttgagctggtaccacatgaggcttctactgaagaacacgaagcttagatgtctgatctcagtgcctagggtagcagcatccacggctaagcgagaacaagcacagtcctgtccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaag

SEQ ID NO: 615383 - DNA, 1317 bp, Homo sapiens
ctcttaatgaactgatcatgttgtcagttgtagctcttatgtgtttatttttatatgttctatatttatttgtttttgagtacttttatgttttcttgtttctttgaatttgtcagtagtgtcagagctttttcttgatgttaagtagaattagcactgattatactattaaatcatttagtatggtttagtgtatttgtgtatatatggagtatattgttatttattgtcagtgttttttatttttctgtttctagttgtgttctgtgtcatgttattcgaggttatgatttgtatggttttgggtatattgacgtgattattatattatatattgtgttgatgtttgatctttcatatgtgttaattattatggatctaattatttgattatattttgttgatattacctgtattatgatgatgctagattattattgtgtgtcttctgtttgtgtaatatattcttatcgtcttgagttgctctttattcaagtgttatgactcaggcattcttggtctttccaatgtgttgaaaatattttttgttatttttgttgtctatgtaaaatacagtctgactatctgatggatttgtctttgtgttgttttgttgtagcatgtagtgattatcgttggtttgtatatttgtcatgtttctgtgataatggtttcttttttgtttttgtgtttctcttctcctgtctgtcattccattgtgctctgtcgtcctgcctctggctgtccgtctggttttctgttatctgctgtagctacttcccttagttttatatgtgtcttcttgtcctctcatggccctcgagacagtttatatattggatatgctgtcttgaggcccccaagttttttgtaacttaagcagtatacagcatattagtcagggattctctcatctatactgatgtagtaaatctgaggctccttatagtcacttgcttactatcctttgtatagctgtttctaatatgtgctattttgtggatattttgtagtagtttatagagcataaatcttactatgtactggtggtgagagaccacacattttatgagagtttggaattattgttagacatgcccgaaaacttatccttgggcctataattatgaaaactcatgatcgagatatatgtgtatacatactatgtatctggtttgtcaggcttacataggtaggctgctgaaattaaatctagactattcttttgatgccacctacacgtgttccgcttctctcttttaaagtatttataaagaatatagattgtacgagttttgtacatcttaggtttgattt

SEQ ID NO: 615384 - DNA, 378 bp, Homo sapiens
  misc_feature (293)..(293): n is a, c, g, or t
atggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgccctgcncctgggcaacaagagtgaaactccgtcttaaaaaatataagaaataaaaaaataaaaacctgtccccagactggatgagcaggga

SEQ ID NO: 615385 - DNA, 413 bp, Homo sapiens
gcagacgggggccagcacagtgagcatccacccagtcctggtaggctcaagctgcccttaccatccccatcccccacgcatggaccaactacctccgttcagcaagaacccaagcccatgatccaaagccttggctgtcccgaaattcacttacttctcctgttcagcctgctgccgccaccccagcgccagaggagttctgagccagccaagcttcaggtgccttgtctgtagcctccaagccacgtcacgaacgattggaccagatcctttgttgcaccaaagtgtcctggagcaagccttctgtggtggcgggggggtcttcgacattatcagtaacctctcctctaccaggggcggcattgaaaatttcagctgtgcccagcaactaggatagaaagaaaacaggggca

SEQ ID NO: 615386 - DNA, 269 bp, Homo sapiens
  misc_feature (170)..(170): n is a, c, g, or t
  misc_feature (225)..(225): n is a, c, g, or t
  misc_feature (233)..(233): n is a, c, g, or t
  misc_feature (252)..(252): n is a, c, g, or t
atcctccccccatacctctcccggtcaagcacctcacatttccaggtggaatctgatcgcacactgcacctcaacatctgtcccgacggtctagtcgcctcttcgtcgggatttccaggaccctgctccgaatgatcgtgttacccggcgtccccatgtgaccccgcaancaaccacagactggccaactaggcgcgggcaccacggccaacgggtacatacacntgatgacnaaagcctatcttccgctanacgtcttcaacaaatgt

SEQ ID NO: 615387 - DNA, 576 bp, Homo sapiens
  misc_feature (18)..(18): n is a, c, g, or t
  misc_feature (25)..(25): n is a, c, g, or t
  misc_feature (215)..(215): n is a, c, g, or t
  misc_feature (248)..(248): n is a, c, g, or t
  misc_feature (277)..(277): n is a, c, g, or t
  misc_feature (344)..(344): n is a, c, g, or t
  misc_feature (362)..(362): n is a, c, g, or t
  misc_feature (375)..(375): n is a, c, g, or t
  misc_feature (407)..(407): n is a, c, g, or t
  misc_feature (410)..(410): n is a, c, g, or t
  misc_feature (420)..(420): n is a, c, g, or t
  misc_feature (453)..(453): n is a, c, g, or t
  misc_feature (485)..(485): n is a, c, g, or t
agcggcgccctttttttnggcgggngggggggcaggttgcgaggagaggagacagagtttggttctgtcacccaggctagaatgcagtggcgcaatctcagctcactgaaatctccacctcacaggctcaagcaatcccacctcagcctcccaagtagctaggactacaggcgcctgccaccatgcctggctaatttttttttttggtatttttnagtagagatggggttcaccgtgttagccagganggtctcgatatcctgacctcgtgatctgnccgcctcggcctcccaagaggtcactttggactgcaacatgcaatttccgggagagatgaattagcngctcacaccgagatgatnagcgtcacagggngtctgaagcagatggaagcagacactccccangcnggaggcggcngtgaaattattccagcagtacagtcggttggtnccacaattaaggttacgcagtggggatttcangctcatcttcaggttggtttacatttctctcaacggcaagtggtgccatgtatggtgtgtgtgtgtctgcgtgtgtgtgtgtgtgtgagtg

SEQ ID NO: 615388 - DNA, 189 bp, Homo sapiens
  misc_feature (63)..(63): n is a, c, g, or t
agtgcaggcagcataaatggtttggctacttcttatctttttggctatttcagagctcttatntgaatcagacagaacggaaatatgtcagttttgttggtattttaaaaatgtatcccaaaacactcagaaaagtattcacctaaagccacatgatccaatctttctattatttcactagaacatacc

SEQ ID NO: 615389 - DNA, 139 bp, Homo sapiens
cagagtgctgctcttggcgcccacaggccttgatcaacaccatcacagtactggagcccacggacggacgctgagcaggctggggaaaggcgacgaggcaatctggttccttaaatgcccaactgttcgcactgagcag

SEQ ID NO: 615390 - DNA, 285 bp, Homo sapiens
ctgtcaggaggtgaaggaaaggagtcaggactgtgcgccaaagaggctagaagcgcttctcttggtctttctcttagtccggttcccgcttgccgggacgtggactcgctggtgatggtgacgacgctagtggggagggtctgcgcgcggctggatgctggcgtgctcggggtgctggcagacacctcgtgttatcagaggagatggcggaagagatagcctggatccatgtgttaatttcctcatatctcttctggctgtagggtggctcagtcgaacggactg

SEQ ID NO: 615391 - DNA, 318 bp, Homo sapiens
  misc_feature (269)..(269): n is a, c, g, or t
ttcctagaggatcccccgttcatgtaccggggtaaatggtgggggctcttggctgtgcatatcccttggagaatctggcacccagatgagcttgaataccttaccactattctcggtgtgtctcgcctaagaagtgtgacgcgtgtggtttgccccgatcttaagtgagctcatcaaccatttccaagtaagccaaatgactcgcttcgcgttactgttcttcctgttcggtgccatgtccgactcgcagatgcgtgagagagccaagngctattctggtgccagtctggacgcatacacagcgttgaggaagggtga

SEQ ID NO: 615392 - DNA, 117 bp, Homo sapiens
ttgagacggacgacactggatactgttgttgaggagaacacccagtgtggtcggtggtggcaagattcgtgctacagaccctgatgaaggcctaaatgcccagatcatgtatcagat

SEQ ID NO: 615393 - DNA, 320 bp, Homo sapiens
gagagaatgtgttgaaggcaagaaggagggcggggacccggggaagggtggcagcaaccaagaaggccaaacgtggttttctccaacgttttttccatgtttgaccaggcccagttacaggagttaaaggaggccttcagctgtatcgaccagattcgtgattgcatcatctgcaaggaagacctaaggaggacctactccaagctgggtgcgtcaaccaacctccaaccctgcgaactggggtccctactctgagctgcttggccgggtgggaagttgcttgggggacaaggaccctgctcccctgctgaccctccgtc

SEQ ID NO: 615394 - DNA, 606 bp, Homo sapiens
agcggcgcctgagcctcggaagggtgatgtggcgtgcaggcatcgacgacctcgctatgtctgccattttcaatttttcaccagtctattgactgttatcttgttgcttatatgtacctgtgcttatattcgatccttggcaaccaggctcctggacagagaattctactggatagtggcgcgtatatttcggaagtgtgccagcaattcggtagaacggaagagtccttatgttgcagtatgctgtatagtaactgggcttcagcatcctcttcatatcagtagctggggaaactgccagcaagtgtagttgccatcagatttgattgtgaacaaggactgactgcagaaaactcaatggcaacggatgtataagctctttatatctccgaatcattgacatgagataacatttccatgatgctgtgctactatttcaaatgtgcatgggaccaatgtactgtatagacaattaagatgtaaccatttactagtctgtgacattcaagctcagtactgtcactacacatattacactgctgctaatgttatcctgtagtatcagatacaaaacttggaggtgagcgtactctctaagggcaccta

SEQ ID NO: 615395 - DNA, 1508 bp, Homo sapiens
  misc_feature (513)..(513): n is a, c, g, or t
  misc_feature (636)..(636): n is a, c, g, or t
  misc_feature (715)..(715): n is a, c, g, or t
ctatatgagacccgtcatgtatcttggtgatgttcgcatcattcgtcctcagaacgcacttgttagtagtgtgggtctatactatgttgtactaacacacgacgcgtccctacatatgttgtaaagtcaccacaccacagcctctggtggttttctgctcccaccccaggtttaaaaagcctctcacggggaccgcaaataggtgcactgtcggacacgggggagaaatctcactttggggatagcgccaaaagacgcttctagcggagtggagagccccctgcgaaataggtgcagctgtctgcacaattgatgggaagacctgcccactttaagggggccttgcccccatacccaagaaaaagttgttttggaaggaaaatttctttcttaaacggtaattaaaattggtgtcccccacaaggggaaccccgttttttttctggcccctcggttctcagaagaccccaaccaatgtcgaagaattctgttccttttgccttggcgtggaantgtgtgccagaagacacccctcgttaataaagtgtcctcttaaaatacgactaagggagttctttctttgaaccacaaaattggagggtggctaaaaaaggcgcggggaaatgttttccgccngtaacacgggtggcgccccttttggggttataataaaaatttaatggcgcacaagatgtccttcgttaatccgagaagnggtttccacaagagcatttaaatctttaataagagacgagatttggagaaacgttatataaacccccgagaaatatatgcttgtggagaatttggggagatacacccccgtcacacacagtttttcacagcgagagaaatgtttgacacacattttgggagacaaaaaattggttttgcacattaaaaaggggagacaccggggtatatatacacatctacatgtggccacaaatttcacatggggtggacacacagagaatgtgagataatcccccaccctcgggaggccacgcctatatttatgagggagaccacagagatttgtgtttcttggagaaaccctcttctgccacatacttgggagaccacaccgtagaaattgagaaaaaatatactcggtggacacacactttataaatataatgtggggctaggttttcttaccacaatgagaaatgtttctctctaggagttttaaaaataaggcacggtactcttatactaatcgttaactgtaaccctcgcacgtggttgagtattttataaaatagaggtttttctgcacgtatagcttttaagttctaagagaaagcaccacgagtggaggcacataactttcctcttctttgaaagaggaattccccaaaagttgagtgttcattcttaaaatggcacatattgtgttaattcttaaaacactgggcacaactttggaagaaattttaacagaagcctcaatgatgatcactttgaattgcttgtgatttccaaaaataaagccagtgaagcca

SEQ ID NO: 615396 - DNA, 371 bp, Homo sapiens
tgcggtcgtctctgagattcccgccggtgacgctgccgctcagccttctcacagtactgcgattatataggccttagccactgagcctggccctgatgcgtttttctcaaaggtcctcagtgtgatccttatcatttgtcattctcctgctcctggagctcacggatcttctctacggagagccccatgcactctctgtttgtgtagagcatcagttttttcatactaatgcgaggatcgatggtatcaagagaaagatgtatccgcagggagatctttcccagtgctgctaccatttctcctcactcacatgagacccaaatatcaaaataatggtcaataccctctacaagcccttttggtttggaaga

SEQ ID NO: 615397 - DNA, 114 bp, Homo sapiens
tgatgttgattaatgaatgattgattcgtgctctgaagaaatgttgtctgtaacgctagagttagtaacagacaggacaactgtctctgttagatagatggatatcttcaatca

SEQ ID NO: 615398 - DNA, 919 bp, Homo sapiens
acattttcattttggtcaataagttcaaactaccaccttgaggcaaagtaattcgaacacggtgtcctttgtataaggaagatataaaataataaggatcacctttctttttagtgccaaaaagatattattgacaagtcacatgtcagaaccgccggtctggaaggtataaagcaggatcatgtgaagaaagatgaaaaatacgatcatgaggtcatcttagatatgtatgttgatttgtaagcaaaaacgagtattaaagtgtaaagtagttggttgtgacaaattgtaatactttaatagcatggtattaatcgtctatgtatggtcttggggggaattcaagatgggtcaaatattggtgatggaacaataaataaagaacctctagcagatggaataaacagtgaatttgaaatagccaaatacacgaggatatgcattgtaacatggaaggagtgtacccagtcactccatgcagctgatgttaatgaaacttctccctcctcctatctgtttccagggtctttgtacaagtggatgaactgtggacatttccgaagatgcagataccaaatactgttgaggaagctgttgaggatcattactggtggggccccagagctagctgtagaaaggaacggcgcgggggaaagtaaagcaggtatcaaccaaggcggtcagagggccaacggaggattcagaatgacgcatgcaggagagggagcggtgttcccccagtcatgacattaaccgagccggcagacgaaccggatcgggaggggtttaaacggccccacagaaatctggcagagcgagagccaggggcggtaaaaaaaagaagcggggagcgggagcgaaacaagatctggggcgccccacaatgtcggtggagaaccacccggggttacccaggcac

SEQ ID NO: 615399 - DNA, 349 bp, Homo sapiens
catccactgcatggtcccggcatacgggccctggtcccaggcaggccgtggtgaaaacaggagcccgcccacagcactctgaaatgctccactcacaccttataggccctaggcctggcccaggccttgtcccctgtaaacctgctgttggctgaagctctgctgaccaggctgcagcctctgctctgtggctccattcacggcctgttttcatctacaaaggccctgaggttcccattcaacccccattgccctacggtcctggtagcaaaaagctttttccagagcgtgcgttgttctttcaaaaggatagctatcacttctcaccatgcgtggactgccagtgggt

SEQ ID NO: 615400 - DNA, 402 bp, Homo sapiens
tatcttccaggatgctcatagccctacctgatgattaagattcctacaggacagagcagaagagctctcgtgaagaattacgaagtatggagatgactttttctctcttctataggataaaaatcctattcgttattcaaattcccatcttgtcactcctcactctctgtgagttaatcctcttcaatctatgctacagttgctcccagaatatcagatgctggactcattttcatcccttattgacagtcctagctgtgtcctgtttacatccaagttccgcatatgaacatggctctcctactgtatttccttgttagataatccattcctgaaccaattaattcagaatgcaactctctagagatcaagctaactaaaagtcatacttccatgttatct

SEQ ID NO: 615401 - DNA, 954 bp, Homo sapiens
agtataccactgcctgactgaacgcgtggctcccgccgtctcgcgccgagcagctccccctctgtggtaagaagccaactgggttgctcgtctcagcgaagtgcctgcgccccgccacacacgtgtttggtgggacgcgcccccgtgtctgacccaacatgggtgccccacacccgggttataacaatgccacaaaaagacctgggggtcgcgacacaacacgacgaacaatccgtgtgggggaaaaaaacacgggagggaggcccctaggatccacggcgaagacaaacatgttggggagacctccctgtgacccaagcgcgccagcattcgccgccgtttgctgggacccaccccaagggggacccccaccccccgtgtagggggccaaatagacgtcaccaggccccccgccaacagccaaccaacaggttgtcaaggcccgggtgtttgatctcaagacctcgtagatctgtccctcggtcgggaataaacaaaagaaaaacataggggaccgtgttctagagcggacaagtctcacccagtagtcgttcgcccccaccccagacaagagagagattactaaagggacatcaaagcgccacacacctagggggggagtaaacagtgtgagttggaaacatctaatacgctctccatccacggtttctacttccgtattcttagataataccttcgggagcactcggttctgggcccgccgcccacggagcaatcgcatcttcgttggtccccctcgtgcgaacatgtccaccacgaacagaatcagtatgccccctagcaagcatgttagtggcatacgctgaaagcatattcacacaaaagcccgcatgttctacgatttagattgtgtagttccaaaaaaaaagagggcacaacatttgtccccgaagccaaaccgtcgatttttctacaaccccgccccaccaaaac

SEQ ID NO: 615402 - DNA, 714 bp, Homo sapiens
gagcccgagaacggggctggaggtccaggtccgggttggtgggggtggagcagcacttcatcgccgcgggggtgctgggactccgggcgcagtgccgccggcatcatggacttcctgtgggacaagcgcacgggcctggccgcctagaaagatgcctcatcctcgaaggtaccattcctctagagacgaggcagccggggcgagttactgtgaattcactatcggagccgagaacaagcgaacgaagaagccgtgtcctgtgtcaagtagtagtgaccggacacgacgggctgccggcgagtaggacagctaccatgtccgtgacggagggtgcagccggacatttagccgttcgtcttcgcagcacagcaggacggaaagccaagagtgtagaggacgacactgatgggccaactcatctaccatgtctggggacttggctacaagagcgatatgaatatcgtcagcaccttaggcaaaggggaccttcggccgagttggtacaactgtgttgaccatcgcaaggctgtggggcatcgaggttagcccttgaagtatcatttacgcaatgtgggagaacgtataagcgcaaggcaagcttggactttggacgaatcacatagtgctagggaccaaaaatccaacgaagtaatggaccctggcacagaaccctcgtggtggtaccagaatgctgtgactggttccgactcacct

SEQ ID NO: 615403 - DNA, 744 bp, Homo sapiens
  misc_feature (529)..(529): n is a, c, g, or t
  misc_feature (744)..(744): n is a, c, g, or t
ttttaagacatgaccaatttattcagaagaattcatattgcgtttggcaaagtatatccggggcacgagatgttcgggataataatgtcggattggaaagcaggtcactttatctactagcaaatgcctggggtaatatctgaaggagaggcaaaactttgaaaaagaattaagtatgtgggggggagataatcataaatattggcgaaggtaacaaaaaaaaaaaccgagcttatacaagccgaagggacaaaatatgcgttaagtgctaataatcgcttatattcaatttagctcaacacacattaagtgaacttaattgggtggcaaagagactgggctatgtagcggggggtagaggtggaaatacaataaacaccaagatgtaatccctctcaagaattggtataagtctagtaagagcacatacagagatggtgctatgccggtaaaaactggtctgaaaccatggggagagaagagtttaccttccttaccagagggtgaagtcgggagcccatttaaattngggagtatgggtagacgagaaggtcataagcacgctaaggaaacttggtgtcataagcatgtagaccgggaacagataagtggtcaagtatcctacatggtttaaatgctgaaagggaaaacgagttgtcaaaggtattttattttatcccatgttagcgagtatagggagatgagaacataactgagttgaagaggagaaataagtgaaacctn

SEQ ID NO: 615404 - DNA, 305 bp, Homo sapiens
  misc_feature (186)..(186): n is a, c, g, or t
attttaaatggccgttgattttgccaaattccattctatgccattagaacgctgtccacactaagttccgttaatgggggtaaactcccatcatttgatcttaagtatggtaaaatagctgtctagaaataaatgaaccagagtcctggaaaatccagtggagatgcctagcaatgggggtcccanagacttcagcgtaagtgcttatccttgatgcgccatcctcctaccttcctctaattgtttcttaatgcacattgttgttcagaaaattacacttgggatttttatattttgtgatttga

SEQ ID NO: 615405 - DNA, 233 bp, Homo sapiens
tggatgcgctacaggctcatttgcaaatcaggtatactcgttatagtggcctaatgggtcaaaagtacagagtactgttattatagtttaataagaataatgtgcggcgcatagtcccaggctactcaggaggctgaggcgggaggatcactggagcccacgagtttgagacaagcctgggtaacatggcaaaactccgggtctacaaaaaatacaaaaattagccaggcatg

SEQ ID NO: 615406 - DNA, 334 bp, Homo sapiens
cggccgaaccaccgttgccgcacttttgcattttgccttcgttgagcaaggcactgaccatcacctgactggcttgctcgatgtgcggtgcaagtacgtccatcgcctgttgcttggtgtcgatgctggcctggaaaagctggcgaattcgggattgcatgtccatctgtgtgaccttaagtagcgcggctgtttggcacaggtaatgtgcagcccgcaatgcaaagagcaaaagtgagtggtgagggtgcccggcgaatcagctgtcgaaggcatttttaagccaggtcagatcagctgtgcctgacggggtgctttcacagggtaccgagct

SEQ ID NO: 615407 - DNA, 328 bp, Homo sapiens
cgtatcacaaacatacgaatctcttaagggcggtggaccccaacgcttcctgatgaacatgcgctttgcccagaagcacaacaaaaagggcctaaagaagatgcacgccaacaatgcccaggtccatgagtgcacctgccgaggctatcaaggccctcgtatagcccaaggaggttaagccctcgatcccgcagggtgtcagccgtcaagctcgatcgacttgcctaccttgcccaccccaagcttgggaagcgtgctcgtgcccgtattgcctaggggctcaggctgtgccggccataggcctatgcccaggccaaggccaaggctc

SEQ ID NO: 615408 - DNA, 415 bp, Homo sapiens
  misc_feature (8)..(8): n is a, c, g, or t
  misc_feature (15)..(15): n is a, c, g, or t
  misc_feature (78)..(78): n is a, c, g, or t
  misc_feature (96)..(96): n is a, c, g, or t
  misc_feature (117)..(117): n is a, c, g, or t
  misc_feature (197)..(197): n is a, c, g, or t
  misc_feature (216)..(216): n is a, c, g, or t
  misc_feature (240)..(240): n is a, c, g, or t
  misc_feature (242)..(242): n is a, c, g, or t
  misc_feature (334)..(334): n is a, c, g, or t
aaacaagntaaaacntgccgatttcctgcaggctgtgtaagcatgtttaccctgttggcttgcctttgtgtgtcctgntaaatgaatgtcatatgnaaatgcctaaaataaatcganagtgtcctcagaactgaataactgccagtgacttgatgcccctaaaacagtgtaggatttaagaatagatgatttttaanccggaaattgtgattgtgncccatgagtggaggaactttcagntnctaaagtctgataaagtgtgtagcccgaagagtacttttttttttgtaaccactgtcttgatgggcaaaataattatggtaaaaaacaagtnctcgtgtttattattccttaagaactctgtgttatatttaccatggaacgtcctaataaaggcaaaatgtggttgtttgca

SEQ ID NO: 615409 - DNA, 675 bp, Homo sapiens
ggtgtaaggcctgcttgatcgtgatgaataagctttttggtatgctggtggatttgatttgcctgtattttgttgaggacttttgcattgatgttcataaaggatattggccttaaatttttcattttgtctctgccaagtttttgtatcaggacgatgctggcctcatagaatgagttggggatgttagctagttattatgcagacttgtttctgtagttgctttatggtgtcactggtctgtgtacttcagtgtgtttctgtagtggctggtaacattgtttcctttccatatttagtgcttctttcaggagctcttccaaggcaggtcgtgtggtaatcaattttcctcagcatttgcttgtctgacacgagaatcttcttaggctgggtgccatggctcatgcctgtaatcccagcacttcgggaggctgaggtgggaggatcacttgaggtctggcgttcacgatcaggctggccaacatgatgattgctccccgtccctactgaccctccccccccttccgctgggcatggtggtgggtgcctgtcgttcccagctactcgggaggctgaggccggacaatcacttgacgcctgggaggcgcggttgcagtgggtccggatggtgcccctgagcctcgatcctgggccgtcgagtcgagactctatcta

SEQ ID NO: 615410 - DNA, 471 bp, Homo sapiens
  misc_feature (245)..(245): n is a, c, g, or t
tgatctagaggatctctgccaataacctccaaggcccagtggacgtgagttacacatctggtacgggcatagaccctgaggatatctacaaaactgcccttgcaaaatacaaggcaaagtacccaagattttctaaagccgacattatcgaattggcagagatggagttaaacaaacaactgaaagacgttgatatatttacccacgtggaaaaacagagtggcaaaaaagtaaatgttaactgnggcactattaaaaaacctctttgggaggagatcgaagtcgattaccggcccaagcgcttcggctcgtccaagaaacgaacaagtgcggcccctgccgaaattcaaagcccctcgaaagaactcaacgccctgggtgagtacaaggatttcaaggatctacccgagcctgaaaaaattaaaaacagtattgcctttaccccctctgaagacgggaggttattggcat

SEQ ID NO: 615411 - DNA, 200 bp, Homo sapiens
  misc_feature (115)..(115): n is a, c, g, or t
tgatacgatcgagctggtacccttatgccgtggggggtaagggaggttagcgaggctgtagaaaagtcatcaaaagcatagtgggagtagagttgaagtcctttggaaacggagnaggattatgatgcgactgtgagtgcgttcgtagttgggttgctaggcagaatagtaatgaggatgtaagtccggggcgattatga

SEQ ID NO: 615412 - DNA, 296 bp, Homo sapiens
cagcccttgggccccaggggggggcctgtggaatagggggggttcatgccccccttttttccccaaaggggggggactcaggttagtttgggggggggggctcctgccctttcccccaggcccggggggggttttttcctcccccccttggccctcccaactggggggggcctttttaaaaaggggattcccccggcccttgcccccttccccagaacaaaacatgttgttcatgggcaattttttttttggggccgaaaacccccaatgagggggattaaagctgttttccccca

SEQ ID NO: 615413 - DNA, 484 bp, Homo sapiens
ttttcctgaactttcggtgttctcatttttaaatcattgctaatataaccaaagaaaaatggtatttccatgcgtatattcattgcagcactattcacaatagcaaagtcatggaattaacctaaatgcccatcaataatagactggataaagaaaaggtggtacatatgcagccataaaaaggaatgagatcatgtcctttgccagtacatggatggagttgaaaccattatcctcagcaaactatcaggaacagaaaaccaaacactgcatgttctcacttataagtgggaactgattgatgagaacacacagacacgtgagggggaacaacacacactgggtacctgttgggggttggcaggagggagagcatcaggaagaatagctaatggatactgggcttaatacctaggtgatggggatctgtgcagcaaaccaaaatggcacatgtctacctatgcaacaaacctgcatatcctgc

SEQ ID NO: 615414 - DNA, 416 bp, Homo sapiens
ggcgtgaagccgcccccttacattttgcgaagtgcattatagtccttgtttttctctccctcgtggggcaacgcacccttcccctggcagtaggggtggggtaggtgactctcgctagatccctccaaagcagaccggtggcgatgtcagccgatgtcacgagctcgttagctgcgttcggggaaggttggggcgtcagggagctctcggatcacagcagcccccgccctctcctaggcctggcccgcagagcccccagagtggaccccccagcgactggggtcttctccccactcctccctccttctgctctgatgcgcagcgcgggcgctgcggggcctgtttgggacgaacagagctctcccttggtaagccttatcttgttaatacatggaatacctggctatattcaaaca

SEQ ID NO: 615415 - DNA, 86 bp, Homo sapiens
  misc_feature (3)..(3): n is a, c, g, or t
  misc_feature (48)..(48): n is a, c, g, or t
tgnggtatctagaggatcccgaaggagacacaggtgattgctctcagntttagtgctgaaataataaacagtgacaggtcaacagt

SEQ ID NO: 615416 - DNA, 344 bp, Homo sapiens
ttgatctagccatcccttagtacgccaaagtgctgggactacaggtgtacactgtatgagcccagcctcattgtgtttgtactaaccccctttccctggcctcttccagcttgtcttcttctcttctagtagtttcttcgtgaagaggccatgtgctatattccatgagatatttcacactcaaagaagacttcttttatactcttctgataatttgtctgggaatcattgtcttgatttataagggagtatgtaataaatacagtaaaagagaaacacacaacgtattttgagatatcagagaagggagaaaccaattctattaatatttgggcgtacgggga

SEQ ID NO: 615417 - DNA, 227 bp, Homo sapiens
tagttagttctagttccagttatgtagagactagggcatatcagactacttaccagctcagaactagaaaagaccgtcaaaacattttataacaatgctacttataagaatcggaaaatcagccaggtgtggttggctcacaccattaatacccagcactttgggaggctaaggcaggcggatacacgagggtcaggatgatcgagaccatcctggataacacggtg

SEQ ID NO: 615418 - DNA, 474 bp, Homo sapiens
  misc_feature (7)..(7): n is a, c, g, or t
gcgctancagtaggctagtagaggccggggttatcggcgaggcgcagtctgagaccaggttgtccgtcgtgctccgctgcctctgacttctacagctatcgccagtcgtcggccacgtcgtccttcggaggcctgggcgggcgtgctccgtgctgtttgggccgggggtcgcctttcgcgcgcccagcattcacgggggctccgggtgcgcggcgtatcctgtgtcctccgcccgctttgtgtcctcgttcctcctcgggtgcctacggcggcgagctacgtgcggcgtccgtgaccgcgtccgacgggctgctggcgggcaaggagaagctatcgcatgcagatggctcaaagcgaccgcctggcctcctacctggacaaggtgcgctgccctgtagcgcggtcaacggtgtagctagaggtgaagatccgtcggactgtgtatcacgagatgcaggggtctggtgccctccc

SEQ ID NO: 615419 - DNA, 199 bp, Homo sapiens
  misc_feature (117)..(117): n is a, c, g, or t
tgaatcgacggttctcttccaaaacactactcaaaaaatacaagtaaagagaatagttttttctttttcttttctcttttttggggacagagtctcattcctgtcacccaggctggnagtgcagtggcacccatctccaactcactgcaaccctcccccctccccagatcccaaagcaatttctccctggccctcagcc

SEQ ID NO: 615420 - DNA, 100 bp, Homo sapiens
catctcaggaacattgtaggaaggtttgttaagcatctcttaggtgtcgatgaatagcgaggtgccgatgaatatcgctattcatcggcacctcgcctat

SEQ ID NO: 615421 - DNA, 704 bp, Homo sapiens
ccggggacgaggacacatgcctgttttcgtcggagtcagacatgcgaaggcatttctcagaggcgagatgatgagcttgctacaggccatgaagaaatagtaaatccagaccgatacgatcaagaccctggccgagaaagatctagagccgctggacttgatggtaaggtattacgtaaactgtgcactgatgatgactatgacagagcagaatcagaatctagtgagccagaatcatcacactaaagtgcaagttggtagcgaggtatatctgagaccggagagccaggactacaatggcttaggtaaaccggaggttacactgatacgaaagatgaatcatagagcgatatagtaagaacacggtcagatagaatagggcctgtatcacgacataagctaaagtctcagagcgatgactctcgaggctacatagctacgaggtgacatgcaggaactagtgactacgagctacagaatgctctgcacaagatcgcctttgagaatcacccatgcaaacctccacccatcgtacactctaacgcgcggacagacatgccaagccaacttgcttaccaacaggccccaagaggaacctctacccaagacttccgccctatcaaccaagcgactctacagcttctccaacccactgactccctgccaccatttcacctccacggctctattacctcacaccgccc

SEQ ID NO: 615422 - DNA, 131 bp, Homo sapiens
acaggagtcgtttaggaaagtgtaaatttctgctctattctactccagtgatatcccctttactgagagagctggaaattagggacaagagcctccacctggtcggacatacttgagggtaggaaggatct

SEQ ID NO: 615423 - DNA, 946 bp, Homo sapiens
gtggaaacctccttgctactatagcgtcttatgtatggtttaaaggaaatttatcaggtgagagagatgagcaacgttgtcttttctctcaaagctgtaatgtgggtttgttttactgtttatttgtttgttgttgtatccttttctccttgttatttgcccttcagaatgcacttgggaaaggctggttccttagcctcctggttgtgtcttttttttttttttttaaacacagaatcactcgtggcaatggtcttgcagcttgccactgggtgtgcaaggcctttaccagcccttagcctcttagcacttctctaagttgccaaaaacaggtgtcatggggtggtgtccctttctggatacttagtcaggggaggattttcacaaaaaagaaatttacaatggtggtccatagtctttcagagtagctcactttagtccggtacctttatggggcggatatccggggtccagggtcaatggtcttctcttggcggatttatgttcaccagggtactcctaaagcatatgcctcacctggttcacacaacgaaccaaactggtcttgcgtgaaagctactggaaggggcctgtgggaactgagaaagtttcactacgtaacagatgagtttttttaaacaacagaagatatatcaaaaaacacaaactgttgttgcgccagtctgggcctgcgaaagaagttgtcaacaccaatgtgtttggggggggggccccaacgttgagtgcgagatgaaacatggggccaaagagggttccccagaagaaacatgcggggcacgcaacaagggggttggtgtcttcccccccaataaaaaaagcccgccgggggggcaacacggagtcgtttcgtaaacacatcacgcggagaactgcggaggagacacaaggggctccacagggggggatcacgggaacggccgatact

SEQ ID NO: 615424 - DNA, 495 bp, Homo sapiens
ctaagctatcgcactatatcgtcggtcgtatagcatataggtccaattatcatagggacatagatagcattgatggactcggtaatatcttacagcgatacctgatcagtacttcgcacgagattctcggtactatacatataggtccaatatcaaagggaatgatgcgggtaccgagctactagtacatgatcttgggccttgctgtttgcaactggagaaaaaagtcagagctggagacctaactgtgataatgattggaatatcaaccacacttaaggtcatgagagaagatagaggtcaccacgagaatgagtgtctactgaaaagagatcaagaaacttgagaccttacagatgatcatgttttgctttgtccatcaatacaagcaaaaaggctaacattaactcagggaaggcattttcatgggaaaccacagctcagcagtgcaggccatatagcttaggggccaaattctggcttaattcccatgag

SEQ ID NO: 615425 - DNA, 2069 bp, Homo sapiens
ggccagttggcggcgcgcactccaggtggcggccggctgcggtgaggggaccgcagggggcgagcagtcccggtggcccgtgtgggtctgctgtgcctggtgggcgcggtgtggaggcgcgtcttgggcctgctgctcactgtgacggcgcggggagggtttgtgtagggggctgctgaggccggggtgggctgcgggccacggagagcgcgagggttgacatggtccgggacccaacccattcgcggggcccagcacctttcggacctgcgcggaaaaacctttaccccatccggggcgcatgtggtggcctggccccccaggccgggactccaacttctcgcaggcggcccggttacgcgcgggtgaaccggcagtattgatatccatccatccggtgaagggcccgtgcggcccaggaagggacataagaaaaatccctggcggctattccagaagggggaagccaggcgcccctgtggggcgcccccaaacgcggtatacctcggaggggtgaatagagaggtggctttgcacccacgagaagtgtccccacgggaggcggaatccggggggacacccaaagggccgtttgacggtgcaccctgggagcattagtataactgtcgaacgtacgtgtgggagctaaaaatttatatccgggtaaccagcgcggcattatgtctacacggagtataacttgcgaggttcggggactacaaaaagcaactgtgccacgacacaacggagagcaatgtgtgcacggcattgttgttgcggaccccgcagtgattgaagggcctgacgacaacaggatgggaaacccgtttcaaacaaccgccaaccgacgacattgtgaagtcgaggcccaaaatatgtgccgcacttcaagatgaggcgggtcatacgcggggaagacacaatacgtgtcacgtcaaagcgccgcagcagtgggtcactgctccatgtttacgctggtccgcaacctcgagtgcacgatatctcttcctcactatccttctccttcccctccatcgtactatcatcttccacccggggcaagacgaacaagccgaagacagaccaaggtcgctagatcagctaagccgaaacaagcggcataggcgttagcatcagtagagtcaggcgagagcaaagcagcactacagcagacagaaccgacgcaacacacagcacagcaaacacagcaccaacgcgacgaccacaatgagctagtagactgcagccatcaagactacaccgaacatacgcacaacgacacgagacaagacaggagagaggacgagcaagcaagagaaggaagaggagagcagacgaagacgaccagagaaagagacgcaactcgagagggaaagacgagagagagaaggcagacggcacgagaagagagaggaagagcgcacaggagagggaaagcagcaggggcgagcgagaggagagaaggacgagacgagaagacgagagacagcagaagcgaagggaggagaaagagagacgaaaacagaaggcgaagacggagaggaggagcgggcgcggacaggagaacgagagaggccagaacgagagaaggagacgagaactggaaggaggtatgacacgagagagagagaagtaggaagaggtcggaagtagagacaggaagagaagatggtgaaagaagcgaaagacgtagaggagacgaggagaagagagtaggagagagaggaaggatgggaagaggagaggaagagatgggagaaagaaggagcggaggaggagaggaagaggacagaagagagaaccgagaagagcgaagagcgagagagacagacgagacgacggagaaaacacagaggacgagagagcacggagaccgggagaaagaagcagagaagagaggcggagaaagcgaagaggaagacgagagagatagaagaaaaagagagagagagagagagaaggaaaggagaaagggaagaagcgagaagagaagaactgacgaagaagaacgaagcggagagggatacaagggagaagacaagcacgggcagagcgaggggaggcggagg

SEQ ID NO: 615426 - DNA, 345 bp, Homo sapiens
cacgaggatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcac

SEQ ID NO: 615427 - DNA, 371 bp, Homo sapiens
  misc_feature (65)..(65): n is a, c, g, or t
taaatttaaaatcccctcaaaattttttgagcatattttaataataacatattaggaatattaantccttaacaatatattaagaatttgtataaaactcagtctttttttactgtagaataaaatgtcatcagtgcaaatgtaatacaattatctctgtgacaagttaagcaaagttgcatcataattctgcccaaattgtgtgacctggctattgtagtaggaagagggctgttctacgcaggaaagcgcgtatgtgcagttatttaggtgattaattttttttctgttggcattataagcactcatacatttcattagcattgagtcatttaatgtcagctatttcttgctgcctaaggagaaaaata

SEQ ID NO: 615428 - DNA, 318 bp, Homo sapiens
gtgggttgaccgtggcttgggcttgctcgtattttgttgaggatttttgcatctatttcgttagggatattggtctgtagttttcttttcttgttatgtccttccctggttttggtattagggtaataaccggcttcatcagaataggtttagggaggattccctctattctctactactgtcgaataagtgtacagtaggatataggtaccaataacttccttgaatagtacttgatagaattcagcagtaaaatataatactaggtcctggacttttttattggcaattttttagttcccatatcaatctggctgc

SEQ ID NO: 615429 - DNA, 137 bp, Homo sapiens
attcgcggccgcgtcgactttttttgatattttggacaggatctgagtctgtcacccaatgaagtgcaatggtgccatataagtttactgcaagctccaccttctgggcttaggtgattttactgactgaggctacc

SEQ ID NO: 615430 - DNA, 526 bp, Homo sapiens
  misc_feature (8)..(8): n is a, c, g, or t
  misc_feature (25)..(25): n is a, c, g, or t
  misc_feature (42)..(42): n is a, c, g, or t
  misc_feature (58)..(58): n is a, c, g, or t
  misc_feature (85)..(85): n is a, c, g, or t
aatggaanttgtaaaaaggataagnaggaagtccaaaataantctgttcttcccctgnaaagacctgaaccttcctaaccccaanatcccgtgaaaaagctccctttccttcctaagctgccccccaggccccaagcccccaggtaatcttgactcccttccctttcctctcccatttttcaagcctactttcccacacccctcccaacattccccattctgaactaaggctatcagcatctctcggctgggcgcagtggctcatgcctgtaatctcggcattttgggaggctgaggaggaaagatcacttgaagccaagagatcaaggccagcccgggcaacaaagtgagacctcatctctacaaaaaattaaaaagttagctgggcatggtgtcgtgcccatgtagtcccagctactcaggaggctgaggcaggaggatcactgagcctggaaggtcaaggctacagtgagcccgtgattgtccaccgccctccagcctggccagcagagtgaaaccctgtctc

SEQ ID NO: 615431 - DNA, 555 bp, Homo sapiens
caccagttgttttgcaaactcaccctgcggcacatcaacaagtgcccagaacacgtgtttaggcccacccagggccggcgggaccagccagctttgtgttaatattaaaaatgtcaaaagcaaggggtggagtacgtgcctgccttcctggtgccccggaggaggaggagggaggaccaaatggacggttacgggccttgcccccgggaaaccttttgggagcccccatccagtgattaggggggagctgcaagttatgacagcatgacaaacctgttcccccctgagctttttcccaaaaaggaccttggaagcccggaggatggggatggcccttatttctttttgacaaacaaaaaggattagaaggcaaagccccccaaaaaaaaggcccctgattaaagcaggaaaaaaacgcccgtgtacccagggctggtccaaaagggcgggaaaaaacagttgggctcgtttaaaaaaaagttccaaagtcatccccgccaaccccagaggttcaggtcctgttaacagcccggttaattaaagcccattccgtga

SEQ ID NO: 615432 - DNA, 1294 bp, Homo sapiens
ggccctgacatggcacgggatgagtcacctgccctgtgcagctgcctggcagtggctgggacaaggatcttgacagaccagacaccagagggccatcattcaaagggcctactccactcttggcactccagagcaaggcagggtgcccggattccccaacacctccaggcagtgaccctaggggcatgccccagacacggtcatcctgagacagacacaacatgggaggaacaccagatacgatacagagcagcgagttccttgtgacccatatatgcaccaaggatcgtgcagtcagtaccatgcacagcatgcgcaccgcggggcccatgcgatatctataccgcggtgacacatgacacagaatatcactatgacacaaagactgatccacacgatgaacattggacattcaccatgaccagtgagaactcatgaatacgccatccgaatgagagggccgtatcatataacccaacaaccaacgcaaagaagcacaccgcaaaatagagagagagaattggcgagagacacaatggggacatggatgagaggcaaaaatgagaaggggaaacagttatgtaccacaattgtagccacagaaaacgttctatgcgacagacggcaacgacgcgacacttatcacagatattccatgacacaccacgtatgtgggtgccaagtgggcaccaattgtacacgggagtgagaaggcacacccacaagcaggcaccacatatgtgtccacaatttacaacagtaggagaatagtacccacttaacgtcatgaccactatccaatcgagacgacaccctatgtaggacagagaacaccacccagcagcacacagagcgacccatatgactacggaaaccatttacaatcatgaggtgcacattaatcactccagcaaaccaccaccacattggagcgccatatgagcgcacatatttaacacaaaacaatgcgagttacgaagcgaaagtttgggtccaacattggggacacccagatttacagaacaggagaaacacccagacaaacacaagagtgcgggcaccccaaaagtgaggaatgatgagacaaacggctcacacccaccattataatacccacgcgacaccatatatgggagcaacaccaacatcatacgactcgcaagtcttgggggcatcacgacacaaaaaattaactcccacgcacaatacaacttgagtgaacaaggacaactcaattcaccacgagtggagtacacaccacagcacccacaacgacttatagggggcagacaat

SEQ ID NO: 615433 - DNA, 1039 bp, Homo sapiens
  misc_feature (574)..(574): n is a, c, g, or t
  misc_feature (583)..(583): n is a, c, g, or t
  misc_feature (593)..(593): n is a, c, g, or t
agcggagaggttacatgacaagatgtcggcggatggtagcttcgagcccttgcggagaggagcatctctgtgacagaatgcttgtctgactggcgtgcttctagtgagctaagtcgaagagagcgagggttgagcgcggggcagctgaccctgtcagggtcgcctcaaccttgggcaacctggcccagactggcgaagactgtgaacttgtggggacccgccaggggggaggtggaagaagtggtgagtgtgcgcaaaatgagctacgtatattgcaccctggtaatccaccgcgtagggaaggcgcgtggagagcgcaatgcttcctgcttgggaacccgcatttcgattggcctgcattgacctgggtggttagaagcgcctgccgagaaattgacacgagcgaacgacacaggcagaccaagggggcttttggaaatgcgccaaagtgcccatacttagaattgaagccgcagtcgatgggtcgatcgtagcgattcagacgagacgagtagaattggtcccaggcaggagagagattcgtggatatggtagcgcgactatatgtagtgancactttgancgttagttantcttcccgccagcgaggatatggcagaagactattggagattaggacagtacagaggtgtggaaacgagacgagagacaaggtgggtacgacgatcattagcgcggaagataaaggggagtcgagatggagttttacgaagtgcttgacttattagtttagtaagtggacgccaaacgttgagaaaggtttggtcagcaggtgtaatcgaaaagagaggaagacttcaatgtatattatgccaattgcgttattgcaggcttgcagagatagtggctgtgggacccctgagtgcgaggaacattggagaaacttctgccattaacggattccatcagaagctatgggaaaccacgattgaatgaggttacaggttcctgaagaatacgcagatcaatattgcttgcatccaggccaaagaaaggtcctccagtttggtgggaacca

SEQ ID NO: 615434 - DNA, 1074 bp, Homo sapiens
gcagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgtcttattgagttctgaagtgttggaactgctgccatgattttggccactttgcatacctgggactttagtggctagaccagttctctttgtacacggacttgtgcctcttgggagacgtccacccgtttccatgcctgggtccaccggcagtctctggagtgtgtgggggttctgggaggcgggtcccagagccccctgtccttcccacgggctactgcgagtcacccctgtatggcccgactgtgctgttgtctgccgtgagagccctaatctgtgcctataccccttcatcacgtcacaatgtcccgaattcccagtcctcaccatcccttctcagtaatgaccctggttggttgcaggagagtacctactccatactgagggtgaaattaagggaaggcaaagtccaggcaccagaggtgggaccccagcctctcactctcagttccagtcatccaactgggaccctcaccaggaatctcaacgatctgattcggtgcctgtatcctcctccgtcacagatgtgagccaggtgactgctcagctgtgaccctaggtgtttctgcctcgttgacatggaggagagccatttcccgttagaaggcctggacctttcgtgagctgagccacagcagcaggctgggtgtctgggtgcacgaggaggaccaggatgcacggcaggcccaggaggccccagtctcgtgtcccaatgacctagttgatgtggaaggtcccagaaagcaggcgtggtaaggccacttcatttgtaagcctcaacgcagagaggagaccccctgggaagggattccacgagccatgagacagatatgtattgaggacacatatattggcgccccatgcgaagaaaggcagttgatggaccagcttgtgtaggaaaaaactcttgtggagaaaagtactacagg

SEQ ID NO: 615435 - DNA, 225 bp, Homo sapiens
  misc_feature (32)..(32): n is a, c, g, or t
  misc_feature (151)..(151): n is a, c, g, or t
cacagaagagcagcttttgaaagataaaaggntccagcagaaaattaaacgattcaaattgagacaagcacaaagagcacatttttttgcagacatggaagaagaaccatttaacccagactacgttgaagtagacagagtattagaagtntctttttgtgaagataaggatactggtgagcctgttatttactacttagtaaaatggtgctcattgccatatta

SEQ ID NO: 615436 - DNA, 920 bp, Homo sapiens
attggacgatgacaccccagtctcctagacatggtaacagggtcacggctcgtacccagactggagtcacgcctggcgtagaccactcgcttgtggctcctggcaagcggggagtggacgtcccaggacgcatcagccggccgcggaaggcccagggacccgggctcagacgcggaagacctctaatagcgcgagtctctgtacgggtcatgtcggtcgagacgaattggcctgttcgtggtcagcttcatgtcagggtgctaactgttgaaaagcttcttcacagaattacgacccatcgagtcagggcagtccacgtcctagccccggcatcctgctctagggcccctcatgccccaggctggagcagctctcctaggtcacatgcctgctgggctgggtcgcgtagcccagggtggaggcagaacgatgctgctgtggtacgcctctttgcctttcatgcccatgctggattgtccttgcacctcagcagctgaaggtactcagagaccagtaatcagaaggcatccgatcgtgcaggtaagtgtgcagcgctgagaagacaatgtacaactaaggcacaggggatttagccactgtgggagggtggacaggcaaataggtttcacgtggccatggcatgttaggcaggaactctaagtgcccaaggcctcgttgggctagcttgagggaccgtgcgctcctgtgttctatgagtgcatgggtcatcttgtctatgggtgtcctatcccatatggagaagaaacggggctctaagttaccggctcttctttctttggggttctctgtacctgaaggaaaccaggacctgaggtgactttgcagatctgctcaccctcggtgagcaacagtgtcagccatggcaagcaggacagaatggtgactgggtgcccgtggat

SEQ ID NO: 615437 - DNA, 133 bp, Homo sapiens
tgtcacacagcttggagtgcagtgtttgatcatagttcattgcagcttcaacctccctggctcaagcaattctcctaccagggcatttatttttcacatctctgcatgcatccaacagtgctgtgtgcccccc

SEQ ID NO: 615438 - DNA, 266 bp, Homo sapiens
gacagggaggcttactctggcacccaggctggagggcagtagtgcaagctcggctcactgcaacctcaggcaggactatttttaattatttttaaaacccgcaaaagggaatctgcccatgcccatccgggtttttacaaaaaactgggacccatggcaaacctgtttgcctttgggggcccacatgaaccatttggcaaaggcatccaatgctaacggggcccaccaactacaacgggggcaacaactctggggattttttttca

SEQ ID NO: 615439 - DNA, 980 bp, Homo sapiens
ggtcgcgccatgttttgatggcaggaagagtccggttctgggaaaagctggagacagtggtggtgactgcaaataacttgaccaaaggatagctataccgcgaagtatgttctccagtcgaagatgggcaatgtgcttggttaacagagccagactggtttccttatctcccaggattacgctctttagtttgacacgggttgtcaatcccaaagccttttcgacggctaaggatcgtcacggttcggatgagtctcatgtggcgtgctgcatctccagatatatgctgctctgaacaagtgtggggccttgatgaaaggctatggagaccctttgaacctcaagatcagaggttccaagcttgctgggaacgctagggtcattgatatgtcacctcgagtgggactgcttccacaggaagtagaaagcctggtatcatacacatctgttgggctgatgttgccgaagcagaaaccctttgagtcgaagtgatagaggagcactgacgttctgtcgagtgggccacacgtatgtgcaactgacattgcaggggtgtaatgactgcacctgttggaacaaagaaactgaccagtgtcagaagactttactttgggaaagctgccaggaggtagacgtggtgcaattaacagaaattgtggtgctaggaaattgctagggaagaaagtattttgggaaatccacgtggtttcccagaaagtgagccacatggccacaactagatgatgtcttgactgtgaacagcatagacaaactgaagaatgattatgcccgttctggcagtgcacgaaagtagagatggaagggaagaggtggctctttaacaaggagttcatccattgcgtgctaagggaacatttgccatgcccctccgagtggaggtaatgggggtcgctttattggcccatcactgggtgggattttgggacgctatccaagcaaccttcgcaatgtgagctgcg

SEQ ID NO: 615440 - DNA, 109 bp, Homo sapiens
gcacatgtaaacattgctgaatacttttgccctagctccaatgttcagcttctcgtactttacgagacttaaatcgtccaacaaatactcagcgatcatttggggagca

SEQ ID NO: 615441 - DNA, 648 bp, Homo sapiens
ttcttgtctagctagaatgatggcttctctctgtgtagctaactgttcttgctgtgcctgcaagcacgagaagaataacttgaagagaaaagagtgaatgggagggaagaatatcggccgagcaggtcgacgcctctccgtgacccctagtaccaagcattcattcgcctcatacctcttaatgaatctgagagaaaccaagaagccatgttcaattaagcagagataatatagtatcctcaggtcactcagagataccaacattgcctgatgggctgtgggtttatcacatcttgtcttacctcaacaagataatttgattgcacttgaagaacactctgcatgcacagacagatttccttccttctattgagaaaacccagaaagaatggctttgtcaacagcatgtcacaatttgaggaacaaggtatcttctgagcatttatccagtctcaccatggtgcatttgcaggcacttcaacagcagttagatacacagaagacagccattcgatctatacaggaagtccaagaagaatcgcttccggcaagcattacgtgcaattggcagaaaagggtatcatctgaaccagttgctcctcttcatttgtatcccaggtgcctggttgtctgactctgaaagaaccc

SEQ ID NO: 615442 - DNA, 151 bp, Homo sapiens
ctcggcgacatgctactacacacgcgacacagcatcatcactgtaacacagcacacacagctccacacacaaacacagcacacacatgcacacagcacatgcacacacagcacacacatgaacacagcacacagcactaggtgtctgccaa

SEQ ID NO: 615443 - DNA, 365 bp, Homo sapiens
aacggatgcgtccgcactggactctgcacacttcttacaatctgatagtaatctgcagagcagcagagatacggcaaggtgcacagagatggaaatataaaatccacgtaagttatgcagagctgacaggaccacgtcttaggttccatggagaaggtggcaagcccggtccccaggccgacgagaagataggcgatgaagtagagggtgcggacgctgagagaactcctccagcttctccaggatagctgaagtagaaggcaagccactgaaggcgtagatacacaatgccccaacagaccatggtcacgccgatataagtacttctgatacagcctctgatgtgtgcggggcctagtaaggga

SEQ ID NO: 615444 - DNA, 770 bp, Homo sapiens
ggaccgggtgactggctgacttacagcagtcagactctgacaggatcatggctatggatggaggtccaggggggacccagcctgggcatcgagaccgtgcgtgctgatcgtgatcttcactaggtgctcctgtcatggctctctgtgtggctgtaagcgttagcgtgtagcatttaccaacgaggctgaagcagatgcatggacatagtactctcaaagaggtgtggatggcttgtttcttaatgatgaagatgacaggttattggtgagcccttatgatcgaacggagagtatgaaggagacctctggtggcaagtcaagtggtgaacttccgtcagttcggttagaaggaggattttgagaagcttctgaggaaaccatttctagagttcaggaaaagtaagaaagatatttgctacccgtagttgagagaaagaggtgcgctcaggagagtagcgagttcagataactgggacctagaggaagaagcaaacagattgtcgtacgtccaaagtaagagagaatgaataaggctcatgggtcgaaaaataatatcctgggaagtcatcaaggagtgggcagttcgattgtgagcgaaatttggatttgaggaatgggtgaactgggtgatccatggtaaaaagggtttgagtaacatctattcgcaagatatactttcggattgcagggaggaaatagaaagagagacacagagaaggacaaaagaattggtccaatatgtttgagaatggaggagttatctgactgat

SEQ ID NO: 615445 - DNA, 134 bp, Homo sapiens
aggatacccccatcatcgatttggacatgctgtaccatgtaatctgaggcctgcagctcctggatttcctcttcgtggagtttcttcaacagacaggcaatctcttcttgcaaagattccactttgacgttcaa

SEQ ID NO: 615446 - DNA, 548 bp, Homo sapiens
ttcatagtgaatgatgagaaaagaaatgtcaaggagatttattgttttcatgctagtattcattctgcggcccatggatcaaggagtcgcttttacttttaacttagtatttaagaaatacatttcataaagttatagccataataggtggtgattcctgtgatggatctgggcaaaataaattgaaaaccttctggaaaggattctcttctagatgcgattaatggcattcataattcacaggaggagatcaaaatggcaacattaactggagtttggaagaaatagattccagttctcaaggatgattttgaggggttcaggacttcagtggaggaattatgcagatattgtgaaaatagcaaaaacccctagaattagaagtggagccttgaggatgtgacttaattgctgcaatcaaataataaaacttgaagggatgaggagttgcttctaatggatgagcaaagaaagttgtcagacagcatcacatgctacagagaaatctttcttgaaaggaagagtccatggagcaaacttcattatta

SEQ ID NO: 615447 - DNA, 1353 bp, Homo sapiens
ggcttgaggtatccgcagaaacggccgggtggcggcgaggcaaccgtgtacgggaactgcaagtagcgtgcattatgcctgtgtcaagatgcacaacctctcaaaagcaccgagatcttcgtggcatgagcccatgggggagaagccagtggggagcctgtgctgggcattggtgaagtcctgggcaaagtaagctggcaggcagagggggtctaggcacaagggcctcatgtggtccttggcccagtttctgtgtgctcaaaggcacacgatgaagaagctcttccggggaatggcatgaaggcagacttgtggggtgccaacagccgaaggcagtcccgggaacgtgcttacggatgcccttcgagaagtgggtagcgaacagccatatcgtttgtgaatgcatctccttggggcacaggctcttctaaatcgcacaagggaccttctataccagaaggttcttgaaaggcagaagtaaaggggaactgccgtccgcgattggtccctcataccgaactgggcaaacatgcaattggcaaaaagtggggtaaagcataacatgtcaacgcttcacgggaatggttcactgcacggaggggatcacttaaatgggagaacggatatcagtacgccgcattagaggccacatatatcacaaccatatgaaaaggattgggggcacattacataaggacatcctttgccgattggaccaatcgacaagcggtagaccattttatagaccacacattgtgaccgaaaggccaacccccgaatgatgagtgtgacacccaggaagtagaggacacgagggactaaatacaaccacttgacacattgtgtagggaaatgtatacccagcaggaggagacacaaccaaaagtgcggcgacaaccacacgcaccagaacaacgacgatgcaccaaagaagtaaattaagacgagaagcccgaggtgtaatgaagaacacaagaccagcatgacaacggcgggcagaccacacatagacagacaagagagcggaaagatgacacccagggcagcccacacaggggaacgcgccgcagctggtaagaaagaggatgcacatagacaggcggaaactcacacacagaacacaacgagtgatcagcggagtggaaatcaatcaccacagtcacaacagaacaacacaaacagctacagaaaaacacacaaaccaccaacaacaaccaccccagaaccagtacgaccgacaagacacaagcacacacaaaagacgcacgaccggagcccacgaccaacgacgaaacacacacagacagaacgaacgtacgaaacattacaacacaacggagcaccgaacacaaa

SEQ ID NO: 615448 - DNA, 178 bp, Homo sapiens
tttaatttttaataacaaagatactgtattttaacatggtgaaatatacttggctaagtccagattaaaaaaaaaagtatctagccaacagtacattatacagctttgtacagacatcatagatcacagaaatacattgagcacaaataaatattagagatctctagcgcattattgc

SEQ ID NO: 615449 - DNA, 149 bp, Homo sapiens
ccaaagacatcatgtgtcatttgactgaatcctcataacagacctctatggactacacacataaatactaagaagaaactgaagcccagggaacattaactcacattgtctcagggttgcacagcatggatttgagagaggagcatggg

SEQ ID NO: 615450 - DNA, 283 bp, Homo sapiens
taactgaaattttttttaaaaatattttttagattggtaatattttaaccagcaaaaacttaaagctttttttaacctttttatcaaataagtgagtaaagcttttttttgccctttggatgccttcgttcaaaatgataaagtgtttttcttatagtgctgtaacagcagttgtaaaataaccaaaaaccccgttgttttttttctggtttgtggcctttttctgtgctttgtatcaaagtttttaacaaaattaataaatcccccccgtttttatttttta

SEQ ID NO: 615451 - DNA, 458 bp, Homo sapiens
atgcgacgccctcgccattcactctccgcgcccgttctccggctgtcctcccgttccgtgtgcccgccctggccagcatgacggaacaggccatctccttcgaccaaagacttcttggccggaggcatcgccgccgtcatctccaagacggccgtggcgtccgatctgagcgggtcaagctgctgctgcaggtccaacacggccacgcaagcagatcgccgtcgcgagcaagcggtacgaggcgcatcgtggactgcattgtcctgcatccccgaggagcagggcgtgctgtccttctggaggggcaaccttgccaacgtcagttcgctacttccctcactccaatgccctcagatcttcgccttcacaggagtagagtacaaggcgagatcttccctggggggctgtagggcacaacgaccacagcgcagattctggatgtgtactttgcagggtca

SEQ ID NO: 615452 - DNA, 871 bp, Homo sapiens
ctcggagtctgtgcagagaggcttcagatgctggcggatccccggctccttcgactcctagcgccttcacgcttctcctccgggcggcattccagagtctgctggacgcccaggcggacgaggccgtgttaggtaagccgctcggctcggctcggagctggatcctgccggggctggaggggctggctcgtgagaagaggagccgtcggagcgagaaggggaaagccccgggaagaggaagtctccggtgctttgcccttcgctccgtgacggagtgttggaggacgtggctctgccaggactcggagcgagactctgagcattgttttgtgccccatcttggcacctgcatagatgccaactccatcgttacctgagcccgcgtttccactccctagtctcatttgttcttattgtaaagccgagtgttcaacgtcttgtatgtaggcctaaactatctaacggtgttgtagccttgtctgaggctgcggctgtttgtgacagttggacttcatctggggagctcccttgcaattcaagcttccagggctaggctagcaaaggtataagggtctgttccgaagtaattactaggtcagacagtgttgacatttgccaagcttagagcatacctcaagttgctatgatcacgtccagcgctctagttcagcatgtttacacaggttctacgccttagaaccttaaactatgatgcacgaatacctttgttaccgaccccaggttacccagcgatgcgagtgtctttaagccgatccggtcagtactgcggaggtgcagtgtcgtaatgcgttgaagaccttattttaactaccggatcgctttaacatgatttcgttaatattagtatcca

SEQ ID NO: 615453 - DNA, 321 bp, Homo sapiens
  misc_feature (210)..(210): n is a, c, g, or t
aatctacggagacagcagcagactaggattccacggaaccacgtgtttgactgaagctagtgatctgtaggagcaacgcgagccaagccagcacttcgtgtgctgaagattggacacgagtccagcgagccagtgcgatttgcgtgaaggaagctaggaataatgaaggagcgctcactatttggtggtgaatctaggaaatcggattcncggaaggagcgcagtgccctttggtgatcaaggtcgcatgcggcttggcttggccaccacaccgaggcatgctacgcagcgcgttgtgcgtagagtatccttgagctccat

SEQ ID NO: 615454 - DNA, 1527 bp, Homo sapiens
  misc_feature (328)..(328): n is a, c, g, or t
  misc_feature (721)..(721): n is a, c, g, or t
cctactgcgtacgattcggagtgtggctagtgctgggcattggccggcggtcgtggtgctgcggcccgcgcgctggccgtgctgattgcaggttgtggcggatctccgagtgggtccagccaaacgacagcgtagaggaagcgcagaggtcgatcaggggtcgtggtgtgcttgtgagctggccatcgcgacggtccatccggatctattcctcgcgcgatggcgccctgggacacccgagattagtgatcgagatgctgtagtgttccgagtactaaatccacggtgttgatacaccaagaaaccacccataaacaaacctatggcncgacacctcgtttctcccttctctatgggcaatggtttcgtcaacaaacacaatatcgttgctgtgtccattgtggtgtttacctttgttgaccctcgtggatggcgagctcttgaaggtcgcaacggatcgtcgagttggataaccctaacaaaacaccccaccgtgtctaggttgtccatagggacccaccgcgattgtgtctataccgccgtatcatatgtgcctcacgaaccgcgtgtatacgtctacacacttcgggcgcgccgttagcatgggtcatctccatttgtcacccctttgttaaggttgagcaggaccggtctttacgccttcgaatttagacggaatcgtaccgagtcatatccaaaactaggtaacgacatatatatnaagcttgctaccttgttacactatgagagggtggtgcttttgccttacagattggaggcaagacacaggtttacggcttcagagcgtgaaattccactgttttaggaatagcaaaggtggaataactttatccctaacagtgtagaattacccgaacgagacataggtccatgtgactacatagtgcggtgcaaaagggttaggactccttatagcgcatagtgaacaaaccaaaatacgcttatgcgaccccggatttaaatccttttgacagacgtcgcagaacttttatttggacacggcacaaacgtttaggtccccgagaaccttattgacggcggacacaacagcggggttggcgaacataatcccgggaaattgggacggttaagtttatccagaacgtgggtatccacggtggaaaatttagagacatttcacacggaatttgggcttccagcgtcaagttttacttggccaagaattaaaaacaaggcataggatgtaccccttagttatggtacacccggggggtttatgccacactcttttgaaaacacaaccacttgtgtgtttggggcatattatgaaagacggcggataaccagtaaaccagcgagggacaaaaggtgtggaacagtggtagggctacggggccacccgagtacttattctagggtcagacccccccagacttaatattgcgtgcgggggttataatcacaaccacatccggcgggttggggtattacagaaaccatttgtgtttcccctgagtttagattatcaaacccccacaccaagcc

SEQ ID NO: 615455 - DNA, 202 bp, Homo sapiens
ggactttttgccaactggccaagaccgtgccctgtagcagactgtggagttgattccacacaccccgacccggcacccgcgatcgacgccatggccatctacaagcagtacacaacacatgacggaggttgtgagtgcgctgcaccccaccatggagcgctgctcagatagcgatggtctggcccctcctcagcatcttatc

SEQ ID NO: 615456 - DNA, 1166 bp, Homo sapiens
  misc_feature (851)..(851): n is a, c, g, or t
gctttttcgctaccttttccccggttgctgcttgctgtgagctgtctctagggtgatacgtgggtgagaaaggtcctggtccgcgccagagcccagcgcgcctcgtcgacatgcctcggcaacaacttgacggaaatcaaggacttcctgctcactagcccgacgaaaggatgccaacatctgtcaaggatcaacgaacacacctacggaccaacgtgacgtcctccacgtctcgatgcagcagatacctttacaccctggttcatcactgaccaaagatgaagcgcacgagcaagctgaagcagtccctgccccccggttgggccggttgacaggaaacctgacacttgacacctaggacaccactgcattggaaagcggtcataactcattcaacaactactaaagatagtccgtaagagcagcaactaacccaaacacaacgcctcagcaaccaacctcaccaccacattttgagagggcgaggcatcatcgcgcacactcaagagcaccctctctagtccaacaacctcaggttgtgctctacactatcggaactcccagaatgatgatatatgtatgttcaaacacgtgctaggccattagcctttgtctacacctctagcagagctaaacccttagtgtacaagtaaccataaattcagcttgtcatcattcatcaccacttaatagacaactacggcgccatggggtcgatacaaccactgtagtccttagcaacgaaatcccgcaaatgtgtagcgtctctgacgcagcgtcattaccatggtggcaatttatctcacctagtagatctcactacgtcaactgttaataatcacatttagccncgctagctcgggggattcaaacccatcacgagtaacacgacggagcacacagatcgacaggacacctacacaacacaacatcaacaacaacagatcaagatcactacaatatgcaaaatggcgcatcggacaaccgagcggaagacacaagcagcgaagacaccgactggagacccacgcacagcagagagtcaacgaaaatgcaacggacgaatacacatacgaacggaaaacacagaaagcaaccacaccagacagagaacacaaggaaacataatagacaatgagacagagatgatgaacagaacaaagcca

SEQ ID NO: 615457 - DNA, 295 bp, Homo sapiens
  misc_feature (58)..(58): n is a, c, g, or t
  misc_feature (90)..(90): n is a, c, g, or t
  misc_feature (113)..(113): n is a, c, g, or t
  misc_feature (190)..(190): n is a, c, g, or t
  misc_feature (236)..(236): n is a, c, g, or t
  misc_feature (260)..(260): n is a, c, g, or t
  misc_feature (266)..(266): n is a, c, g, or t
  misc_feature (270)..(270): n is a, c, g, or t
  misc_feature (274)..(274): n is a, c, g, or t
attggttttcctcatccactgagaatgctgctggttactgcaaacgttcaccaaccanagctttggtccatacagctttcttctagattnggagactctcaaggacagcaggngctttaaaatccctggactgtgttgagagggcttctttaggcttttcatgatgtgaatagccagtcatgaactttgngtctgtttcttttaggctctttttgcagcagcagagccatgctatngaaggagtgagaacctatgcgagngacccngtgnttgnacttgccagggagcttggcgt

SEQ ID NO: 615458 - DNA, 853 bp, Homo sapiens
gtatttttagtagagacggggtttcaccatgttggtcaggatggtctcgatcttttgaccttgtgattcgcctgccttggcctcccaaagtgctgggattacaggcatgagacactgtgctcggccgatttttttttttttttttttggcccaggttgggagcgcatgggggcaaagatcatgggctcactgggggcctcaaactcctggggctcaagcaatggttcccacctcagcctcctgagtagctggggattacagggtgtgcaccaccatgccgggctattttttaattaccattttttttgtgtcagacgacagaagtcttgctatgtgcgcctaggctggctctggaactccgggccttaaaaaatcctctcacccgtcatcctccaaaaggtgcggggatcacagctggtgagccatggccaccgggacctattatggattttataaaacccctttaaaatatacatgggaaaaatacccttagcaaagtaaccgtatgtcattctcaacctaaaaccatttgagaggcctaaaattagggatattgggaggagcttttccatttaagattcgggaacccaaaattaaagaacggttactattttccactaaaatggttaagagggtaatttggggggaatcattaaacccagtgtgttgccctggctgtgaacaggaacacactatgttgagagtcttctccaaggaaaaattgctggagaggggggggttactatgaaacggttgtgtggggcaacaatgaggggggaaatttgtggggatgtcaaatttttcccaagagaatatataatgacaaaggggcttaattcgaaagcacagtgct

SEQ ID NO: 615459 - DNA, 212 bp, Homo sapiens
tggccaagcgcaaactttctctatacatttgcacgctattccgaggcgcgtcctgttgactctatgctctggatcccagagctctctgagacctagggccctgtagcacacaccgcgccttcctctggccacaatgtccgtgtgaatattcaggctcgacatgtaccacctttcttccatgccctggtggtccgggctctgttggcttccgc

SEQ ID NO: 615460 - DNA, 1185 bp, Homo sapiens
tgtttctataagggggtgtataaggggggtttatatatgggggaaaatatagggcgccttttttaaaaattttttagggagaattttttttatagaaaaagtgggtattaaaactgtgggtttggtcccaaaatttttaaaaatttgtgtgcgccgtattttattccccgcgggtgtggtgtgtgtggcgggtaaaagagtgtggtgtgtgggtttaaagacttctgcgggatatattggtttgtgtgtttttaaaacctttattgtgggggaaaccgcctccatgtggtgtgtgaaaaaaacgctttttgtggtcgtgtttattatttttttctacaaatatgtggggggttttacaagcgggggagaatctccttccctcgagatgtggtctaccgcgcctaaggagacttctccaggtgtctcccgtgtgtgtctctcctgagaaatatattgcgcgggggcaaacactttttgtgtaggcccccttgtcaacattatctcctctcccgcccgataatcgcggctgtctacccgcggtggggtcttcaacccccccttgtggtggcccacatatgtgtgtcttgtcggctgtggcctaaggggcgcgggggaactctcggttaacaccctctcctgtttgtgtctttcttctcacagggtctctgcctctcgcgcctctttggccgaggccgccacacccacgcgacccccacggacaatacctggcgggggacccaagacatatctctcccacagcgcgggctcctactatctcccccctccagccccccgcttacacaccgtctcccccaccaccccacaactcttacgttacgcccacccgccctccacgcaacaaagcggccccaccccccggccccctggacgccccccccttacgcgcccaaccagtattctatagcacgcgcgatcccccaccaacacgccgtgcaaacgccccttcccctcaccccggcggaccatcgtttctcaaaacatccgcaccgcccgcctctcatcaaatacccccaggggggccccccacactctcgccaccccccagctttcttacccgtgcgtcccccatgacctccaccaactcttcagcagccgccgcggctcttaaaacctcttacgtcgaaaacgtcacctgcaaccatcttcagcacacaccaccctcgg

SEQ ID NO: 615461 - DNA, 552 bp, Homo sapiens
  misc_feature (142)..(142): n is a, c, g, or t
  misc_feature (160)..(160): n is a, c, g, or t
  misc_feature (164)..(164): n is a, c, g, or t
ctaggacccagcgctgatagctcgacatctatgtacacataagaggtgcacgcaataagtctttaaggtagactgggcaatcacacagaactagaagcactgaagggagtgataccactaagcatgctacttttgtgtaganatattaactggtattgtnttgngaaaaaaaaaaatccctgtatctatgtaatcagagctggctttctggagaggatgacattttgaggtaaagagaaatgagtaggtagagatgaaaatgagatcacacagtgggtgagtgggaggatttaggaaaatgggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatatggggaggccaaggcgggtggatcacttgaggtcaggagtttgagactagcctggcca

SEQ ID NO: 615462 - DNA, 607 bp, Homo sapiens
cggcacgagcgcaaacccactctacattactatcagacacccttagacaaaccatatacccacataaagtgatatgcgatagaaattgagacctgtggcaatagatataggaccgcaagggaaagaggaaaaattattaccaagcataatatagcaagggctatacccctataccttctggatatatggattaactatgaaataactttgcaaggagagcgcacaagctatagacaccccgaaaccagacgagctacctatagaacacggttaaagagcacacccgtctatggagcaaaatagtgggaagaattataggtagaggcgacaaacctatcgagcctgtggatagctggttgtgcaagatatgaatcttaagtcaactttaaatttggccacagaaccctttaaatacccttggaaatttaactggtagagcaaagaggaacaggtctttggacactctgaaaaaaccttgtagagagagtgaaaaatttaacacccatatgtaaggctgcagacaccaatttaggcgggtaagctcaacacccactatctaacctatagaagaactcatgtgagggtaagtgacatgagcttctcctcc

SEQ ID NO: 615463 - DNA, 274 bp, Homo sapiens
ctggacagatggttctggcttcatattccatacaaacttatatcaaatagctagtcaagtaaaaatttacctgttctaaagatgaggccaggcacggtggctcatgcccgtaatcccagcactttgagagcgtaaggtgggaggatcgcttgagcccaggaggtggaggctgcagtgcagccgcgattgcacccactgcactcccagcctgggtgacagcagcaagcactctgtctcaacaaaaactcagttttcttttttttttttttttttg

SEQ ID NO: 615464 - DNA, 165 bp, Homo sapiens
atctccagctcggctctcaattgtggtatagaggcatgagcgcctgcacagcatatgattggctggacttgattggttcatccaggaatcctcaatgtcagtgtctttccagcttttctctttatatctcttccctggtcagatttccagtagagttctctactg

SEQ ID NO: 615465 - DNA, 791 bp, Homo sapiens
  misc_feature (14)..(14): n is a, c, g, or t
  misc_feature (59)..(59): n is a, c, g, or t
  misc_feature (66)..(66): n is a, c, g, or t
  misc_feature (161)..(161): n is a, c, g, or t
  misc_feature (165)..(165): n is a, c, g, or t
  misc_feature (203)..(203): n is a, c, g, or t
  misc_feature (259)..(259): n is a, c, g, or t
  misc_feature (261)..(261): n is a, c, g, or t
  misc_feature (264)..(264): n is a, c, g, or t
  misc_feature (307)..(307): n is a, c, g, or t
  misc_feature (310)..(310): n is a, c, g, or t
  misc_feature (328)..(328): n is a, c, g, or t
  misc_feature (343)..(343): n is a, c, g, or t
  misc_feature (390)..(390): n is a, c, g, or t
  misc_feature (414)..(414): n is a, c, g, or t
  misc_feature (475)..(475): n is a, c, g, or t
  misc_feature (619)..(619): n is a, c, g, or t
  misc_feature (669)..(669): n is a, c, g, or t
  misc_feature (789)..(789): n is a, c, g, or t
ggcggcggagggtnatgggcccgcgtggggctgggcgcggcgccgcacgagcaccagcntagagcnaggactgaagcttcaagatggctgatcaggaccctgcgggcattagcgccctccagctaaatggtggcctcaggaaccggggctgtggttacttntttntttatgatactcttggacgtggtgaaggttcgcttgcngttttagcggccctccatggccagcgagctgatgctttcctccagactgtggagcntnttntatactaaattgctctttttttttcaattcaaagggaagtgcnttntgtattgcaatggtgttntggagcttttgtacntgtgctcaaatggtgcccgctgtgccacctggttttaagaccctacncgctttattgggaccatggatgcntttgtgaagattgtgagggacgagggcaccaggaccctttggaggggcttccccgctaccntggtgatgactgtgctagctactgctatctactttattgcttatgatcaactgaaggcctttctgtgtgtgtcgagctctgacctctgatctctacgcacccatggtggctggcgcgctggcccgcctgggcaccgtgactgtnatcagccccctggagcttatgcggacaaagctgcaggctcagcatgtgtngtaccgggagctgggtgcctgtgttcgaactgcagtggctcagggtggctggcgctcactgtggctgggctggggcccactgcccttcgagatgtgcccttctcagccctgtactggttnaa

SEQ ID NO: 615466 - DNA, 321 bp, Homo sapiens
cgcggactgaccgacaaactgaggacacacgaatgattcaagatcaccacccgctggccaaggactttcctgagttcaaggacaagatccacgcgctgaagacctcgaatacgcatttcgccaagctggaacgtgagtacgaagacctggacaaggccatcgttcggctcgaaaccggcgtggaacacggctctagcatcgaactggaacaaaagaagcagcagcgcgttacccttaaggatgagctctacaacctgctgaaggcctgatcaccaggcagcaacgcttaaggcaatcgctgcacgctacctgatcgggtag

SEQ ID NO: 615467 - DNA, 398 bp, Homo sapiens
  misc_feature (371)..(371): n is a, c, g, or t
cacgaggcctccgcctcgatcacggttcgcggcaccatcttcgacgtgttcgtggaggacggcggcacgagctggctgctgctgcacgagggcgccgtgcgcgtctgcaatgcgactgggacctgccgcgatcattccgaaccgggcaagctcatccgcatctcgagcgggggtgagctcagcaagccgacccgatgggccacgctgccgggcatcgagaagatctcgttcgataccgcattcccattcgtcggcacgccgccgtcggtcgatcccaagcccgtgctcacccgcgaggccgtgcttcagccgacgtccgacacggcgaaggagactccgaagcgccgcgctgaagcacctaagaagaagcnccagcagcaggcttccgccgaggctac

SEQ ID NO: 615468 - DNA, 1195 bp, Homo sapiens
  misc_feature (537)..(537): n is a, c, g, or t
  misc_feature (644)..(644): n is a, c, g, or t
gcaacggggtgcggcagggtggggagcgcgggagcggggccagctcccaggaacatgctggtctgcgagcggcccctggccgggctcctcaggtcccatgctgacgagcccacgctcgcttccccgaggatccctcgagccgtggctgaccgccctgctggtcccggaagctccagcctgaagcacatgtttgttcgacttgtggccgcaaatgaggcacatgtgtggtcatcactggggttctaggcgaagccacccgcagacatggtgggctgcgtagcgcgccgtgctcgttctggtcctcgtcgcctgtcatacccaagcgagatctcgagaggatctctctcgaagcagcactgacctcttcaactgtcagagagtgcaagaaggttgacactctggcctatggggtacccattctccagtcgactggtcatttgcgccaggttaagaaatccaggggccagatacaacggagactgttgggcggggcgactggtacatgagtgattcctgtggcgaaaagatcgggatggngtgaggacttgcctgacatttgcctcgtggagagcgcttgggaagcgggccatccgagagtggccagtcatggggccagagtgacgtagtgagagtgacgatcgtantaacgggagcatggcaggacgagttgctcgagaacacgggtttgcaaagatgcgccctcctcaagacctggggtcaaatagtggggcatcacagtgtggggtccacgctaccaactcgttgaagggacattacaacggatgacgaggaactattttggcactcgttagggggaaagggctcgagacagttcaaagtccaaaaaaggatgcccggattgggaggaagcagaggccaggagagatgctgggatccggaaaggtagaggcacaggcacggaaaagggagtctggagcaggacctgagggcaatccgagactggcaagggcacgcaaagaattacggcactgcaaacagggccgctctatgacatgcagggcaaaaaccggacgaaccagggtggaccgtgcctactagagatagaggggccaagacacgccggacacgagaacaacagatgcagtgcacagcgcggagccaccgagcccagagtgagacaggaacaaacaacggtggaaaagacagcaccgtccagacaagagagaagcaacgg

SEQ ID NO: 615469 - DNA, 378 bp, Homo sapiens
ctttatcgagggtgttcaataaagtgaaagaagttatatcatgtaaagacatgtaattttcaagtaggcagaagaatcacaatctaaatagatagccaaatttggttttaatgggttatcttctataaaactaaggaggagagatacacaaaaacaaatggtaaatgtcaagttgaaaatagtttggggggtgggccaagacggccaattagaagcagctgcagtctgtggctgtcacagagaacaaaaacagggagtaaattctacaccttcaactgtgatatccaggttcttgcactgcgactgatgaggcaatcggcatgacccacggagagcaaggaaaagcaggatggggcaacaccccacctgggagagaca

SEQ ID NO: 615470 - DNA, 179 bp, Homo sapiens
gttccccaagggcgggggggttttttaaaaaaaaaaaaaaaggggggggggttttttttttttaaaaaggtaaaattgtttttccccaagggttatggggggggtgtttccccccttcccccttgggggggaaaagggtggggggtttgaaaaaaaaaaaaaccccggtttttttttca

SEQ ID NO: 615471 - DNA, 684 bp, Homo sapiens
  misc_feature (1)..(1): n is a, c, g, or t
  misc_feature (72)..(72): n is a, c, g, or t
  misc_feature (93)..(93): n is a, c, g, or t
  misc_feature (96)..(96): n is a, c, g, or t
  misc_feature (175)..(175): n is a, c, g, or t
  misc_feature (248)..(248): n is a, c, g, or t
  misc_feature (251)..(251): n is a, c, g, or t
  misc_feature (261)..(261): n is a, c, g, or t
  misc_feature (275)..(275): n is a, c, g, or t
  misc_feature (278)..(278): n is a, c, g, or t
  misc_feature (282)..(282): n is a, c, g, or t
  misc_feature (296)..(299): n is a, c, g, or t
  misc_feature (305)..(305): n is a, c, g, or t
  misc_feature (307)..(307): n is a, c, g, or t
  misc_feature (314)..(314): n is a, c, g, or t
  misc_feature (327)..(327): n is a, c, g, or t
  misc_feature (364)..(364): n is a, c, g, or t
  misc_feature (388)..(388): n is a, c, g, or t
  misc_feature (445)..(445): n is a, c, g, or t
  misc_feature (526)..(526): n is a, c, g, or t
  misc_feature (530)..(530): n is a, c, g, or t
  misc_feature (533)..(533): n is a, c, g, or t
  misc_feature (576)..(576): n is a, c, g, or t
  misc_feature (683)..(683): n is a, c, g, or t
ngggggggccctgccaggagagggcagctctgaactgctggctgggaccagctcagtgatggaacagatganagagaaagtcttctgaggccngtnggctcgagcgccagttgtcctcctgcgggtactacaggtgccactgccagtttctcaccgcgggaccatgcggctggtnagcagccccacgtacgcaatatgctttccagccgcgtctgtccgtctatatcccatctgaaagcgtctgtctncgncccgagcctnttatcctgcctccnatncagncttgtccctggttnnnnggcgcngncagagcnctggctttcgatnattaattattgaagttgtggtatggaaatccagtttncccctgtagcacctccggcaagtnaaccaagcttgactaaagcgtctgaagacttctcaccaggaggtagcggcaggtctngcacccagggatgcccaccacttttactgtgtcctcttcctcaggacacgtaaggtttttgtccaccatatctggcactgngatngantcaacagccccatctttcttggaggcatcttcacttccagagncccactcctcctcttcctccagctccctgcaaggggtctcctccatctcctgctctggtgtctcctcatcctcaggcagcgtcttagcacccaaaggggtctcaaang

SEQ ID NO: 615472 - DNA, 1586 bp, Homo sapiens
tccaaaaccaaaactttttaactccttggggcctcggggaagagggccgaggacagaagtgtgccagaggtgtgttccacgaggagaggggttaagccagaagagaggagctctacaggagggccgtaccagttccaattaccctgttgggggaaggaactgaagggaatgggagaattgggtactcccggagaggggggagctacacaggttcctggtgtggcccaggtttctctaagaaacctctggcgcctctcctctgagagtgttaccaacatgtggagatatccctatgcgacaggtcctgagaacaccacacaagtggctctgcgctctgaaaacaccctgagggggctcacagagcaagaaaaaacaccactgtcgtggcgcaaggggcgagaaaagggcgacatgcggcggagagcgcaaaacccacaaatgaacggcgcctctgtagcgctaccaatacacagtggggcgacatggagagagcaacatatccccaagtaggggagaaacaaacaggggagccaacagccgcccacagcgcggcaccagacgaacggggggccagcagaaaaagcggcctcaggacgggggcgaaacacaaccccccaaggcgcaacctagagaaacaaaaagccaaatagcccaccaatagaactctaccaaaaagggcgccaacaaagaaatcacaagcgagggggccacccaaacggaacaagagacgagaatatcgcaagaggggagggggacaacaacaagagagtcataaacacaacggaggggagcgcagcgaaagcatgactaaaacaaagcgagacgaatcgcccacacaacaatgaaaacacaggcccccaacacactcccccccccaccagaaagcagagaaaagaaaaaaatcaccaccaaacaaaggaggcaacccaacacaaaaacaacaaaagtaacaacgtttaggaataataggaatcaagagagaacaaaacaaaccactagtacacgcaccagcgcacgacaagaatgagacacaccaggaactgtgccatcacacacataacacaagagagaaaacaagaacacaccaaacccagccccagggggataaaaacaggagagaagcaaaccacacgtaatattggcgagaacaacaacaagaagaacataggacacaaaggtacaacagaaggtaggaataaactataagccccactacgacaaagacaacatatgtaaggtatgagagccaaaccaaaagaagaaaacaatccagacacaaaagcactaataaacagcccaggaggaaggagaccccatgtcaaccagagaacccgagaagagctacatctcatagacagaagtctctaagaccagaggaagaactccaactctgccttactcactagaaggaccacaaactacaaatcagtgagaaagagcttctcgacgccagcagcaccaacgagcggtcaagactacacactacaccgaaagtagacagaccagagaagataaaataacaagggcacgataaacagaactagaaaaagatgaggctgaaactcgtcagccggtaagacaggact

SEQ ID NO: 615473 - DNA, 134 bp, Homo sapiens
tggggagccttatatactagcttgagaatgtgtaaggcagaggggccgggaaacatagtggctaaatacaaacagttattctagctgtgtgtgtaaacataagtgcagacagaggtgtttaggccacaactaca

SEQ ID NO: 615474 - DNA, 141 bp, Homo sapiens
cgatccccttgctatacatcggcaccatcatgagccaccatcaccctccttaacctctacttctacctacgcctattttacaccaaccccggtgccgatgaatagcgaggtgccgattaacgaggtgccgattaatagcga

SEQ ID NO: 615475 - DNA, 696 bp, Homo sapiens
tgctcatgtctttcaacagattcgagggttacagctgcgtcatcacctctggtacactgtacccgctggacatctaccccaagatcctggacttccaccccgtcaccatggcaaccttcaccatgagctggcacgggtcgtgcctctgccctatgatcatctgtgacgtggcaatgaccaggtgtgccatcagttccaaatttgagacccgggaggctatagctgtgatcctggaactatgggaacctcctgctggagatgtccgctgtggtccctgatggcatcgatggcactatcttcaccagctaccagtacatggacgagcacacgtggcactcctggtatgagcaggggatccttgagaaacatccacgagtgaacaagctgctctttattagagacccaggatggtggctgacacagtgtcgccctgtagcacagtaccaggaggcctgcgagcaatggccgtggtgccatcctgctgtcagtggccccgggggccatagtgtccgcagggaatcgacttttgtgcacccactacgggctgggccgccatcatggatggcgtccctacgttatacacagagcgcatctcaagcgcgctggaatacctgcggaccagttcagatcggacactgattttacttcgtgcatggcagggccagtgtggcgggcatatggcacagacacgctctg

SEQ ID NO: 615476 - DNA, 255 bp, Homo sapiens
  misc_feature (158)..(158): n is a, c, g, or t
cttgttataagagaaaggctagagggagaagagtgtgggagcagggataattagtgagctattgaatatctggagaagagataatctgcagtagaggaaggtgcaaggcatgtcaggataagcctggaggatttgcccattgattagattgtgggtanacgatgaaacagtgaatcgtggaggattcccccagttttactggactcggaacttaatgaacgagttttgacttacgtaggatgggagtctccccag

SEQ ID NO: 615477 - DNA, 252 bp, Homo sapiens
ctcccgggttcatgcaattctcctgcctcagcctccagagcagctgggactacaggcgcccgccaccatgcccagctaattttttgtatttttagtagagatggcgtttcaccatgttagccaggatggtctcgatctcctgacctcgtgatctgcccgcctcggcctcccaaagtgctgggattacaggcatgagccactgtcctgggcccaacttgttttttcagtgatgcacatctttatcccaaaagt

SEQ ID NO: 615478 - DNA, 614 bp, Homo sapiens
  misc_feature (178)..(178): n is a, c, g, or t
gagggtgtcattgaactatctgggacggaaaaggtatacctgagtagatcatgccccaagtatagtgagctatcttgtctctgtcgggatgggacgtagaataaagccattcaactctctggtttgacagcaggataatatcactatatgtgacatacactgggctatgaatggctgnagaccacgttctgctctctacctaaagatatagtctacgccttttcatttagtcaagttgactgccactcacagtcctcttgtaccactcgtgaatgtgctccacagactctctccagtcttaatgtcatgtgtccgagcatcagttggatccctctcgtagacccttggcaatgtcacttcattattctgagatctatgatgcaagtccatacagatcttgtagctcggggtaataatctgagtgtttagctccatacaaggtcgaggtactcccccagaacccgagcatcataggtaggtggcgcaataatggtcagaccagcttcgatctctatcaccagttattgctgcacttcagggtgcttgggtagttcatctagagtctgccagaggtctcagatgatggtgtctcgtgccgaattcatgcagccagg

SEQ ID NO: 615479 - DNA, 190 bp, Homo sapiens
cggtcgcggtcgcgggctttcgatagaaccgaaggattctgggttcggcgacatggggatctcggggcggttcctcctcctggccgtggcgctggtgatcgccgccgccgcggtggccgcggatgagcaggcggcggtggacctggcggggcccggggagatcgcggcgggcgtcaaggaggccgccgag

SEQ ID NO: 615480 - DNA, 102 bp, Homo sapiens
cgccgcatgcccggaaacgggcgctttagcggcgaccgaggagcgaggaccgatgagatccgaaagctggacgcgttggctcgtgtttgaacaagcgcaaaa

SEQ ID NO: 615481 - DNA, 128 bp, Homo sapiens
tcctgaatattttcgatgaaccccttgtagataaaacttacgaagctgctctggaaacaggtcagaacatgagcaaagtagtgtattccctctacaacaaagccaagaaactgacatagagttggatc

SEQ ID NO: 615482 - DNA, 715 bp, Homo sapiens
atcaccttctgaaaatgcgatatagccccttgctattcccggggtccaatctgtctgcagaccccataataccatggaagagctgggtgttctggcacccagtgaaacaatacctggttttttattttaaaccagcccatcttcccctgctgcatgtttggaacctgttctacgtggatttgggatcaaccagcaggcctttcctgagctgttacttgttgtggagtgggcgctgaggctccatgccattgattgcaaagaccccaatcctgacctgaagggctgctcacaaatctctcacccaagtggcctggtgttgaacactgcagacgcaactgcagtgcagggcattctccccaggttggctgcctgtagagcaaatggttgccagaaaatgggtcacttcctcaaaaagcaatgccgggtgagcccagcacaagctccccaagttttttgcaacgacaacacataacatcaacagcttccatttttcaaaggatttcaaggtggcatggttcaaggaaccaggccttggaactaagacaaggcctcaaaatgtgcattaagttgagaagaaccccctttaaagggctccttaaaaaaaggtacctgacccccaaagagggctattgtgtataaccacttggtcttattgatattaactctagtggacattaaacacgttgggacgtttataccatggtttatttcatta

SEQ ID NO: 615483 - DNA, 484 bp, Homo sapiens
gcagcttacaggaatcgttacggtgctcagcgtcgtgctgagacgaggcaggtctccagctgggttgcacgtgcccaccagactgccgaaggccaagacgccaggtacggtggacgttacacgcaggacatgacatggtccggtgtgacggctagcacgaggaggcgcgtccggccttcctgaacaccttaggctggtggggctgcggcaagaagcgggtctgtaactttacttcctccacggagtcagcacactatggactgccctctgggctcccagaacccacaacatgaaagaaatggtgctacccagctcaagcctgggccttagaatccggacacaaaaccctctagcttggacatgaatatgctgcactttacaacctctgcactacctgactcaggaatcggctctggaaggtgcagctagagaaaccagacctcatcagcccaacatagaagacaccatcggaccctcctcgcga

SEQ ID NO: 615484 - DNA, 194 bp, Homo sapiens
  misc_feature (28)..(28): n is a, c, g, or t
  misc_feature (133)..(133): n is a, c, g, or t
  misc_feature (157)..(157): n is a, c, g, or t
  misc_feature (180)..(180): n is a, c, g, or t
  misc_feature (193)..(193): n is a, c, g, or t
tatcactgtgcccctgttccagataaanccttatccctggcatttctctgcttccccactttgcctgtaaaaatcaagcccaggtttggtggttcatgcctataatctcagctacttggttgagacaggaggntcgcttgaggccaggagttctagnccaggctgggcaacataacaagnccccatctctttna

SEQ ID NO: 615485 - DNA, 756 bp, Homo sapiens
  misc_feature (230)..(230): n is a, c, g, or t
  misc_feature (236)..(236): n is a, c, g, or t
  misc_feature (240)..(240): n is a, c, g, or t
  misc_feature (248)..(248): n is a, c, g, or t
  misc_feature (270)..(270): n is a, c, g, or t
  misc_feature (272)..(272): n is a, c, g, or t
  misc_feature (278)..(278): n is a, c, g, or t
  misc_feature (284)..(284): n is a, c, g, or t
  misc_feature (309)..(309): n is a, c, g, or t
  misc_feature (312)..(312): n is a, c, g, or t
  misc_feature (320)..(320): n is a, c, g, or t
  misc_feature (331)..(331): n is a, c, g, or t
  misc_feature (337)..(337): n is a, c, g, or t
  misc_feature (342)..(342): n is a, c, g, or t
  misc_feature (344)..(344): n is a, c, g, or t
  misc_feature (358)..(358): n is a, c, g, or t
  misc_feature (371)..(371): n is a, c, g, or t
  misc_feature (376)..(376): n is a, c, g, or t
  misc_feature (384)..(384): n is a, c, g, or t
  misc_feature (443)..(443): n is a, c, g, or t
  misc_feature (448)..(448): n is a, c, g, or t
  misc_feature (493)..(493): n is a, c, g, or t
  misc_feature (655)..(655): n is a, c, g, or t
  misc_feature (737)..(737): n is a, c, g, or t
tgcgttcctccacgaagtcccgaatactctagccccgctctcttcccctctttctgtccccgccattttccagtgggctatataggtcagtagctgctctccaaatagagtgtaccagcgcagctgtgggcaagctgcctctcattcccaggcctgttactctcgtgtcagctctcccctcactgttctgcagacagggtcgtccccctaaaccctctgcagtgagaganagaagntggncccacggncgtgctgtggcacaagccttancnctgtgngtatgnctgtgtgactgtgtgggagctggtntgncagatagnccaggctactntctggnatctncnggtgtttgtagcancagcactatgctntgtcntggactcnctcagctcaggatgggaatagccaagaatggcagcctcagcgcagaggcaaggtcaganagagncggcgcttcagagtttcctttccagacacccctccccgcactgtnaagttcccctgaccgccctcctggttcacaaagagcattaagaaagctgcggtggtctgagcaacatagcccagagggctgagcctcctggcctgcctgcccgccacctggagtcccagtggtgaggctcaagaacttctaaggggaaagaacagtggagtntctgttgatgtgaagaaggcagtcttggctcccactcccattctttggctataaatctttctacagcaattgagctacctgnaggagaggccaggcaaagg

SEQ ID NO: 615486 - DNA, 348 bp, Homo sapiens
tagaggatcgctgggctcagtgatcctcctgcttggccttccgaagtgctgggattacaggcataagccaccatgcccagcctatttgggcgaattttaaggcaactgaactattgtatgtctagagctctgcaagggccattagaaaatagtctcagatttttttttttttccattaatgatgctaactttctctcagcacttttccttgggagtggatggtgaagttaagtctgggaaacagaattcacaaccctaaaagcgtagtgcttaaacttggggagatcaagtcacagacaagaagaacttcaatcccctgtgcagagtataaccttgttcaaataaaca

SEQ ID NO: 615487 - DNA, 658 bp, Homo sapiens
gggcagtaggcggcggtggcagggggaggtggaggctgtggagcggagcgagagagcgggtcccgggactgatggcagcatcgcggggctggctggcgtggctggcaagctgaggtgacgaatggcagcgtgcgtgcgtgcggcctgtttccctcacggtgtgcggagaccaaggcggcggcggcggacgtggggagctggcccggccccgggtccccctgctcgttgagagtggtggaccaggggtacggccgggggtggcccgcgccctgggcttctctgggctcacacggcggacacttcccacctttctcgggctactcttccttcgcgtgcgcaacaacgcgcagggagggcccttcggcccaccggggtcccgggacacgttcacgcaccttgcgtgcctgcatgccccgttctgcccggcggacaaagatcccactaaatgtgcctagtgctgggtccagagctggcccaattggtgcacagttgccgttggacccatccatgtgcggcgcgcgaccacttgtcggaagcgaccgagtatgttttgccacccgatcaagcgctgccacattgattcgcaaacgcggggccccttatccatcacagtgcgtcttatcgggcgaaacacacgtggtcacagtggaaaggaatt

SEQ ID NO: 615488 - DNA, 124 bp, Homo sapiens
gctcggtaccagaagatcactcaccataatttaggtaacaaaaaaagggacgatgacaatgaattgatgacatctggtccacgaatgagagtaagagattcaacactacatttaaaagaggttt

SEQ ID NO: 615489 - DNA, 391 bp, Homo sapiens
atagcacatgccccttactactaaatacaatacatcgttgtataaacgccaagaggtctgcactgaactataccatagccaagaaagggtgaaaaaagccacaattataggcaatccaggctctatttataagtactgcacacttaagtgtaaggggctctcagaaaggagaaaaattgctagaaatgcagtattttagacttaataacagaatcatgtctcatctcttgctgcagcgttgggaatcgctaacaattttatcaacaacacctgtatacatgactcacctattcacctcattcctagccacctttggttgggtgagtataaggaaaaatcgcaaacaaacttcttgtatgacaggaactcatgattttctatatacattttg

SEQ ID NO: 615490 - DNA, 296 bp, Homo sapiens
ggtgtttaaggtctcccatttttctaagtatggccttcaggattctgatgaagaggaggaggagcatccctctaaaactagtacaaagaagttgaagacttctcccttgccttctgcaagacagactacggccttacagagtaggctctttaatgtgcaaacctgcacctccacctcaggtagagagaaaaggacagtgtatttgaatagagtccgcgatacccagttgagagcacgtgcatacagctcatacacagctgcttttatgacccccggagctctgaagagtacacaca

SEQ ID NO: 615491 - DNA, 855 bp, Homo sapiens
gcagccgcccgggcggcggcgccacccaactagtatattcatctggaagctagaggggggtgaggcggtagctgctcctcggggaggagcggtacttatgtcaagttgtcccttgttgaggaaagtcctgcaacccgaatttatgatatattcgtggtaggagtaatggtgggcttttggtggttgccgcccggccccccgtatccccccccacaactactgcgaactccgaggccgggagcggggcggggtgggaggaagtggtagacacaaacctacaaaatagagaaatgtgagacggaagcttggtgtggtacggttggtgggcggagtttgctccccgcaacgccactcactcatggcgctcaccagcctagacaacccgcacgccccccagaaacgctaaaaacaacaccaacaacatctatattgacgtcttaacgaggagaaactgtagacgtgtctgcgatcgcgtcgggtttacgtgttagttaccacgccggaagcacgccgagaggggcgggacgctcaaacagacggcacgctcttgcgagatgggggatgtagtgaagatactaaatgatcgagttggtggaaattaggggagggtggacggttagtattctcatatcttgtcgctccagtagtcggcttactggcgactggggagatagatgatagatgccagcctatcgctatgtttgtcattgatacaatactcttctatatcacccccgcagcggcgactcaaggagccaatcagcagagatacagattatacccgaacgggaagagatgatcggcgaggatagaataggaggcatgtgagagagaacatggagcgcgtcgcaccat

SEQ ID NO: 615492 - DNA, 128 bp, Homo sapiens
ttgtccagtccattgtgaaattatcccagcagctgtaatgtacagtccttctgaagcaagcaacatcagcagcagcagcagcagcaagcacaattcgtgtgttttataaagacaacagtggcttctaa

SEQ ID NO: 615493 - DNA, 259 bp, Homo sapiens
ggaaaaaaaggttccccccccgggggggttgttttttagaatggtccaaaatcccggcctttccggcctttccatgtttaagggagaaaaaaaaacccctttcctttccaagaactaatatactttggttttgggggaaccctaccccaggtttttggccagcctttaccgccctttttgaacttttttaaattttgggccccccaattttttggttttggtgccttttttaaccattaattttccctgggccaaagga

SEQ ID NO: 615494 - DNA, 147 bp, Homo sapiens
cctttcttgtccagaattgtctgtgtctccaaatgcttggtacgaccggaacagctgagtctacctgaaccactgagatggcacgccacccctcccccctgggagctctgtcccaggggagagatcagagtacttgtctgtagaacc

SEQ ID NO: 615495 - DNA, 519 bp, Homo sapiens
gggtagtacggattttttaacacagctattccagtgaaatgggaggttatcacacctgcacaattatcatcgctgctcaatcagatttcattattattatccgacctcctacatatcaagcataagtttgcctatggatccttaattctacgctggcatgtgccaaactttactagaacaagctgggaaagagagacagagcatgcgtgagcaaaccctataagactcttttagtaatagacctcaaggggaattcattaaatttaaaaaagaagtgtaagatgacaggaataccaggaatcctcccactgtgtatgggggtaatactgccttgacacatgaaagatttggtttcttagggtgccaacaaatgccagttgtactgtggagagcactgtcttttgtatcaaaacagaggtacctgttccaaaaataggatagctgcagtctcagggtctatgctcgtgcccagtagacggaagaaaagcacgtctcacgtaatgagagaacgggattttg

SEQ ID NO: 615496 - DNA, 598 bp, Homo sapiens
catagacgcaatttaaactttaattgaacactatcacatggctgcctctcacgcggagtcctaacaggtttctaccatcgtgtattaaatgagcctgtagcagttgatcatatgaagactcctactttagtccgccctctgatgctgaataaccaggatatttcttggaggagggggtgaggcgaggtgcaatagactagtgtgaagggcactgcatctgtcatccgtcctggactcagtgggatttttctcatgatacgatgcctataccaggagctgctgacctcacaagagagcgttggggggatggcggatctctttggtttggtacaagtcaatccacacagggacagaggttcagttggtcggtcgccgttaacaggcatctaacagtctagtatgaagacgacctccctcatatagattgggccatatgctaccatcggatgctgcactcatgctcatcaacttcatcatgactggataacacagttttacccgtattattgccagtgtttacttcaaccaacatgatccaatgcgatcttcagatggggaccccacaatcttatggcccaaaatctcctgaaccggtcta

SEQ ID NO: 615497 - DNA, 168 bp, Homo sapiens
ccgatgcagatgccgcttgcgtttgaatatttgctactaccgcaaccaatcacgccgttttagactcctgggctcaagcgatcctgctgcctcagcctaccaaatagttgggactagatgcacgcaccaccacgcctgactcgggacattattcttaagggtattatc

SEQ ID NO: 615498 - DNA, 184 bp, Homo sapiens
tctcggcacatggctgctgggcttgcattgcattctccatgcaccagggcgcgctgtgtccatcccacagtcagtgccgcatggccgctgtcctgcatgcatgctcaggcggggggcatcctctcgcagtcgcacctgccaggccatgccaagctttggccactgggccggtcggtttttccca

SEQ ID NO: 615499 - DNA, 947 bp, Homo sapiens
gaggagaaagagcaactaagaatgtgtgcatagagaccaggatgtgaagacataataagaaggcagtgtggctgggtgcagtggttcatatctgtaatcccagcactctgggaggccaaggcaggtggatcatttgaggtcaggagttcaagactatcctgaccaacatggtgaaaccccgtctctactaaaaatacaaaaattagttgggcatggtggtgcacgcctgtggtcccagctacttgagaggctgaggcaggagaatagctggaaccgggagacgaaggttgcagtgagccgagatcatgccactacactccaacctggcgacagagcaagactccctcagtctcaaaacaaacaaaaaaagaattcccaaaatttagcccaggactatgtggggccacgttgcctgtaatccccagtctattaggggtggctgaaggcagggaaaatcgtttgaaccctgggggcggtgcgaagtttgacagttgacgccgaagatcaacaccagttggagacttccaaggccttggtggcaaccaggatgtagacagctctccaaagttctcaacaacaaacgtaatatagaccaggaacgacaaactcaagcagacgtagaaaaaaccacttcgagatcctgggggaagtaagggctacctgggaaactccagcgttacgccagtactcggataaagcgggacttccccgcactgggggaaattcccgtttagtcttaggaaaaccaccacagtttcataacaatctaacccggggacagcctgcacacagtacatcaacgacacttgcggggtttgccagcacagcacaccacaactaacaacaacaaacaaatcacacacgactagttgttcggacaccgccaggagcaccacggagaagagcgactttcatagcaccgatctcattgttgtaggcacgagcga

SEQ ID NO: 615500 - DNA, 250 bp, Homo sapiens
cacttacatacactattgttcaaaggaacaggaatgataaaaattgccgacgcattcaatctcttttcctccctgaagtcttcaatgatttagaaatcttttctgtattgttcaggcctataaagatatttcaatccaatctgtaaccctttttaggtcataatcccttttgaaagcaagaactggatttttacctccccccactatttaagggtttggttttgggaaagtttggataaaaagggcccca

SEQ ID NO: 615501 - DNA, 1016 bp, Homo sapiens
ggtcctagatgctttatgatcagaggtagttgcgggggtgttattttgggaagtggtggtggtaagggaattccacacttgttctgggggccctagtgaggagtgggagaattagggtgaaagtgctagctgtttcgaataaggtgaaacggcttgaggtgacgctataatgggctagaatctatctaagtacaggctttggcaagttgggaaaaagggaaagctctggattaagggttacaggtcactttcaagcgccttatggtacgcaatggtgtaccgagccgcgtttttagcaaatgttgtacgcattgtgcgccatcccgtgtacctgcaatgccaggatggagggtccaaggcaagcccgagtatgctcctcgattgtctctcaagaggtacgcaagagttaagcacgttgagcctgggcgtacgatatgcagtccacgtcgccctggcgttctgcctaatagctctctgcatagttggcaatgcccagacccagatgtgcccatcccgcaccagatgcccatggctgattcacagcaaactacgtcccaatcggaagcccacgttctctgttcattccgtcctgctagtctcccgattgtcagtgagataggaacgccgccccatctccaggccccacaagccatgaagcgtgggcataatgccaatgtcgctcctgcttggcgagcccaatcaccacagcttgcctgaacagctactaaccacacgcccactccatgctcatgtcctttccctggtctgcttcatctccttctcactctagactcatcatggcagatgaacagaggaagatgagtggtgacaagccaagaactcaggccaggctgcccagggtcaaaccccagctctaccactggggaacgttgggcaagtgactgctccctctatgcgcccagattcatctgttaaaggagacagaataaacctacctcagagggttgttagggggacaaatcaggtataattagtcatgagtgctttatgtctag

SEQ ID NO: 615502 - DNA, 860 bp, Homo sapiens
gatggacgggaggctgtggggtcccgggtggggaatgcagtgggtgttgctagacgatgggcaactagcctctcgatcgacttcctcagtaccgacggctgggccactccgtctagccggaagcatgggggcccggagccggggtgggcagagagtagtgctcggaggtccaggagagcggtcagactcggcggagggagtcagggtgcatggccaatctgtcaggttgatagaacccgtaccgtcgatagcgtggcatatgagtggctgcagatccaagccgtgcatatcagcgatcagaggtaatcctgaaggcacatggtcgagtcctctgggatcacatgagtcacgaggaaggagtaaatccaccaatgcttttgagggctttacactagtcggtggtaaattatgatagctctgtcgtgagcaatcgacctgggactctgtactactgaggatagtaacctgaggatgattatgaaggaatatgcgagtacaggcagatagctgagttgagtaaacagtaacgccaaaagaaataacagatagattggagagaatgcaccgttaagcaggctgcacagcaatcagggtgccaaatgcaagctgtatgagagaaaatgggattggatgtatgaatgagtggtggcacaccaggaatgtttgtgacttatagatgattggcaggttatagcattcatcgaaactgctgggatgacatagatagatgctgtaagcatggctggtgaagaaactttatcagatcataagaagccttttgaaagacaaatttggccaaggagagtagtaaattatgggaggaaaacctgtatatataactacaggcttgaaaaggttga

SEQ ID NO: 615503 - DNA, 329 bp, Homo sapiens
tgactctagaggactcccgtccattcgtggcccgcgcatacaagcacttcgctcgttagtcgctgtcgcctcgcttcgcttatcctccgcaatcatgtcgtgacacatccgatatggctgagatcgataaattcgatcagtcgtgactgaaaaagacctagaggcaagagaaccatccactgccttccaaagaaacgattgaacaggagaagcaagcaggcgaatcgtaatgaggcgtgcgccgccaatatgcactgtacattccacaagcattgccttcttattttgcttcttttagctgtttaactttgtaagatgcaaagaggttg

SEQ ID NO: 615504 - DNA, 260 bp, Homo sapiens
cgcctcctgggcaattctcttgcctcagccttctgaactagctgggattacaggcacctgccaccatgcccagctaattttttttttggtatttttagtagagatgggatttcaccgtgttggccaggacggtctcgctctcctgacctcgtgatctgcccgcctcggcctcccaaaatgatttggtggctttttaaagttctgaagacacccaacacaatttggcaattatgtggtatatattcccaggaatacttacc

SEQ ID NO: 615505 - DNA, 198 bp, Homo sapiens
tgtggtgcaagtcttgtgtgggaggatctgtcatggctcagcaggtcactgagtcagtacagaagcactctgaagcagcacccatttcacacatatgtttccaggcagagagaggtgatagagactccaggtgcatcaactcagcacatctgaagctgtgtgctgcggtggagaagcaggaagcggtaccgagctcga

SEQ ID NO: 615506 - DNA, 820 bp, Homo sapiens
ggcaaagatccatgttgcacacagacaggtgttcagtaaataatttttggaataaatgtgaacactgaatagcgaataaatgttatagatcgtaatagttgtagaagattggttggagatgtagggactggatgtggggcaatggctgtgggtctagagtatattcattgtgcagtggacacacacctaatctgtcctcaaggacacgtaaccatgtggcagtgaataggaaagaccaaggtagaagcaggcaacgagaagcggaggcagggagtacagcagctatgaaatgttacattgggttcatccagagcaagaaaagctgagagctgtccgtgagggaaggccacacaggcaagaggagtgggacaggggagtaaaggagtgggctacaacaggccctgcagatgtgtgacatgccagacccgaatcagaggcgacttagaaagtgaggatcctggatgaattattttagggagaaagtgtaggtttagatcaggtgggtaggatgtgttctgtagggcgtacagaccaagtttggtcaggactaagaaggtagctaaaatggaagtagaacttctgggggacaggagatctagggtactccagaaccagggaaatgagaaacaacgaggggacattttacgaaagagagggaagatcattctatgaggtggacgatgacaggtgtgggtgatggtgaggcacagtccaagactcactcgaagggagggaactctgttattgttcctattcccgagttgtcatgagtctggccccgtgggcgcctcggcctatgtttcctgtgctgcctggtgtg

SEQ ID NO: 615507 - DNA, 116 bp, Homo sapiens
aaaaatccaggtactgggcgctctcaaagggaagagaaggctacatagttgaatgtgcattgaacctggatctaacgggggaacccaatggaacaaggaatgtgagttattgtttt

SEQ ID NO: 615508 - DNA, 260 bp, Homo sapiens
  misc_feature (11)..(11): n is a, c, g, or t
  misc_feature (96)..(96): n is a, c, g, or t
caggcactagntagtacctctgggaacttttggtaaacccctggaatacagaagaggctgttctctttgatggaccctttagtcattcgaccatgngagctagcaaggtgtcttggccaagacccacactagccctgagggcctctcatagtagcagaatgtcgaagctctgcccatcagcttatctgaaatgacacctcttatctttcactcctccactccctgggtttaacagcaaatttttgccccatgctcagagt

SEQ ID NO: 615509 - DNA, 2075 bp, Homo sapiens
  misc_feature (955)..(955): n is a, c, g, or t
tactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcactcgacacagatgcagcaaatagggcatcacacatacacaggcattaatactcacgggcatatagatgctgacatgtgtacactgacttacgcccttcccacagctacagataaggnctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatctttgcatcgcttttgttttctttttatgtctctgaagccagcttttcctgttcactcatcccttgattaaatatggacattctagcttcacatcacttcctaattcagggaccaacagagactggttagcatgttgctatcccacctccaaattgcatcagggaatttgattttgctgcttgggtcagggtccagtagtctgggccaggggactgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcaggttctaaccttctcccctctctgaggctcagctgctcccttctgtagaataaaaggggttggtctgtaacaagattttcaaaaatttatagtagtgaaactttacaattcgacttggacaaccagagattaaaagcaaatagattcttgttgatgtcaggtggggagcttagctctcccattctgtgattccttcctctgaaggccctcaaagcaactccataataactcacagagctgccagagccgatgttttggagcaccctgagacatatgaactctaatataacttccaggagaaagtacataggattccacttagagccaatctcagctgtctatctgtctagctacctgtc

SEQ ID NO: 615510 - DNA, 147 bp, Homo sapiens
catagttgtgtccattaatttcatgcccacagtcttcttttctcttcctgacctctcattacctcttttatactacttgatctctggttaaactttcttttgttgacatataattcatacactgtaaaatccacctttttttttttt

SEQ ID NO: 615511 - DNA, 116 bp, Homo sapiens
cacacctatcaccctaaataataatgtatctatacaaaagtattgtacaatttcgcaaccgctgctgcccaactggaataaggagtcgggagcgaaattcacatggatagaaatgc

SEQ ID NO: 615512 - DNA, 106 bp, Homo sapiens
gatctccctcatctggcgtgactcgcatcgggggtatgctgttcgaattcataagaacaggaggttagaagtagggtctggtggcaaaatatgtgtgtagagtcag

SEQ ID NO: 615513 - DNA, 394 bp, Homo sapiens
agagttggtaccttttagctatatttgcagttttctctgtggacttttagaggaagctggagaagaacagcgaaagtgtgactaagattttatatttcttgtcctctaaatattttgataatttctggattgatgcagtgatgtttttgttccttccgtatttataaatgaaacacctttttttagtgtttctaaacctaaaatctacttgggtttggaacatcgaagtggtgtggaacactggtgtggactatttatttcgaagcatttggttgattggaaaatttcattgaggaagtttttaatcagtgtgatcagtttgattctgtaatgagcacagcagctaatattttgaggagctctgtgttgaggaccaatgcttaaggtggacttg

SEQ ID NO: 615514 - DNA, 127 bp, Homo sapiens
ccccgctcctgtggagatcaaaatttaacctgtgtgttatctagtgctggagcctgaagagcccggtgggaatgtggagtgacggagaggatggggcatggacccagaggacactttgcatccagag

SEQ ID NO: 615515 - DNA, 1025 bp, Homo sapiens
  misc_feature (186)..(186): n is a, c, g, or t
cactcaaatctggtccttctgttcctgtctcagttactaactaacgatcatgtctatgagcgctacatgacagagatgtacaggctactgtgacagcttttgatgccagaaaaggcttctgtcacacacagtggcccatggagaaagaggctcttattaaacttagatgaaagagctgcttccatngtcagggtattttctaatttcagttcaaggaatatcctaaaatttagcctgttcagaatttactgcacataaaaaagggtatttcatccagaatagatcagttattgaagcagtgctgctaacatccattccctttcataccaccattttcaccctgtttcttcccctcctccagttcttgggaaatggtgatcgggggatcttagtgcttattgtttggactctgtgtgtgctgtgggcactggagtagagatttctggagaaaaacaaacagttttatttcatctgtgcctttggtgttggacgtccattcttcaataaattttcctgtaacactatctcgtaatattttcaactttgtaatggaaactggtctcacaatgtcatttcctaatacaaggcacaggatatgtggggaagaatatgtacaatttatttgatccaacattatttcccactgacctacactttcagtgatgtggtgggacccaaatacactaactgtcctaaaccggaaaaaaaacaataacaacaacagaccacctttggtgggcggcgcggcccaagaaaagttttagaacccatggagtggggcggcgacccatagttacgacaagcgcaccgcgggtcacacgaaccgcgcaggagatggtgtgatcaccaaaaaaaggcggggacacgcgcggtgacaaccaggggctgcggcataggcttacgggcacgagcagatatccggcgggatacgcacgcacagacagcgaaaacgcacacacgaacaggcagaccccaggcgcaccaatgcgcaaacacacacaccaaacacgaacacactacacaga

SEQ ID NO: 615516 - DNA, 526 bp, Homo sapiens
acttgctctgccaagcaagctgttgccaacacaggcaagatggagtcacccgcctggatgcccaacttcccagcgtccatgcgtaatccaccgattcagactaaggggctgaccactctggagaccttcatggacacgttgccggatgtgaagaccacgtgcatcacgctgctggtgctctggaccctcagccgagagcctgacgacaggcggcccctgggacacttcccggacattcacttcgtggaggaggccccgcggaggagcaatagacggttccgccagcgcctgaaccagatctcacacgacatccgccagcgcaacaagtgccttcccatcccctactactacctggacccggtgctgattgagaacagcatttctatttaggagcgcgcttcccgtctctcctctccccattctgtgccctactattttcaacaaaacaaaacaaacaagcaaaaaacacaaaaacctcagagaccaaaacaccaaacaaacaaaaaaacaaaaaaccttcctttca

SEQ ID NO: 615517 - DNA, 434 bp, Homo sapiens
  misc_feature (1)..(1): n is a, c, g, or t
  misc_feature (149)..(149): n is a, c, g, or t
  misc_feature (176)..(176): n is a, c, g, or t
  misc_feature (222)..(222): n is a, c, g, or t
  misc_feature (357)..(357): n is a, c, g, or t
ngcccggaaggagacagacggccaaaggagaagctgcctgtctctgcacaggtccatgtccctgaggaaaagccaacgtcacagagaaatgatgaccactttctcaaacctggcttcggatttgcacgttggctgccaaagctgatcancagcgggctttgtgaagatgcctggtntaccacgtgcctccagctggtcacgcccaagactccctgagccctntggaagggcagcacttgcccagtgcctccctccaggtcctgccacatccaagaaccacctggactattatttacttagtattttaaaccaatgtactttttaaactccaattttttaataagatcatttatgtcnccatataacacccaaagcagtagaatttgtcatacacagaaggcaatgctaaaaatacaatgaaaatggaaccagga

SEQ ID NO: 615518 - DNA, 1038 bp, Homo sapiens
  misc_feature (124)..(124): n is a, c, g, or t
  misc_feature (325)..(325): n is a, c, g, or t
  misc_feature (398)..(398): n is a, c, g, or t
atcaatacctgaccttttttaaagaaaataatttgaacacagcagcagtactgtgaggaagaacagtgatttgacatacccgacaatcccaggcatggtgtaccctgccagttctcttcttagnggaattctctatcctccaaagacgacttgtggagtctggggtgttgtcggatcaacagaggagggtctgaaagtttgtgcatgtccacggcaaagaacatttggcctgtatcactaacacacggaaactgagaaatagggaaggagttggtgcatgcgaatggagataaatgtatggtgagggcgtgtctcagttctggcntcgttcatatgtgtactatggtggagtagccagtgagtagtagtaggtgatgtattatagaaagcaggagtancagtgctcaataataatttgtagtcgtgcaacgggaacgtataaggacgcattcagtggtacaacgataggcttaaagcccacgccttttgtacctatacatgtaataaaggttagagcattacgtgtcgacgccgatcattatgggagagggataaggtgtttatgcatacacagcttcccaaacggtttttcccacttgtttatccaactttgtccccaagacgttttcttgttatttttctcagaaacaggagacttaacacacagttcctcaacgttcaatagaaggatggaaaaccggtgctcgcgaatttaaccgtattgacaaaacagagacaaagacaccatagtcgtgtttccaccagagaataccttgtacaaagaaaacgaacaacctgcatctctctcgagaacttaaccgtctaaccgtcggtacagagaaccgtgtatctatttcccccccgtgggtttaaacgtggacgtatttaaatatggcctaaggacctactctcggagtgagtgaacgcataaatgcgacgcatttaaatgttaaaatttaccttcgtgggaactattttggagaaatcctatgggacgccttagtgacctttccacaagggggcgccaaacacccaact

SEQ ID NO: 615519 - DNA, 116 bp, Homo sapiens
gctaccggcttctcgccgtaacttttccgccgagcacgctacgcacgtaggtgttgtggcagcgtacgaagagcgattccccttcggcacccgtggcgtcggcgttgttagcttcg

SEQ ID NO: 615520 - DNA, 307 bp, Homo sapiens
tgaaacagaagttttggctctggtttgcccaggctgaattgcaagggcgcaatctcggcttcaaccgcaattaactggaattcacaggcttgccccaccacacctgaactattttggtttttttagctaaaaacgggtttcctccttttgggtcaggctgattctcaaactctcgacctcaggttgactccgcccacctgttggcctcccaaagttgctggaatttccagcgcattacccaccggacccgtggcctttgaccttctcatttctaaagtgtggagaggaaaaaaaccaggctccgtgg

SEQ ID NO: 615521 - DNA, 433 bp, Homo sapiens
  misc_feature (12)..(12): n is a, c, g, or t
  misc_feature (20)..(20): n is a, c, g, or t
  misc_feature (61)..(61): n is a, c, g, or t
  misc_feature (63)..(63): n is a, c, g, or t
gattcggcacgnggcggagngggcagatcacttgatgtcaggagttccaagaccagcctantnaacacagtgaaaccccgtctctactaaaaatacaaaaaatcagctgggcatcgtggcaggcacctgtaatcccagctactcaggaggctgagcaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccaagtctgctgtcaagtgttcaagtggcacacgtcgcgaggggctgccatcacggacggtgcaagatgtcccatatatccagcattctaaggacattctgtcagatggcaccgggctctgtcctgtctgctgaggaggt

SEQ ID NO: 615522 - DNA, 419 bp, Homo sapiens
gggagtggtgatctagaggatcctttttgcggcgctttcctgttaggcgagagtgcgaaagggagacgtgcgaaggggcaggtgtcgggcgctgtttctcgtttcatcatatagacaaaacagccctgtgtgcaaagatggtcacggtacctaaaaccggaagaaccttctgtaagaggtgtggcaggcatcagcctcacaaagtgcacaggtataacgaagggcaaggattctttgtatgcccagggaacggaggcgctatgactcggaagcagagtggctatggtgggcagacaaagccaattttccggaagaaggctaagaccacaaagaagattgtgctaaggctggaatgtgtggagcctaactgcagatccaagaggatgctgggctattaagagatgcaagcattttgaact

SEQ ID NO: 615523 - DNA, 1026 bp, Homo sapiens
  misc_feature (4)..(4): n is a, c, g, or t
  misc_feature (68)..(68): n is a, c, g, or t
  misc_feature (91)..(95): n is a, c, g, or t
  misc_feature (97)..(97): n is a, c, g, or t
  misc_feature (100)..(100): n is a, c, g, or t
  misc_feature (172)..(172): n is a, c, g, or t
  misc_feature (258)..(258): n is a, c, g, or t
  misc_feature (266)..(266): n is a, c, g, or t
  misc_feature (658)..(658): n is a, c, g, or t
  misc_feature (687)..(687): n is a, c, g, or t
  misc_feature (743)..(743): n is a, c, g, or t
  misc_feature (786)..(786): n is a, c, g, or t
  misc_feature (802)..(802): n is a, c, g, or t
attntttgttaaaagttcaaacattttaatgctctgggaggatgggagaacaacagaattcggtaaanacatttgggaaaagacatccttnnnnnanacntgtggttgatctaacaaatatagaccctgatgtcgcttattcttcagttccctatgaaaagggctttgcttnacttttttaccttgaacaactgcttggaggaccagagattttcctaggattcttaaaagcttatgttgagaagttttcctataagngcattacnactgattactggaaggatttcctgtattcctattttaaagataaggttgatgttctcaatcaagtttattggaattcctggctctcactctcctgaactgcctcccataaagcccaattatgatatgtattctgacaaatgcttgtatttccttaagtcaaagatggattactgccaaagaagattatttaaattcattcaatgccacagacctgaaggctctctcttctcatcaattgaatgagttttttggacagacgctccagtgggcacctcttccatttggggacataaagcgaatgccagaggtggactactttaatgccattaacaattctgaaatactattcagatggctgcggctctgcattcaatccaagtgggaggacgcnattcctttggcgctaaagatggcaactgnacaaggaagaatgaagtttacccggcccttattcaaggatcttgctgcctttgacnaatcccatgatcaagctgtccgaacctaccaagagcacaaagnaagcatgcatcccgtnactgcaaagctggtggggaaaaactttaaaaagtggattaaaagacctgcgtatgtgatgagttttagatgatttctcgttttttaaatggaattcggtaaagaaagtataaagacttcatgctcccatattaaaacgtgtctttattagttattggcgttttatatgtgtttatgttgagtgatttatactgagaataaaggttgagcgtactttcttaaata

SEQ ID NO: 615524 - DNA, 273 bp, Homo sapiens
  misc_feature (134)..(134): n is a, c, g, or t
  misc_feature (152)..(152): n is a, c, g, or t
  misc_feature (162)..(162): n is a, c, g, or t
  misc_feature (179)..(179): n is a, c, g, or t
  misc_feature (221)..(221): n is a, c, g, or t
  misc_feature (224)..(224): n is a, c, g, or t
  misc_feature (261)..(261): n is a, c, g, or t
ctgaactgggttaggtgccgctgttgctgctcgtgttgaatctagaaccgtagccagacatgggactggaggacgagcaaaagatgcttaccgaatccggagatcctgaggaggaggaagaggaagaggagganttagtgataggacttagnctttcagtgnatactggcaaccttggnaggcaggaatgtgaaacttttccctactacttagcatcaganttnaatgggagaccgcattctgccatttttggcggcagtntggctctgtcag

SEQ ID NO: 615525 - DNA, 146 bp, Homo sapiens
gacgcagtctcaaaatcaactattagtacagaagagtcaatcagaatatgaaaatgtgtaaatgtgcatattctcttttatactaatttggtagcattaacaaatacttacagcatcacaagttagagctttcatgaagaaggagt

SEQ ID NO: 615526 - DNA, 936 bp, Homo sapiens
gattatactagcattataccatactcacttctaggaatactagtatatcgctcacacctcatatcctccctactatgcctagaaggaataatactatcgcgtgcatgatagctactctcataacctcaagacccactccctcttagccaatatggtgcctatgccatactagtctttgcgcctggaagcgaagggtgggcctagccctagtagtctcaatctccaacacatatggcctagactaggtacatagagctaaacctactccaatgcgttagaagctaatcgtccgcaacaattatattactaccacgtgacatgagtttccaaaaaacacataattgaatcaacagaatcacccacaggctaattattagcgtcatccctctactatgttttaaccaagtcaacaacaacctgatttagctgttccccaacttttcctccgaacccctagcaagcccgcctcctaatactaagctacctgactcctacccctcagaatcatggaaggccaaggccattatccagtgaaccactatcacgaaaaaaatctacctctctatactaatctccctacaaatctccttaattataacattcagaggcacagaatattcatatattatatcttcttcgagacagattatcgcaactgggtattatcaccgatgaggagcaagacagaaagcgtgaagggggaatatttctaattataactagtaggttccttccgtaatatggagtttagatgaaagaacctaggtgactaaaattataatgagttgaggcagagaataaatctggcgaaataaaggaggttagaaggttaggagaacctaggcccttgactagcgtgacccggggtagtgtggaacaaaaggggtaggcgctttccgaaggctgtgtttgtaggggaaatttagcggatgaact

SEQ ID NO: 615527 - DNA, 781 bp, Homo sapiens
  misc_feature (53)..(53): n is a, c, g, or t
  misc_feature (194)..(195): n is a, c, g, or t
  misc_feature (200)..(201): n is a, c, g, or t
  misc_feature (223)..(223): n is a, c, g, or t
  misc_feature (228)..(228): n is a, c, g, or t
  misc_feature (237)..(237): n is a, c, g, or t
  misc_feature (242)..(243): n is a, c, g, or t
  misc_feature (253)..(253): n is a, c, g, or t
  misc_feature (262)..(262): n is a, c, g, or t
agcgggttgtacccgcggtgcatggtggggcggtctccttcggcaaccccggncgaacgggccacccagaggctgtgctgagctggcgcagcggcagcagcatgagccggaccctcgcatcggccgtgcccctgtcgagtcccgactactacgagaggctgggccaactccagcacgggctgcgggacagtgannaaganngagattggacctggaaaagaanctttnatgaatatnatcanntctgatacantgcaggagnttaagctgaaaatattgtcaacactaacagaattattctgaccggccactatgtgactctgacacgacggctcatactcgaaaccaagaatatttacacagcgatttgagcgtgtccaaggctcatgttgtacacttcaccacaaataccgagaagcttcaaaaactgaagctcgaatatgagactcacaacttacgaagatgctatgctcaaaagatagcctgggactaaacagaggaactgacagatgaacgacagagaaacaggttgcagtgcaggagggggattaactcaggaaacagcccatgtccagaggattgtatcaaccaggcaacaattctttatgggccgccaagatgtcagccatcttaagcattgagagatttcagtaccaggagcacaaatctcaccagccaaaaaagaactttttcaattcctgacccacattcacaccgacagaacagccagagcagttatgtgaccagacagctgtgtagttacaaactagtagtgagcaga

SEQ ID NO: 615528 - DNA, 163 bp, Homo sapiens
tcaatggtgacagtgttgaaggaaatgtttcggtacccatgtctgtcatctccagattgggtgatcattgagactcaggagcaagtcaccacagtctttgaccacaggaggcatgcccatgatggtaggagaaccgcacaagtgccgcaaccatgttctctga

SEQ ID NO: 615529 - DNA, 144 bp, Homo sapiens
ccgggcgtgagagagaaaagtgtgtctgtactgcccccacctttagctgggccagcaactgcccggcctgcttctccccacctactcactggtgatctttttttttacttttttttcccttttcttttccattctctctccact

SEQ ID NO: 615530 - DNA, 289 bp, Homo sapiens
ggccggctgatgcatggctgctactgtccagtttcctagtatttcttttgtttttgagaacggagtctcgctctgtccccccaggctggagtgcagtggcgtaatctgtggctcaatgcaagctccgcctcctgggtttcacgccattctcctgcctcaacctctcgagtagctaggactacaggtgcccgctaccacgcccagctaatttttggtattttaagtaaaaacaggttttcaccgcgtttagccaggatggtctcggtctcctgacctcgtgatccgccca

SEQ ID NO: 615531 - DNA, 190 bp, Homo sapiens
ctcgatatgaacacaaactagaatcactgcattgacttcccttctccaatcagggggagtgatggtgatggtgcatgagtgtctatttgcattgagtcttaatggaaaataaggttgtgtcactcaaaggaaaaacaaatcacagcccagactggagctgtagatgaataacatggctgagtgttggtac

SEQ ID NO: 615532 - DNA, 418 bp, Homo sapiens
atgtatgggatgctgcatagtcagtctgtaaatactgtggtacctcagaatgatagttggccgcacgggagctcatagcctatgaagtctgttgctataggtgcaagcaggaggataacaccgatgtctcaggattgtgagtagtgaaatgaaccgtcatatagacctagtcctatgtgtagttagaggcagatatagaatattaaggcgcctttggcgtgaaggtaccgtatgattcagacataattcacgtgacgagtgatgtgcccgattgatgtataggcgctgtaggcgtctggtaagtagtgcatgtctaggaatagtcccgttgtcaggtgtcggttcaggcaagagtcaaggagtgagaagtgggttcatcataggcagatgttgaatgtagtgtgtaggtcaatgaatg

SEQ ID NO: 615533 - DNA, 218 bp, Homo sapiens
ggtttaacctgtggaagcatgctacaggcgtccacacgatcttcaagtggtgatcggctcacattgcctcactatctgcatatcatccgacagctaatatttcactatacatccaaacctcacttcggcttcgaagccgccgcctgatacaggcatcttgtagatttggtttgactattgctgtatgtctccatctagtagatgagcgtcactgttgt

SEQ ID NO: 615534 - DNA, 592 bp, Homo sapiens
atatctaacatatcactataaagaattaatctctctaatatataagaactctaaaaaaaaaaaaaaattttaaaacattgagagaaaaccaaaaatctttaccaaaaaaatgacaaaatacatgcacagattgttcacaaataaatgactcttacatgtaaaaatacactcaacctcgctcataagagaaatacaaattaacaccacattcacataccatgtttgaccaagtcacaccagaaaaaaaattaacagcttgataataaattgtgttggtgaggctataggggaaacaggtactctaatacactgctgctgggaatgcaaaatggtgaaatttcaatggaggggaatatggctatatctaacaaaactatacatgtatttacccttaaatgcaacaggtccactctaggaacttatactgaggatacccttcccaaaataatggcgaaaaatacacccgaggtatacagtagtaaatacgcacaatttcggaaacaacaattcaaatttccaccacgtatgagtcttgttggccaggtgtggtggctcatgcctgtaatcccagctacttgggaggctgaggcag

SEQ ID NO: 615535 - DNA, 95 bp, Homo sapiens
cgcggccgccttttgagaagtgcggaataggttgcttctaccacctgttcttaatgtaacagtaaaagttttcacatttttctcagaaaaaaaaa

SEQ ID NO: 615536 - DNA, 480 bp, Homo sapiens
agggtacatgacgagtaagtcagagacgtaggctgctgcgtgccgttcgtgagctaaaacaccaaaagtcaagggcaacacaagccacaatgacaaatgggatcggattaaactaaagagcttctgcacaacaaaagaaactgtcatcagagtgaacaggcaacccacagaagggaagaaaatttttgcaatctacccttctgagaaagggctactacccagaatctacaatgaactcaaacaaatttacaagaaaaaaacaaacaacgccatcaaaaggtgggcaaaggatatgaacagacacttctcaaaagaagacatctatgcaaccaacagacacatgaaaaaatgctcatcatcactggtcattagagaaatgcaaatcaaaaccacaatgagataccatctcacaacagttagaatggcaatcattaaaaagtcaggaaacaacagatgctggagaggttttgtcaccaccag

SEQ ID NO: 615537 - DNA, 114 bp, Homo sapiens
gtattttcggcgcgcagtatcgcctgcgttcggtgctgatgcggctgctggacagtcatgcacaccgtgcccagcgttcgtgtatctgatcccggtgctgattgctgttcggcc

SEQ ID NO: 615538 - DNA, 184 bp, Homo sapiens
tgtacttctggtcttatttaggacttatacattcatgagaaaagaacaaattttttatggaatacataacttccaggaacaacagtttataacgtattcagttgtttaacataacacagaactattttccttcctaaaatgtaaacatccagctaaatgcgggcacggcaagatcagggcgatc

SEQ ID NO: 615539 - DNA, 136 bp, Homo sapiens
  misc_feature (1)..(1): n is a, c, g, or t
  misc_feature (76)..(76): n is a, c, g, or t
  misc_feature (100)..(100): n is a, c, g, or t
  misc_feature (117)..(117): n is a, c, g, or t
  misc_feature (130)..(130): n is a, c, g, or t
nttctaccaacgccaggacgtggcgcgacgctgtctgtccccgtccggttcatctggcgccccagcctcccctgcntgcagctccccacccagctctganttcatggatgttaattnagagccctggttnctgcca

SEQ ID NO: 615540 - DNA, 150 bp, Homo sapiens
gctcacactccgcagctcttgagtccgatccttcatcctgcgacggctcctcctcctcctcctagtcctcctgcctctgctgctgctccgggtctcccgcctctgtgccggaggccggggtctgggggcgccggggggcgccgcggccgc

SEQ ID NO: 615541 - DNA, 1790 bp, Homo sapiens
  misc_feature (1038)..(1038): n is a, c, g, or t
ggcccctcattgacatgaatatcatactagcggatacctatctctctctacgtaggaactacctagccattatacgacttctagtcgcctcgatgatccattcccctacaaatgtcctttacgtatagcgaagtaaatgatcatgactacagactggtggccatttatcatgactcatcttctccaattataccactcttacataccacctctaaatcacgcctactttaacgcctctaaattaattggtctgccttcattttggcgcaatgacgttagtgtcggttcttggccgactcattgcggaaaagtctaggcggagagggggtccttgagacgcttatcatggggtccattcaagatactactcgaatcaaccattatatgggctccgtataagcgtaacgattaatcattaaaatccctgacatttgcacattatcttactcatattttgtccttgggcactcctctaagaattcgggttcacccaaatcaaaggtcaatttactttcaccatgaacacggaccggggaactatttagtacctttatgtacgcacaataaatcccatcaatcactatgtgcgatatcgatgccacaaaatgggcacccaaccaagggcgatacaatgtaacatttaggtccacgttcgaggtcaccccggtcgtgaacctcatgaatttacacaaataacggattagagtccacaagatagccaattccccgtaagtcatccgggccatgtgtgttttccaccactatatatcccgcttccctaccacttccccagaacacactcggcgcgctaaaaggaaaattctctccccaccggtgcgccttcaaacatatacattttaagtctttaaaaccccttgaacttcttccccgttaaagcacaccgtgtgtcatgtatacaccaaccccactgtggtgtctacaatggctccgcaaacaagatacacatccgccttaaagtgcgccaaagtttggttgtccctcgcgacaaatctcacacaacattcagtaaagaacaancaacatgggccgctgccggcacaaatataacagaagacatcattccaccactgcggggcggtcacccgaaataatgtgcgtattaaacaccaccacaccaatataggtcgggcgggcgacagctgcacgacccactaacgactgctcacacacacagcgctgggtgcgaacacgcacacaaccagagatgccgcccaggccatggtgaccccagcgaatcaccacgcaaagcacgagcgcaccaacaccgggcgacccactacaacgactgggacgacgaacaccactccaaataaagaagacaccaaaatcgggtcaccacgcacaccacacacccacgcatcaacagcagagaacgagacaaaacagcaacggagcgcgtcacaaatcgatagacccagtacacaactcccacgacaaccacaacacagcgaggcgacaccaacagcatagacaacgcacacaacagacaaacaacagcacagagcacgagcaggcgcaccaaacaagactaacgagcagcgagatcaagtaaaccagagtaaatatccagcagacagaatgtgacaaggcacaaccaatcagtcagttagtgacagcacgagactcagcaggagaacgacacaccagagcaaacaaacggacacaccaaaggcaagacacacaccgagaccaaagccacacagtcacaacaccatcacaaagcgaaacagcgacgaccagcagaacggacacaaaaccagagcaagacc

SEQ ID NO: 615542 - DNA, 960 bp, Homo sapiens
  misc_feature (23)..(23): n is a, c, g, or t
  misc_feature (68)..(69): n is a, c, g, or t
  misc_feature (311)..(311): n is a, c, g, or t
  misc_feature (379)..(379): n is a, c, g, or t
  misc_feature (406)..(406): n is a, c, g, or t
tcccccttcctgctagttggcgncctcatggctgtgaacaactgcgggctgcaagctggctcccccannactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgcactccaccccaacaacaaccagatgtgctccagcccanccgggcttcagtcccatatttgccatgtgtctgtccagatgtggggttgagcgggggtggggctgcanccagtggattgggtcacccggcagacntagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgcacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaa

SEQ ID NO: 615543 - DNA, 298 bp, Homo sapiens
gtctctgtttcacactctctgacccattctttgatcagcctatgtgttctgatgcggaatttgggaaatagaataaagacaggacccttcctgtcatgctcttagaatctctcaggcaaggtactgtgctgcaccttgaacatggtaggcattgaacaaatgtttcaagatcatttattataagttccaggcattctgatagattttttttcatgtatttctttctgtggccttgaaagtaagcccttcccaataaatgcacagtcccatttgcctccattttaacgtactttgcaaa

SEQ ID NO: 615544 - DNA, 850 bp, Homo sapiens
acctgttggtgtcctgtgcctgttcagttgccctgccattgctgagcttggatcctgttctggctgcccctgcctggctgcccctgtgctggtccctgctgctggttgaactggagtggcctggctgcctgtgctgaatgaatgaccctgtgcttgctgtgccttctatggtgctgcatgcgaatgatgatgctgatgatttgctgtgtgcatctgatgaactgactgatggccttctgcctatcctttgactgtgctggctgccccctgtgtgccctcaagcctgcacttgctgatgcctgcctgtggtgtgtgtcctgtgagtgctcgtgttgacttgtgatgtacacttggaattgtgttgaagtacgtagccatgtgaaagtgtacccttgtgtccacacaggaccatggttcttgcacgctagttttcagcagagttgtgattctgagttttgcattgtacaggatggccgcattgaaaggtcatccctggtaagaaccttggtgccgcactcgagacttgagatcagatgagtttgtgagagctggcatgtggaggaaggcgcccgttttggagttgccccacacgtttcccttcctgtgaacaatgtcgacaatggaccagtgcccgagacatggtttcggcgcagattctggagcatctgactgtggccagatcttcacacgaggtgtctgcatcgagcttccacgcacccgtggcaattctgctgttagtttcgccagacttgaaagcagtctgggaacatgcatagtcattgctctttccccatctgatacagtagtcagatacatggctcagcactcctcaatctacggtgtggcatcg

SEQ ID NO: 615545 - DNA, 750 bp, Homo sapiens
  misc_feature (13)..(13): n is a, c, g, or t
  misc_feature (64)..(64): n is a, c, g, or t
  misc_feature (77)..(77): n is a, c, g, or t
  misc_feature (83)..(83): n is a, c, g, or t
  misc_feature (95)..(96): n is a, c, g, or t
  misc_feature (101)..(101): n is a, c, g, or t
  misc_feature (105)..(105): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (139)..(139): n is a, c, g, or t
  misc_feature (152)..(152): n is a, c, g, or t
  misc_feature (156)..(158): n is a, c, g, or t
  misc_feature (160)..(161): n is a, c, g, or t
  misc_feature (192)..(192): n is a, c, g, or t
  misc_feature (194)..(194): n is a, c, g, or t
  misc_feature (202)..(203): n is a, c, g, or t
  misc_feature (208)..(208): n is a, c, g, or t
  misc_feature (213)..(213): n is a, c, g, or t
  misc_feature (221)..(221): n is a, c, g, or t
  misc_feature (226)..(228): n is a, c, g, or t
  misc_feature (230)..(231): n is a, c, g, or t
  misc_feature (237)..(237): n is a, c, g, or t
  misc_feature (239)..(239): n is a, c, g, or t
  misc_feature (244)..(247): n is a, c, g, or t
cccgcgtttgtgncggtttggcggtttttttcttggttcggcggtttttcgcggttgcctcgtngtggccgggccgncgccgnctcttttgtggnngggcnggtntgttgctttggctctttgggctntntntntgncncttttttttttcngttnnntnnatgtggcgggattttcttttttgcgggttgntnggtatttnnttttnttgtntttttttnttttnnntnntggggntnggtgnnnnatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgcacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaa

SEQ ID NO: 615546 - DNA, 318 bp, Homo sapiens
cgacagagtgtcaccccaatgttattaacagcacagagccatatacggaactacctaaatgtccatcagtagatgaatgtttaaagaaagtgtggtatttaccctgggcatggtggctcacgcctgtaatcccagcactttgggaggccgaggcaggtggatcacctgaggtcaggagttcaagagcagcctggccaacatggtgaaaccccgtctctagtaaaaatacaaaaaaaaattagctgggcgtgataatgggcccctgtaatcccagctacttgggaggctgaggcaggagaatcacttgaaccttggagg

SEQ ID NO: 615547 - DNA, 579 bp, Homo sapiens
ggagagggggtctcatcaatagcaatccgaggcccggggccttagcaagagcctccttgagagccgggatggtggggcaggtgaacagggatgttttccggcttcagggataatgggcctcaagggtggcggggggatgcttctgccgggcctccaggcagaggggggctttctcctcccagcgttcagcaagggtcagcagttcctgcagctcggccggggcttaatccacagcagggctaggggctacacgggcacccgcgaccaacagtcctcgcatgacagccaaggtgccccttcgggctgagggggccagtgtgagtttcacctcatccagccatcgcgccggtccacctgccgcgggagctgctggggcctcaggcacctccacccccagtggccgccccctctccaacagggacggcagtagcccgggatggtagggcagtgaggccagtgcctcacgagcctcagccgggtaggcctccaccggttccagaacacccttgacatccccaatcgggtgcatggcgcagggcaggttgttcatctggtccagaaagtgccggagctcagtca

SEQ ID NO: 615548 - DNA, 133 bp, Homo sapiens
ggtcggaggtcgctggcggtgtggtctttcggcgtgtgcagggccaggtcagtatggacgaagttgttggtgcacacgccgtagtgtgcagaccagagacggtgtggagaagtcgcagtggacgaagttgtgg

SEQ ID NO: 615549 - DNA, 329 bp, Homo sapiens
gcaggggccccagtttgggagccccggatgaccctggacactcaagccaaagttaggcccccccaggcccaaccctgtgctggtcaagccagggcagtcacagctgcttggggcccccagcactgctgcctggtttccccagtagcctccctggccgggttccagccccctggatgcccgtttttgtcccaggcgggatggggcccagtgcaggacccagccatgtaccccaaaaaaagagtaccaagtagttttttgttcagctttttctggaaactgctgtttagggccccctgccctaaccaggaataaaggcaagacagcctgga

SEQ ID NO: 615550 - DNA, 1526 bp, Homo sapiens
cgctggcggcgcgctggtcggtgttgcgcggtggtgcgtcggcgatgatctgctggtgtgtacgctggcgtgtttgcatcgcagctgtgggggggtgttggcgtctggcggtggtatgcgcgcatgttttggtcggccgcgcgtgcttgtttggtgttgcttcttggtggttgctcgagggtgttgtgtcgcgttttctggctgagatggaggggcctcgtgctgtgcgtgctgggggaggtggagttcgtgtgtggagggtacgaagtagctgtatggggggggtaagacagtcgtgtccttttgtttgggggggtgttcgtttggcgtggagtggggcggagtggcgctgcgttgggggggggggggagttgggggctgattgttgccccccgtggggtgggagggtggttgctgcggcccgcgtgtgggaggggtggtagatgcgagggggtgtgtttggtcgggtgtggttggttgtttatgatgggtcgaggtcgctgttgagtgcgggtcctcccgtagatggcggcaccatcgtggtgtggtgcgagcggttggtagtgatggcaccgggggcgttttgtgttggagggtgtgggacgacccaccggggggaggattcctcccggcgtgggtgtgtgtcggcggggaggagggggggtgcgccgcacagggggtggtggaaagtgagtgcagcggtgagaagatgtgtcgtgtatagggcagcgctgtgtggttgcctctatagaaaggggtggtgagataggcacagctcgtggaaagaatgggtgtgtttgtgggaagcgcgcttctctcgtagaggggggccctagcagccccgtagtcccggggagagttttgggtgtttgtcttgtgggaaacgcctcgtgcttatatggtcacgccgcgcgcgctgtcgttgatagactcgccgctctcactggggggggggcacacaccacgggctgtctctatagacgtctctctctgaggttgggaggctccacgagggagattttatatcttcacatataagacccttgttcgtctcactctggtatccctgggggagggcgtttatatatatagagccacaccccagagagatataaaatggcacactgttctctggggcctctctttatataaaagactctggggagaatttcttatagagagaagacgcggctcttctatatgtaacccgcgcctcgtatattataggctcggtgattatagtttttttttgtttttcttctctataagaatgtgttctcgttatattaggttctgaagaccacacccactcttgttgtgttgtttataaggagaaagaatatcacgtcacgtgctccgcggaaggtaatttcctcgtggggtctgcacccctcctcgttctgggtggtggaatgtgggtttgagaaagtaaggagaagcacgggtggtaaccgctgtgggctcttaaccccttaatgtgattttggaccacagtgccttccattataagttttttttatccacca

SEQ ID NO: 615551 - DNA, 399 bp, Homo sapiens
gttgtaccgtggatgtatggaaaacagacgaacctagaattagaagtggagcctgcaagatgtgacagaattgtttcaatctcgtgaaaaaacttgaacagatgagaggctgctttgtatagataagcaaagaacgtggtttcctgaaatgaaatctactcctgaagatgctgtgaacattgttgaaaagacaacagacttggaatattacatcaacttagttgatcaagcagtggcgaagttagagaggattcagtccaattctaaaagaagttccactatgcgtaaacatgttaatcaaacagcgtcgaatgctaaagagaacgtatcccatgtcctgaagagtcaaaacacagcagcaatcatcactgcagactaataaaacagaaaactgccaca

SEQ ID NO: 615552 - DNA, 1234 bp, Homo sapiens
attccaaatagtttgtgccattgaaaaacttgaccttcaaaaaaattgtttttcagaatagaacacaataggaaccagtgcactgcacagttgtgcaacacaaggaaagcagcaatcattaaagcacacatgtaacacaacagcattttaagcaccgttgaaaatccaattatccaagcaacgtccataaaaacacctatggcttttgcactttgttattggatcccagattaattatccttgcattggggcaacactcatctttcatcactttgtctgcatgtacaagcatggttagaagcaagacataagtcatgagcaaagacacaactgcgcacatacaagagagacccacgtgataactaattcatataatgaggcaaaacaacatgtataccaaaataggaccacatatctcttatgagttatcaagagactagaaaagacttgaggaaaaagctttggaaaaacttctattaatagtagaatctagatacaaagaacaaaaagataattgacacaaggcataacattaaaagaaggtagtacaagataacaattggaattgcaaataaaaatcaaaaataatgtaataaaaagatgatgacaaatggatattactaagaagcaatgatagtcaaacacaaccgacagcaactcctgacgaacattcaaggacgcagacaacatcgataatatgggaaatccataaagcatacaaagacccagaaggtgcagacaaacacaaaacaagaagaaaaaacccagaatagggcaaaacaaacacaacgagacagaccacgaagacaacaacaaaaacagacaggaacccaagaagtccagacagagaaataaacaaatcatgtcgaacagcaataaaaaggcggatacagaaaaatgactacaacagaacaaaagagaccgatgaaaaagagaggagacaaatagccacgacgaaagaaagaggaaagcggaaaggaagaaaacacagaggagcagaaaagaaaagaacagtataaaagaacaaagagaccaaagcagtagaaacaaaggggatagaaaaaacgtgagagaaggcagaaagagagcaaaaaacagcacacgaaacaaggagcagagatagacagacacagaacaggagataagaccagcacaggaaaagaaaagggaacaacaaacgagctgtggacccacccaaaaaacaagaagcaagagaaaaacgaagagaacacaa

SEQ ID NO: 615553 - DNA, 202 bp, Homo sapiens
gtgtattagcaactcatcactagaacatcgtacacacgacacgtactacgttgtatctcacttccactatgtcctatcaataggggctgtatttgccatcatagtggggcttcattcactgatttcccactattctcatggctacacccctaaaccaaagcgtaagccacggtcaatccacaacgccactggtcaacccagc

SEQ ID NO: 615554 - DNA, 180 bp, Homo sapiens
gctcgacagggcatgtatgctgactggtggcaggagctggatgccaagggtgacgaggccgaggctgagccaaagcctgaactcgcatgagaaggggacagccacacccctcaagcttgggaagcctggtgccgatggcccacgctcaccagcctgggcagcagcaagaactatttatta

SEQ ID NO: 615555 - DNA, 128 bp, Homo sapiens
ggcacgagccacaactaaaaatggatccacatagtacctgttcttttgacgagaggatttactgaaactggataggatctccctgcatgacagtgccccagaaacttaatgaggcctggactggactg

SEQ ID NO: 615556 - DNA, 146 bp, Homo sapiens
ctgtgctctactactgcggtcctctactcctctacttactgccgttctctactgttgcctctactcctctacttctataatacttatcacagtactgtgattgtcaatcagttcctaccctgcagatattcatagtgaaaggaact

SEQ ID NO: 615557 - DNA, 133 bp, Homo sapiens
agctcgtcattacatgaaaaccaccgataaccacaataataacaagagacaagaagaatatacaaagatgactgaccagaaaacgattaacaaaataacaagagtatgtcctcacctgtcaaaaataactttg

SEQ ID NO: 615558 - DNA, 832 bp, Homo sapiens
gctagaactctacgttataagcgcggacatggctacatatatgaactgggtcatacatgtaacttacagagtagccatgtgcaatgagctagtgtgtgagtgattcttcaacacactacatactatcgtctccgagaggttgtatttcgtagccgattcgtagtaaacagaagttccatgtacaggagggtctctcgaggttccagacactggctttgtatgtcaacaagaggtgtctcctatgacggatgctgcgaatcattggggataaacctttcacctcgtggtctgtcgtggaggctgatattttattccctattatttaacaactggaagaatacacagctattcgaatcctctttattcacttgcaaggcattacaatggaaagcaatcatgtagggcaagtgactccatggcggcatcatgtgtacagcacatcagatacaatggtaaccagacgactcacacgttacatttacgtggagtgactgtaaaattacttcagcgacaaaaatgacagagcacagacactttctgtgatagaactgctggcccccaaaggtgtccagattcgaccatagctttttaacaatagcttttcaatggcctaggcgtggatggctcacacctgtaatcccagcaacttcgggaggccgaggcaggtggatcaccaagttcaagaagatgagaccatcctggttaacacggtgaaaccccgtctctactaaaaatgccaaacacacaaaaaagacacatcacaaacaaaagttctgatgacgcaacgacacaagagaaaattttcaaacaaacacgtcatgggaacaggcaa

SEQ ID NO: 615559 - DNA, 300 bp, Homo sapiens
atgcttggaaccagaagtgtttcagatttcatatttttttcatattttggaatatttgtattatacttaccgctcaaacattcctaatccaaagtccgaaatgctccaatgagcatttcttttgcatgttatgtctgtgctcaaaaattttggattttttagcatttcaaattccagatttttgaatttggtatgtgcacctatagtagtatgcttatctattcgacatatgacacagttgatcattttctccttctgctaacacttgtggttatcttgcttcaagatagcataatgccc

SEQ ID NO: 615560 - DNA, 448 bp, Homo sapiens
agcagttcaccaggccacggcccccagggcttcggtccgtggttggcacattgccgtctttcctacctgtgttttgcacagttgcagttagatggtgtttgcaattttacacctgcccgttttctctttacctttcttgtggccacgggtccacagcaccacagttgtttctagagtccaatttacggacggcgtaaaatttcatgatgctgatgatccagaacatcctccaccagtcccattattggacgtgtaaatcacatgcggcagtgcctcgttacccgcagttcactttctgcagtttgttacctgcagacagctacagtatgaaaatattaagctattctgagggagaggccacagccacatcacttctgttacagtatagtgttatgattgtatcttattattagttattgttataaatatcttattgtgcctaaaaaaa

SEQ ID NO: 615561 - DNA, 408 bp, Homo sapiens
ggacgtacactcagggaatctgattgtagtgacagatggtgttacgagaggagtctgggttccgtcagcaggctagatgtgcagaggggtgatctcagctcacggcaacctccgccatccgtggggtccaagtgattctcccgcctcagcctcccgagtagctgggattgcaggtgcccaccaccacgcccagctaattttttgtatttttagtggagacagggtttcaccatgttggtcaggctagtctcagtctcagtctcctgacctcaggcaatccgcccacctcggcctcccaaagtgcagggattataggcgtgagccatcgcaccagccccatccatctttcttgttggtgaagtagaatgtgtgtatggggaggggaggtgataggatacagtagggaga

SEQ ID NO: 615562 - DNA, 746 bp, Homo sapiens
  misc_feature (1)..(1): n is a, c, g, or t
  misc_feature (9)..(9): n is a, c, g, or t
  misc_feature (29)..(29): n is a, c, g, or t
  misc_feature (32)..(32): n is a, c, g, or t
  misc_feature (41)..(41): n is a, c, g, or t
  misc_feature (86)..(86): n is a, c, g, or t
  misc_feature (94)..(94): n is a, c, g, or t
  misc_feature (103)..(103): n is a, c, g, or t
  misc_feature (110)..(110): n is a, c, g, or t
  misc_feature (141)..(141): n is a, c, g, or t
  misc_feature (145)..(145): n is a, c, g, or t
  misc_feature (190)..(190): n is a, c, g, or t
  misc_feature (231)..(231): n is a, c, g, or t
  misc_feature (238)..(238): n is a, c, g, or t
  misc_feature (241)..(241): n is a, c, g, or t
  misc_feature (276)..(276): n is a, c, g, or t
  misc_feature (321)..(321): n is a, c, g, or t
  misc_feature (327)..(327): n is a, c, g, or t
  misc_feature (354)..(354): n is a, c, g, or t
  misc_feature (416)..(416): n is a, c, g, or t
  misc_feature (419)..(419): n is a, c, g, or t
  misc_feature (428)..(428): n is a, c, g, or t
  misc_feature (452)..(452): n is a, c, g, or t
  misc_feature (506)..(506): n is a, c, g, or t
  misc_feature (518)..(518): n is a, c, g, or t
  misc_feature (556)..(556): n is a, c, g, or t
  misc_feature (583)..(583): n is a, c, g, or t
  misc_feature (613)..(613): n is a, c, g, or t
  misc_feature (620)..(620): n is a, c, g, or t
  misc_feature (626)..(626): n is a, c, g, or t
  misc_feature (646)..(646): n is a, c, g, or t
  misc_feature (658)..(658): n is a, c, g, or t
  misc_feature (686)..(686): n is a, c, g, or t
  misc_feature (705)..(705): n is a, c, g, or t
nccattganaaatttgagaaggaggctgntgngatgggaangggctcgcttcaagtatgcctgggtcttggataaactgaaagctnagcgtgancgtggtatnaccattnatatctccttgtggaaatttgtagaccagcnagtnctatgtgagctatcattgatcgccccaggacacacgcagactttntcaaaaacatgattatcagggacattctcaggcgtgaactnttctgtnctnattgttgctgctggtgttggttgaatttgaagctngtatctcctaattaatagggcagacccgagagcatagcccttctngcttanacactgggtgtgaaacaactaattgtnggtgttaacaaaatggattccactgagccactctctatcagtccagaagagatatgaggaanttnttaaggtanttagcacttacattaagaaaattngctacaaccccgacacagtagcatttgtagccaattatcttgtttgaatggtgncaacatgtctgnatctcaagtgctaatatgccttggttcaagggatgganagtcacccgttagactggcaatgccantggaaccacgctgcttgaggctctggactncatcctnccaccnactcgtccaactgacaagcncttgcgcctgcntctccaggatgtctacaaaattggtggnattggtactgttcctgttngccgagtggagactaggtgtactcaaacccggtatggtggt

SEQ ID NO: 615563 - DNA, 1206 bp, Homo sapiens
  misc_feature (789)..(789): n is a, c, g, or t
gacgtacactcgtctacgtgacgggacacgaccacagcacgcaaaacaaactggcaatactcatgtgataacgttctttaacaacgaggtacagacgcaaccgtgctattgggacgcagacgacacgacgggagacacagcagcatcttgcctggatgagccaggggacacagaagagaagcccactatctcatttaatctttacaactctcttgcaaggttccctggtagtgaaaatacagtgagataaatcatgaaggccactatcatcctccttctgctagcacaagtttcctgggctggaccgctttcaacagagcaggcttatcttgacctttatgctagaagattgacggctcctgggataaggccagaagtacctgatgaccgcgacattcgaagccactccctaggcccagatgtagccccattccgcatgtcaactgccatcttccgacgtggatacaagtgtaactgataggcgtcctgggcaccacaacatgtgggccaacggcatcattccaccccttgacaccaaaatctggctacgcacctggcaacacaacacacaaaccatacacccagcacatcacgaagatcggacaccctttacaggaacccttgaacgaaaccattccacgccactaggaactcccttgatagacaccatatacactttcagcaaacaagttaagcgtcctgcgcaggcatttaacacccaccattctgggggaaagctggcgaaccgacctacaattgggtccaagcaaatacaaagaaaggagcatntggcaagaaacaagaatgcacccaaaaaactcatacaagaacagccgatgccacaactaaccacaaggcgatgccgcaacacgggcgaacaaggtatcgatatcaacggagcactgcgaacccacatgactgcggcaaagacccggagagcacaacaacggctgacaacagacccggctaatgccgaagtgcgcgccccccggaccagcaaaagcacccacacaaacaagaaatggaggcacacagaccccacacacatcgacaaggcatccacccgcacatagcaaaaactgcgatgccacaacgacggctaggcgaccaccgaccacgccacaccgcacacagcacaactcgaactgctcgatgacgagccgcacgcaccaagagaggaagcaaacaacaagagcggcgacgtcc

SEQ ID NO: 615564 - DNA, 370 bp, Homo sapiens
ttcgacggtgtactagaatagaaaagtgactggaagggaatttacttaaataccattagtgtttacacttgggtgtaaggattaaggaaatattcattttcttctttaatttccttttttttttttttggaaatgaagtctcactctgtccccaggctgaagtggcagggccttaatctcactggcaatctctgccccccaggttcaagcgattcccctgtcctcagccctcttgagcaactgggaccatacaggcgcaaaccaccatgcctgcctattttttggttttttaagtacgagacgggttccactgtgtgtacccaggagtgtctctcgatcctcctgtgattccatgtgactccccccgcct

SEQ ID NO: 615565 - DNA, 116 bp, Homo sapiens
  misc_feature (107)..(107): n is a, c, g, or t
tgtggtgcaatccccaaattacaatttatggagacctggaagagcagtgtctcatgggccgaggtataggtgtctccctcctgcgcttgttgttgagcggtacgagntgtcatgca

SEQ ID NO: 615566 - DNA, 119 bp, Homo sapiens
agagtatccccccggatgtctggggcttggcctctcagcagcatttgccagctgggatttaccacttgtggcgcgcatcctcctctgtgaaacatccccctgccgctctgcagcgccgt

SEQ ID NO: 615567 - DNA, 917 bp, Homo sapiens
  misc_feature (282)..(282): n is a, c, g, or t
ccgacgttgactattctctagcttatagccactaaagacattgtgaacattatacctattattcggcgacatgagactggagtcctagtgcacttattctaagcctcgcttattcgagccgagtctgggccacgatcaggcaatcttgctaaggttaacgacactactatctacatacgtatatacctgtcactagacccatgcatttgctattaatcttcttcatagatagtcatccagcatcaatctggaggcgtttggctaagttgagctagttccccntagatataatctgtgatgcgcccgtatatggctgttatcccctgtattaaaataatataagcattcatgacatcattacctctcgcatctctctcgtacatccttagcttgcctgactatcatgcttaatagctggaggccagtgagcaggggacatcatgggtgtgaggcctatgtgcttaacactcgtgcgctcttaaggcacgtgggaatctacttcgcacatcggctggaagactcctccgtgtaatactactaagtacaatctgtctaccttatcaaccctatgacaggatgtgtctctggttctattcgttaggtggccaggtctggatttccattcattatagcacatgtagtcaaatattacataagctcctcgcttgtccatatactcaccagataggcataaagcacccctctttcggtcctggatccggtcctacattgacaggtgggatccgtacattcttcctatcatcttcccgagggctctagcgtactgtggctttctaattgtacttatcttaacagaccggcgtatcgtataaaccgatcgttatttcgtacgccgccctggaggcatggtggacccgatactattcccaaaactaatctggagttttcggccaacc

SEQ ID NO: 615568 - DNA, 134 bp, Homo sapiens
ggatttgctggtgcagtacaactaggcttaatagggacatgcctcactttcttctagctgagctttaaatcattagagcttaaattgtcagatcgttcattgcctttccagggttatttagtaaagtttgttga

SEQ ID NO: 615569 - DNA, 328 bp, Homo sapiens
cgattcgagctcgttccctttttggggccttggctcttttgggattcgctcaaattcgtgtaaaaaaaattaaacccccgaacttgccatttcttatttttcgaggatttggcggtcggccttaaaaagctccggacaagatgctggagtttagccctgaaaaggagaaacttacacccccgggaaatgggcctacgccccaatttaaaccctttaacacttaaggaggaaactcccccttttttttggaaaataattaaagggttcccataagtaagccccaaaaaaacacattttggcgagcttcacggttttttcccacccactg

SEQ ID NO: 615570 - DNA, 493 bp, Homo sapiens
aacacatttactgcgggcgggggtctgagggcctgcaaacaactcgagctggagcctcggccaggaccggcgcgagaggcaggcacctggcccagtgctccagagaaaggccaggcctgcagcacccgccaccgtcgccggccgcccgcacgtccgtccgccccgtgactggctgcagtttccgctgcgtttcagctgagctgccgcacgcgcacgagccgtcaccggacgccgagacctgtttcaccctcagcgcacctggccctgcgccttcccccagcgcctgtagccaccctgagggcagatcgggagcaggtggcaattccggacacactgggctataccagggcaatagcgggactcccaggaagatgttattatttagcttaagtcaagatcataatgtgggctgctaagagtgcatttcagatgcagttcgtttttcaaacaatctttgccgcaccgagtatctgaataaaggaagaaaaataaa

SEQ ID NO: 615571 - DNA, 1089 bp, Homo sapiens
ttaggtgtgtactccgacagtgcactgtccatctcacactgcgatttcaccctgtctctagcgatcgctctgctattcagtgcatgatgtctgaccgatggacggggtattcggatatacgagcttgggcaccaactatatcggttgcgtcaaaggtgtgctataccaatacatgagtacacggtggcagagtcatcgatcaaatgaaacgacgggaaaatcgaatcctacaccccatgcttaaggggtgattccattactaactgggagcatcggatggcgcgctgcgattctgagtcgtacctggccggtccaaggaggccatggttggccaatggagaccgcagcaaggaccagtctttgcgacctgcccgagaagattggcgtagaattcggaccgtgagagatatacgatggataggcgcacagtgtcatctcaggaataatgagtacagctgtgcacgccccgggtggtggagtcgaagggatggtaagtccatatgggtggcagacggttagaggtgaccaaaggagtgcgacgtatgcaaggatgcgtgtacgtgtcccaggagggacggattagtaccctcgcattaggttgctcacagaaaggatgaaggcagactctgtcaggaaagtgcttatacttgtggggagctaaggatgcaaccagtcgacgagtctacaaaacaagtgcaccctggccctaattaacacccgtaggtcgcagtcgtctcctgacatcccaagtgcattgcccaaggggcctattcaatgggggctcgaagtgttgagtgtcgctagtatccatcgagccactagggcggggggtatctgtgtaattggccctggacctagtataggggggcctcgcgtcggggaatacagagacgtaggttcatcttaagaacctggcgaggtgggcgaaatttcagatggcggtcctatgactgaaccaatcgatggttggcctttgtgagttggggaccaccaggcggggatctcccctgggggttggtgggaggtgcgcacccgttgggggggccccttgtggggggattttgccaccccaacaaggagtttggggcc

SEQ ID NO: 615572 - DNA, 138 bp, Homo sapiens
taaacttgtcttctcaaactgttcctcagtttatgttggccaatgtagatggcctcttactaatgtaaaatgatttgtagtggaagcatttgtctttttctaattgacataatgaaaatattctgaacagactggtga

SEQ ID NO: 615573 - DNA, 935 bp, Homo sapiens
  misc_feature (571)..(571): n is a, c, g, or t
cgagcagtatgtgatgtaggagcgacgaagctcctttgaacactcgcggcgtttttccactggcaagtacttccgtgcccagaaatcgtgttgtgtccgaagacaccctcttctggggcgtcccaccaatataggctcaaccgagtctggggaacaataccccctggggttcgcgaaaaaaacctaattgttttgacaacgcgatttcatcctgcggaaggcgccctctctctccaaaaagggtttccaagacaccctgattggggaaactctcgcacctgagaagttgaagctttcaccgtcacaatttagttatccccctgcgggactccccaaggggcaagggcaatgcgggcgaaaaaaccgtttaaaaagcccgcgttgcaccgtagggagaatgaaaccccccgtggattggcttagggacttcatggggataaaccctctttgccccccccccgttgatgtggccctcatgaagtactcgcggtggactgcgggaatcacaaaaggtactatcatacgcaggggttcctcacctgaaactaatgcggcgccgggccgtataatncccccacgggtaatatatgccaaagaagtaagacagttaaaattatcctatgccccggagttttaaccccgtagagccccgacccccttgggaaaacacacggtggggccccatcactccctgcgttcccccccctcccgtgtcccaacctcgggtaaacccccgctctttgcttagataccccgacttccccgccctgtgtggccgcgtcccgctatccacctttgctttgtggcaggctgtggtgcccccagagattgttacttacatcctggggtgggcccgcacagtgtgccctctggccctcagttaccaccccccccaccccccccggggggccaaaaatgtttccccccacaagaca

SEQ ID NO: 615574 - DNA, 343 bp, Homo sapiens
  misc_feature (301)..(301): n is a, c, g, or t
  misc_feature (327)..(327): n is a, c, g, or t
  misc_feature (339)..(339): n is a, c, g, or t
ataccctgttactacaaaaaaaaaaaaatttaaaaattaaccaggtgtggtggcacacacccttctctctcttgctccttctttcgccatgtgataggcctgctcccctttagccttctgccatgattggaagcttcttgagaccctcaccagaagcagatgctgggcaccatactccctgtacagcctgcaggaaccgtgaaccaaaataaatatcttttctttattaaattacccagccttcaggtattccttaaacaggcaacacaaacgggattttacacattggctattaaaaggntaacaggcttcagggtccaagggggnaatggacttttngggc

SEQ ID NO: 615575 - DNA, 186 bp, Homo sapiens
  misc_feature (9)..(9): n is a, c, g, or t
acccacgcntccgtaagactataggtattcctcactgatatacatttcaggaattacaatacataacatacaatccacaaactttctacccactcagaatctcttactccatcatgtacttagtatttcccattaacctacacactgattttcatgctactccttgtagataccaaattcttgttt

SEQ ID NO: 615576 - DNA, 204 bp, Homo sapiens
tgtgggtgatctagaggatcccggctcccatttggttgccaggtgaggaggaggatcatctgaggcaagagtcaagatcatgctgggcaatgtggtgaaattccgtctctggtaaaatacaaaaaattaggcgggtgtagtggtgcatgcctgtaatcccagctactcaagaggctgaggcagagaattgcttgaacccggaaa

SEQ ID NO: 615577 - DNA, 648 bp, Homo sapiens
  misc_feature (58)..(58): n is a, c, g, or t
  misc_feature (62)..(62): n is a, c, g, or t
  misc_feature (66)..(66): n is a, c, g, or t
  misc_feature (75)..(75): n is a, c, g, or t
  misc_feature (80)..(80): n is a, c, g, or t
  misc_feature (90)..(90): n is a, c, g, or t
  misc_feature (149)..(149): n is a, c, g, or t
gagtatgagagtagacgtgtgtgtgtagtaaatacagggtcgaaacagcggacggagnagtngtcnagtgccctnaccancgtgccaagnattttttggtgctcaaaccaatttcctgctgaccagaatgaaatggagccacattccancacggtgcgggggctgacctcctgcaagcccagaccatggaagacactcaataaaaagtaagtgattaaatgacaacctctacggaaaagagtatggaggtctctcaaagaactaaaaacagaactaccttttggccagatgcagtggctcacacctatggggggaacatttgggaaggctgaggtggaaggatcacttgaagccagagtttgagaccagcctgtgctacacagcaagaccccgtctctacaaaaacttaaaagattagctggctgtggtggtgctcacccatagttccagctactcgggaagttgagggagtaagatcacttgagcccaggaggcccatgctggagtgaactgggattgttccactacagtccagcctgggtgacagagaaacgaaaaggaaacattacctaattgggctagaggataatattttaatttcctgggttttgaaaattcagtttgaaagagaggatatttgccgggccc

SEQ ID NO: 615578 - DNA, 339 bp, Homo sapiens
acggtctctctctgtcacctaggctacagtgcagtggtgtgatcacagctcattgcagccctgacctcccaggctcagccatccttctacctcagcctcccgagtagctggaaacaggtgcacaccaccacgcccagctaatttttttattttttgtaacaaaaagagacaggatcttgctgtgttgcccaagctggtctcaaactcctgcactcaaatgatcttcccgtcttggtcttccaaagtgccggaattacaggcctgagccactgtaccaagccagaatgtgatatatttatactagcagatattattcagcaataaaagggaatgctgata

SEQ ID NO: 615579 - DNA, 493 bp, Homo sapiens
  misc_feature (3)..(3): n is a, c, g, or t
ggnctcctcacatgtccctacaaggacaggccccaactgataaccgtcgctttttatttatggtgaacatagttggatttgatcacaggtcaaaaacgccttatattttgaaaagactccgggcccctcttccctctcccgggttccctagccgttccccttctgccccagtctgagccagtgaggggtagcttttaaaaaccattatcctagagggaggaggcactgagtgctggtaactcgggaaagaggcctacacccaggggctaggaatttaattttccctttcctcaccagggtgtcggcagtgtgtgtgtgggtgtgaatgtgtatacttgcccatcagcattaattcacagtgtctgaatttcggtgtccagacgagcccaatcaaactagtggggaagggccccagtgaccaagtgtataagcatccctggaaaagggatgggggcaggggaggcaggaggggctctccagagcccttttccat

SEQ ID NO: 615580 - DNA, 135 bp, Homo sapiens
gtctatctgggatcagtacgcgcatatgcagtcgagagtaaattatggctgaatcatccgctaccttcagcgccaactggcgcctcaagtattcttgatctgcctcttcctacacatcggacgaggccatatagt

SEQ ID NO: 615581 - DNA, 341 bp, Homo sapiens
aagaccagaatcgaagtttcctgattccatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtct

SEQ ID NO: 615582 - DNA, 549 bp, Homo sapiens
acgctgtcgtaaaagcgaccgagaaaagaccccagtacatggtggtgatgccttgctgaatcgtgcaaaccgctttagcaaaagaccccagtcttggctcctccagagctcccaaggccggctggatcttcattcacagctctatgtgttctgtactggggtggcttctccactgccttcttggctaagaggttggtccagaaagctacttctttgtccttcagcttctgggccgcctgagtgttggcaccaatctgcagatacccttccttctggttgtactctggccagtggggcagcccttccccattggggttcccattgcgagcaaagttggcccagaatttcatcagcatcttgctaaagtctgatctcctcttctgaggcaccctcttttaaaaatggggccccaaagacggagaagagctcatccccgtggtctcctatcaccgtctagggtctcatgtctgatgagaagcttggacggtactgaaactcatacatgtaggtgggtgctcccgaatttctgttggaccggggcaccaatca

SEQ ID NO: 615583 - DNA, 438 bp, Homo sapiens
atcagtggggagcagacgtttcttggtaggtgggatctctatactagtgaacaggccagttccagactttggacttagaactgtactctagattatgtgaacacagaatagtgtcaatccctaatttacttacggttacttattggaagtggggctgatgaagtacgcacaggagggaaatctactgtgtgtaggcacaggcagccccagtgtataaggagatcatatgccaaaaggttgtctagttggttgtgtgctgacctggagtgtatgttcctttagagaccaggttatccatggtggttaggcccctagagcagctggaaaagatgatcaaaccaataggttagctgacatcgaataatgtaatagtttatgctgtaatagtttatgctgtaatagtttatgctgtaatagtttatgctgtaatagtttatg

SEQ ID NO: 615584 - DNA, 330 bp, Homo sapiens
  misc_feature (17)..(17): n is a, c, g, or t
  misc_feature (61)..(61): n is a, c, g, or t
  misc_feature (79)..(79): n is a, c, g, or t
  misc_feature (253)..(253): n is a, c, g, or t
  misc_feature (255)..(255): n is a, c, g, or t
tccccttgtacatcttnatgttctttggcagtctagagaaccagaagagcaaactctatgngatagaaactctaagaanttatttacctccagcatcccttctcttctttcattaaactgaatttgtggccaactcaaagactgacaatttatactatggtttgtatgtttttatattataatttatattatggcttatgtcaaaatgttttgttcactgctttgaaagtatcttttgtttactttttttttntnttttaattttttcctttctaattgttagaaactcatgtattttatctttcaaagaaaattttttaaaaggctaaa

SEQ ID NO: 615585 - DNA, 315 bp, Homo sapiens
caacatatctactaagttataataatcaaaaaaaggtggtctagcattaggacagacacaaatggaatacaactgagattatccagtttacaaaggtttagaaataaaccttagagaccagcctggccaacatggcaaaaccccatctctactaaaaatacaaaaattagccgggcatggtggtgcatgcctgtaatcccagctactcaggaggctgaggcaagagaatcgcttgaacccaggaggcggaggttgcagtgagctgagatcatgccattgcactccagcctgggtgacagaatgagactccatctc

SEQ ID NO: 615586 - DNA, 326 bp, Homo sapiens
  misc_feature (240)..(240): n is a, c, g, or t
  misc_feature (267)..(267): n is a, c, g, or t
  misc_feature (287)..(287): n is a, c, g, or t
tggagacagggtctcactgtgttcgcccatgctggagtgcaatggtgcaatcttggctcactgcaaccgctgcctcccaggctcaagtgatcctccggcctcagtcccccaagtagctgggactacaggcacgtgccatcatgcctggctaatttgtgtatttttagtagagacatggttttgccacgttgcccaggctggactcaaactcctgagcttaagcgattctgcccagcgcanctgcccaaagtgctgggattacaggtntgagctactgcacctggctnccaatcgattttcaacaaagatgccaagaccatttacac

SEQ ID NO: 615587 - DNA, 276 bp, Homo sapiens
actatatattgtagaaggtatttcgagcggctatacctactgtacagatagccacccggactctatcttaaccagtaaaagttttctgcacagcacggttcacagaccaacgtgtgtggatacaaatataaaggccacacctataacagaccgaacctactacaaagatcctttactttgcactaatatgcactggagaaccaaagacgggagacgaatgaaagcaaagatgctacaaagaaccaaaggaaagacctgaagagctctgccaaggag

SEQ ID NO: 615588 - DNA, 100 bp, Homo sapiens
cttgacttcagcgcctcggctccagcgccatggccctccaggaggtgctccgttgggggaaactggaggaggaccgcgcgaagcgagatgtctgggggag

SEQ ID NO: 615589 - DNA, 995 bp, Homo sapiens
ggagagagagagagagagagagagagagagagagagagagagagagaaacatcgggaagaaatagccgttgtagtgtgccatatatcttcctgatatcatcaaagatctgaaggcctacaagggccagtgcgcgctacagaagggctttacaagatgccttcttggctatagagcgccaaatgtgaccactgaagaagtcatttagagagctggcacagatatgcgggggcgacccactgatggactgaacatgaacaccagaaaaagtaggctgacatgacagactgagtgctggaccacatgagcgacggcgctgcacatgcgctggcactgcacagactgacctcccacctggacctactagcacaggagccctgtctcgcactaccgcctctctgctgcggcacgcaacacacagcattccaaccaggaggtagaaccacccacaccagcaaaacacacagaaaaatccctggacaagaagacagaaagcaagcaacgggacgccacgcgcaacacacacacgggacgcccccacaaagcgggcgcacctccataagagagggagccagcgaccgcaagcaaccccctagaaaaagaaagacacacacacccagtaaagggaagcaaacacacccgtccaccttctcgaacgcaagcaccggcaaagaaagagacacggcggcaccgcaccccaacaccaagctgccaaagacgacgagcagcaccatctaaccaaaacgagagcggaggcacgatcacctacatcacgacacttacacccagaaaccataaccgagcgaacaagacacaggcatagcgccgaaccgaataggtatggagtgagacgagcggcaactcaaacaaagagatagagcagaactgaactagggcaaggtagggatgagaaatacacctccccaaaccattactacgacgtggaatggcaggccgttagtatccgcaaccacgtcactctccctagggcctacac

SEQ ID NO: 615590 - DNA, 495 bp, Homo sapiens
  misc_feature (238)..(238): n is a, c, g, or t
  misc_feature (416)..(416): n is a, c, g, or t
caatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggatttttttttntcttaagcaggtgctaattgtgtgttttattaattttgaattcagaaagtaggtcccagctacataggtggttcatactagttacatccagaaacattatgtcaggctcctcgtgtcacgctttcaagtgtacaatatggatatagaacacacatggaggttagcgcactctcctggnattttttttttaatgagaagaaatacgtggtatttaaaagtggtaaagataaatcttttaaaaacgcaccgcactaaca

SEQ ID NO: 615591 - DNA, 155 bp, Homo sapiens
tctcgtatgccttctcaatgcagctagcgatctcatcccggatagtgtcgagcaggatgtcaatgaagaagcgtgtagctctcggtggggatgttatcccttggccaggaacactttgttgtagctgccctccatcaggtatttgctcagctgct

SEQ ID NO: 615592 - DNA, 975 bp, Homo sapiens
cctggtggagggtgcctgtagtcccagctaccggggaggctgaggcaggagaattgcttgaacccaggaggcggaagtcgccgtgagctgagatcgcaccaccgcaccccatcctgggtgacagagcgagactccatctcaaaaaaaaaaaaaaaaaaggaaaaggaaaaagaaaaagaaaaatttcctctattaataaatttaatagggtttgataagaggttggtaagccagtgctctctaaaagaaattcctttagcccagttgccggggctatatgctgtgtaatccccttcgctttgggcaggctatagggtgggagaaactgcctgtgacctcgtggagattggagactagcctggggcaacccagggcaagaatctcacccctctacaaaaatttttaaaccttgtagcccaggaggcccaggccgccagtgggtctcacaccctgtaatccccagacacttggggaaggcccgaggcgggccaaaatggctggaaggtccaggaagtttggagaccaccctgggaccaacattggttgaaacccaattccttatttaacacttttacaatttagccgggccttggctgcccatacaccctgtaatcccagttactcggggagcgctgaggcaggaaaactgctttgaaccccaggaggcagcacgtttccacgcgacgctggagaccactgtgaccccaggcgttggtgcggttggtgccaccttgttgggcccatatagctaacttaaggaagcgctgaagaggtatatgaacggagagttgctctgagggcgcctggggaaaggcttgaaaggcctggtatggtgaaacccccatataattagacgccaagtggcacccccaagcccccggtggacacggtgcagggagccccctaatttcgctaagacagacagaacacagagccactacacaagaaattcttcctcctacctgtgtagcacac

SEQ ID NO: 615593 - DNA, 366 bp, Homo sapiens
  misc_feature (55)..(55): n is a, c, g, or t
ttatagccagtgaaaaggcagaagaactgagacagctgcacctctgaaatcaggnttaccagacatgtctaaaactgagacttggccgggcgcagtggctcacgcctatgatcccagcactttggaaggccgaggcaggcaaatcacctgaggtcaggagtttggcaccagcttggccaatgtggtcaaagacagacagggttctgtctctactgaaaatacaataattggctgggcatggtggcaggtgcctgcagctactttggaggctggggcaggagaatcgcttgaacctggcaggcagaggttgccgtgagccaagatcgcgccactggactgcagactaggcgaaagagtgagacttca

SEQ ID NO: 615594 - DNA, 147 bp, Homo sapiens
ttgcatatgcaaggccaagtaggggcaccatactgttgcttatcctattcttcgtcacgtgattcatctatcatcaccatacaagatatcctgcatccatgtcttgtgccttacatatctccttgtccttgccatatgcaagggaat

SEQ ID NO: 615595 - DNA, 879 bp, Homo sapiens
ggtgctgacccctgccaggccacgaatatcaggctagagacccatggccatcttggtggctgtgggcaccaggcatgggactgagcccatgtctcctcagggggatgtggaggtggggtacaatcatccatgaccaactgccggagtagtggcctacgcaggtcgtggtcacctgccagcgactgtctcagacatgggcaagggaggcttggcatgacttagagaggaagggcagtcttgggcccgctatgcgaggtcctggcaaatcgcatggctgccctgtctccatccctgtccctcaggggtagcacgctatggcaggactgcgggaactggagggtccttgcttgtcatccctgttgtgaggttccttccaggggcctggcacatgaagcaggggtgctgtggccccatgggccttcagccctgagctgatggcgaatgggactgtaggtgcatgggccaagttcctgaggtcaggtcttggtaggtgcctgcaatctgtctgccttcgtggttgactgatcctggaaatctgttctccagaatcaggccaaaaaagttcacacgtcaaagtggggcaggggtgtcttcatgctggagactccaggcctgaggtggaaatacctcaatgctgtccaggcggatgctcatgaaagcctggtagagaatggtatcttccaaagcagtgtaatgtgggtaagggtttaaccttttcttttttttttaagctgggttggctcaacaagttgtgtttaaaaaaagaaaggaaaagaaatttggggggggggcgaaaattataacatttgggggggcgaagagaaaatgattgggcaaacgggaaaagggggtccaaaaggggcagggggacaagtggtt

SEQ ID NO: 615596 - DNA, 168 bp, Homo sapiens
gttatgctagtctggactttgatcgagtgcatctgtagcctgtatatcaatggtctgcgaaccgttgacttcgagggctcgattccgcttctggaagtcttcctcttgcacttgttaagcgagtgcgtgctgtcccgccttcattaagtggagcaagttttggctttg

SEQ ID NO: 615597 - DNA, 125 bp, Homo sapiens
acgtcctgctcacagaagggacagtgacagacaaggacagcaaagggggagagagtctgtgtgtagatctccttaaagaggctcatgtgtgccgggcgcagtggctcacgcctgtaatcccagca

SEQ ID NO: 615598 - DNA, 101 bp, Homo sapiens
tgtactgagctctgatcactagtactgcgcagtgtctggacttctggctttgactgtcgaccagtgttgtttccagaaagaatcctgagttggttcttgtg

SEQ ID NO: 615599 - DNA, 1640 bp, Homo sapiens
  misc_feature (98)..(98): n is a, c, g, or t
  misc_feature (102)..(102): n is a, c, g, or t
  misc_feature (104)..(104): n is a, c, g, or t
  misc_feature (119)..(119): n is a, c, g, or t
  misc_feature (124)..(124): n is a, c, g, or t
  misc_feature (134)..(134): n is a, c, g, or t
  misc_feature (142)..(142): n is a, c, g, or t
  misc_feature (179)..(180): n is a, c, g, or t
gtccatcttcgcggtagctgggaccgccgttcagtcgccaatatgcagctctttgtccgcgcccaggagctacacaccttcgaggtgaccggccaggnaacngngtcgcccagatcaanggctnatgtagcctnactggagnggcattgccccggaagatcaagtcgtgctcctggcanngcgcgcccctggaggatgaggccactctgggccagtccggggtagaggccctgactacccttggaaagtatgccatgtgcctgcaatgcattggatgtgtacaagtccaattggtttccactgtggcccccgatgcttggaaaaagttgaggcagtggtcagcactccctaaggtgttggcacaaaagcagtgagcaaagaacagacagaacgaagaccaggtggtctggtgctacatgtctgggctgtgaattgccactgtacaaactctgtgactggctatcttgctcaaacactgatattgttggacccaacacatgttatggtggcacaaggacactggaccctgtggtggcacccctaaagttggcccaaacacattcgtttaaatggactcctctcatattgttagaagtatctttggggccttttgtctacattacacgtaaagacatcaatggcctagacttttacgattgcacatgttctaagtcaaagaacagagcatcatacaacgaatcagagaacaagtcgacgggacggagcgccgacatcatgtagcgtggacccacagcgggcgatcgacccagcgacacgcaaacaggaagagatcggtgatacatctggaacacgagtgtgggggacaccacgctggtgtgggtcacaaatccacacgatgtgggaacgacccgttgatgacacaccccacaagacagtactatgactcgtgagtaaacccaacaagcagctgggatggatccgacacagtcccagtacgaacgcaggagacacacacacgcaccagaatcgaacgtgggacagatcacacggacagcaagccaaccacacatcctcccccggacgaagatcaaggccacccagagtggaattacaacacagccacgtggagcacaattaaacatgaacacacgactcccggggaccaaccacacgcgaaccgcacaaacgcacgacaactaccgacagagcgacagacaccgagacgagcagaagaccacacagccgacgcagcacgcacgaagaaggatgcgagcctcacacgaagagcaacgctacataaagctgacaatccagacagcaagagtgagcgggaccgacgagcgaggcacaccagacgggagagggaccgagacggaggggagaagaaagacaagacgggcacgaaccacacgacatcacgcacagagcgagcagaacgcaagcgcaggacgggcgagagagacacacgcaagagagacgagggagcagacgcgacgagaacgaccgagcgtgagagctcgaaccgggggcgagagcagagaggacgacgcacaacacacccgaggatagggagacggaggacgacgagagaagacgagaggggaggagagacagaggaagacagcgacgaaaggaaggcggcgagcgcggacgcagacgacggagagagaacgacaaga

SEQ ID NO: 615600 - DNA, 186 bp, Homo sapiens
ccggttagcggggagatggcagacacactgacactccgaagtggaccacaagaaacgcaaaatccgggaggagattgagcatttcggaatcaagatctatcaattcccagactgtgactctgatgagagatgaggacttcaaattgcaggaccaagccctaaaggaaagcatcccatttgcagtaa

SEQ ID NO: 615601 - DNA, 448 bp, Homo sapiens
  misc_feature (13)..(13): n is a, c, g, or t
  misc_feature (86)..(86): n is a, c, g, or t
  misc_feature (305)..(305): n is a, c, g, or t
  misc_feature (424)..(424): n is a, c, g, or t
atcagtgtattgntattattcatggttttagaaaattctcagccattatttcttcaaatgttgcttctgcccctttatctctttcngtcagctttgtgaccaaattaaatattggtagaggtataccttgtggtattttctatgtcttctaccttcttttctgtattttgcatgtttttttttcaccatgctttggtctttttgtttcttctgtcctctcttactggtctctttctcttcagtactgtttaatctgatgttaatctattcactaatttttaaatgttaattatatttttcagttnttatgtttctatttcctttttaaaatctactgtattaattttttggccggggcatggtggctcacgcctgtaatcccagcactttgggaaggctgaggcaaggcagatcacctgagggncaggaggttccaagaccaagcctg

SEQ ID NO: 615602 - DNA, 394 bp, Homo sapiens
  misc_feature (318)..(318): n is a, c, g, or t
atacatacatacatacatacatacatacatacatacgacaggtgcagtggctcatgcctgtaatcccagcactttgggaagccaaggcgggtggatcacaaggtcaggagattgagatcatcctggctaacacggtgaaaccccgtctctactaaaaatacaaaaaattagtcggatgtggcggcggctgcctgtagtcccagctactcggtaggctgaggcaggagaatggcgtaaacacaggaggcggaacttgcagtgagccgagatcgcgccactgcactccagcctgggcgacagagcgagactccgtctcanaaaaaaaaaggaagggaaaaaaggaaaaaatttttcagaatgtttgcaacatgattctcaataaatacagtgaggt

SEQ ID NO: 615603 - DNA, 772 bp, Homo sapiens
gactgactctcttttcagactcagcccacctgcacccaggtgaaataaacagctttattgctcacacaaagcctgtttcgtggtctcttcacactgacgtgcatgaaatttgttgccatgacttggatcgggggacctccctttggagatcaatcccccatcctcctgctctttgctccgtgagaaagatccacctatgacctcaggtcctcagactgaccagcccaagaaacatctcaccaatttcaaatccgtacaagaaggcacggaatgtcaggcctctgagcccaagccaagccatcgcatcccctgtgacttgcacgtatacgcccagatggcctgaagtaactgaagaatcacaacaagaagtgaacaaggccctgcccggccttaactgatgacattccaccattgtgatttgttcctgccccaccttaactgagtgattaaccctgtgaatttccttcccctggctcaagaagctctccccactgaggcaccttggtgaccccccgatctcatgcccaacaagagaatcaatcccccttttgactgtcattttcctatcaactttacccaaactccttatacaaaacgagcctccaacccgtaattctcccccattcgctcgacttctcattataactagacctcagctcaaccctgcaacacctggttcaacattacagcagcatttacttgcttcaacaaaacaaaacaacaaactcacacaacaacacaaaacacaaacaacacaaaccacaaacaaaaa

SEQ ID NO: 615604 - DNA, 404 bp, Homo sapiens
atccccgccactgaagcctggtataggattcttaatgagggattatcacttgggtgataaaccagtgtgagagagtctgagatggagtcttgctgtgtcacccaggctggagtgcagtggcatgatctcagctcactgcaacctccaccttccccccacacctggcttcaagtgattctcctgcctcagcctcccaagtagctgacattataggcacctgccaccacgcccagctaatttttgtatttttagtagagatggggtttcaccatgttgggcaggctcgtcttgaactcctgacctcgtgatccgcccaccttagcctcccaaaatgctgagattggaggtgtgagccaccgcgcctggccagtgtgtcctttcttaattgacagtgacattatatc

SEQ ID NO: 615605 - DNA, 503 bp, Homo sapiens
tttaccgccgaaaaatgggcatgtcaacctctgtacattcccggtgttgtacgtgtctgacgtatattgtggtagttgtaaactgctgtaccagtaccgtgagcatgggtcctcagcaactctcgagcatttttatccacatagcaaatcatccaacgtgtgttgtactgactatactactccaacagtctcccgtctgtatttcatggcgccacccaatacagtcctttgtgtggatgctggcaagtgtaatccctaccccaatcaccatatagataagaaaacccactccagttgcgctgaaccacagacgggccgcgtgatgttcacacacccacattaccacagctccctggagtgccagtacggtggactacaggggtcttggtcgatctttagacgcctcacactctctcagcttggtcttcagagccacgatttctcggtcaatgccaaggaccttggcagaggcctagtgtctcaagcttctcttccaagagagt

SEQ ID NO: 615606 - DNA, 122 bp, Homo sapiens
cttgatccagattgtctgccctgggtctgaggctcccgatcacagtaggccatcaccttattgctgtcgcatttacaagtaagaataactgagtttcagagacacttgaccaaagctcaact

SEQ ID NO: 615607 - DNA, 198 bp, Homo sapiens
gtgttcagaggttccctcctccctagtagctgggattacaggtgtcactactacacccggctaaattttttgtatttttaatagagacagtgtttccccatgttggccaggtaatatgctaggcactgatgacatactcatgacgcagagctggtcccaatgctagaatgatctttgttcctgatttccaccttgcca

SEQ ID NO: 615608 - DNA, 345 bp, Homo sapiens
  misc_feature (279)..(279): n is a, c, g, or t
  misc_feature (281)..(281): n is a, c, g, or t
gatcgaccacagagtttaacctttctgttcgtagagcagttaggaaacactctgtttgtaaagtctgtaagtggatatttggatagctttgaggatttcgttggaaacgggattgtcttcatataaactctagacagaagcattcccagaagcttcattgggatgtttcaattgaagtcacagtgttgaacagtccctttcatagagcatgtttgaaacaatctttttgtagtatctggaagtggtcatttggagcgttctcaggactacggtcctgcnanatgttgggggtaccgaagctcgaaattccggtaaatcaatgggccatatacctgtttcccttgt

SEQ ID NO: 615609 - DNA, 364 bp, Homo sapiens
gatcgaccacagagtttaacctttctgttcgtagagcagttaggaaacactctgtttgtaaagtctgtaagtggatatttggatagctttgaggatttcgttggaaacgggattgtcttcatataaactctagacagaagcattcccagaagcttcattgggatgtttcaattgaagtcacagtgttgaacagtccctttcatagagcatgtttgaaacaatctttttgtagtatctggaagtggtcatttggagcgttctcaggactacggtgaaaaaggaaatatcttccaataaaagctagatagaagcaatgtcagagactttttcatgatgtatctactcagctaacagagttggtcga

SEQ ID NO: 615610 - DNA, 578 bp, Homo sapiens
  misc_feature (96)..(96): n is a, c, g, or t
  misc_feature (133)..(133): n is a, c, g, or t
  misc_feature (152)..(153): n is a, c, g, or t
  misc_feature (171)..(172): n is a, c, g, or t
  misc_feature (190)..(191): n is a, c, g, or t
  misc_feature (220)..(220): n is a, c, g, or t
  misc_feature (374)..(374): n is a, c, g, or t
  misc_feature (411)..(411): n is a, c, g, or t
  misc_feature (435)..(435): n is a, c, g, or t
  misc_feature (473)..(473): n is a, c, g, or t
  misc_feature (491)..(491): n is a, c, g, or t
ccattaagaagggtcactgcctaattgctttgtaaaatccagcaatggtattttttacccgatatagtgtaatttaccagttttcctacaaagtgnctttatattgttgcctaacctatgttatgtaagcaancggtttggaaaggcggganngagtctagatttggcganngtgtgcgtttgtgtgtgnnaatgtatgaaaagtttccccattgggtgnattcttaagatgtgtttattgtaaagttttctacgttttgcccacagtaaatgtacaacttcgtcaattgtaggatttaattgattgaattccaaattttatactgtctcttcccttctggcagagacatttatgccactgtaaggtgcatgtnacagaaaatacctctgaggttgacttgttaaataacngatgaatggttattttcacactgnatctcaaagcagtcatttgttttgcgggtttagggggnaagttttggttttttgcngggtgttttttgttggttttaaattaggcacactaagagtgggccaaatttggggggaattggtggatagggaagacctggaaagtg

SEQ ID NO: 615611 - DNA, 132 bp, Homo sapiens
  misc_feature (7)..(7): n is a, c, g, or t
  misc_feature (94)..(94): n is a, c, g, or t
ggcaagncgagacattctggcatcgtgcagtgccgtctgtgagggagctgtgcttctagctgccgggtggcatcctgtgacccttccagtgctnttctgggcctggaaggtgcacttcaggggcccggcttg

SEQ ID NO: 615612 - DNA, 768 bp, Homo sapiens
  misc_feature (9)..(9): n is a, c, g, or t
  misc_feature (454)..(454): n is a, c, g, or t
ataagcccnttttcatcagcatcttgtaagataaatataaatataattattatgtcgccgtcgtccttgtgttttcactcccgccctcctccttcacatgagaggtgttttctcttatgtggtgtgtgtataaataaaccgcatctccctcatcacacatctgctgtactacgctcgcactcttctatatattatgttgtcctcacacacaaatcaaatgtcatatcccgcttctcgcacacagcatcttatatgacaatgagatgacgtcgtgcaacgaccccttctctcttcgtccctcggctctctctcatcgatgttcagcacacaacactcggtgctcgcgcctgcgatgtgtgataatatgagacaatactctcgctccgcgctgctgtgggtgatcagcacagccctgctggtgtcgcatctcatcagctgtgttctcatcgcacanagcagtgtgtgttctctcacccagctcagtgtgtggtcccctcactcacacatctgagggcctctgtgggcgagagagtgagacaaaacaccccgctgttatacacacactgcgcgggatgtaagacattattgagccccccgctgactacactacttgtggtaaaagaattgtctgcacctaccccggagtaagattagtacgcccccaagtatgtataacggctgtggggacaagaagtaaatatatccacctatgtcccctggggagtgcgagaatcgcccgaaaaacagacccggacaatagacaagaaa

SEQ ID NO: 615613 - DNA, 564 bp, Homo sapiens
tagtgagctgtactttttgcaatgcctcctcactactccgtgaacgattggctgcttgtgtgcctgtcacatcgattcattcccccaagaaacaccaaacctgcccagtgggcatgcccatttgttcctttgggccatttctagcaaaattcatattgctactgagggtcatgttctgactgggaacccccttgcgcagggcctgatgggcaggtctgttaaagctaattggattcagtggcttccccatcgtttgtccagtcagatccggattcatcacacacacattctgctctctgtgaagcatatgtaaagatattacaagttgaggttcattagtagtctgagaacggatgagtttgctcttcgtttgtgcagcaacaagagtgccatcagacaaggaaaaacgatagatttgactgaatgccaatccttgtctcagtacttcatgatgatgcctcttagcataggacacagattctccttcatgctgcgcatggaacttctgaatacaccttcttaccaggtcctcccagcctggtttcatggggcagaagcaggaag

SEQ ID NO: 615614 - DNA, 826 bp, Homo sapiens
cacggcaatgctgccatggagatctgcttgaaatgtgctgatgagcagggcggaccttgccaagtatatctgtgaaaaacctctgttggacactgatgagatgcctgcttgacttggcttcacttagctgctgattgcgtcgacaacgtaaggatgtctgccaccaattagtgctgcgcgccatagggatgtctgtcctgggcatgtcttgtatgccaatatgcaccagaaggcatcctgatcactctgtcgtgctgctgcttgagcacttgccaaagacactatgacaccactctagagaagtgctgtgccgctgcagatcctcatgattgctatgccaaagtgtcgaatgaatttaagcctcttgcggacagagcctcagacctcgaatcaactcaacaatcgtgagctgtctgatgcagcctctggagagtaccacattcccgcatgcgctataagtctcgtacaccaagataagtaccccaagtgtcacactcccctctccggaccaggtctcgctgaacaccctacgacacagtgggcgcgcagctgtcggtcaaccattaccttgacgcaccaaagaatgccctgtcgtcagaactgcactttctatcccgggtggcctgcaccacagaactgcatgctgtcagccttcgacgacaacccgcccacaagtgcataaagctcaacccacatgtggctccaggaccccttggctgcgaacacggcgacacatggatctctccaatctcctggacattccgcggaacacatccgttcgccacacgaattcactggccgaacaattcgaccctttccatcacac

SEQ ID NO: 615615 - DNA, 344 bp, Homo sapiens
aaggctgctgaacgcatatcggctgggtgtggtggctcacgcctgtaaccccagcaccttgagagcccgagtgtgggcggatcacttgaggccaggagttcaagaccagtctagccaacatggtgaaaccctgtctctactcaaaatccaaaaattaccagaatgtgttggtgcacgtcggtaatcccagctactcaggagtctgaggtggaaggatcatgccactgcactacagcctgggtgacaaagcgagactctgtctcaaaaaaaaagcaacctgtgcattaatatagttcgcagtagctaaattccagagtaatttcctctaagttctctttgaggac

SEQ ID NO: 615616 - DNA, 463 bp, Homo sapiens
cacgaggcggggtcccgctggccagcaccagcggtttgccggtgtcggcgagcgcggcccccagcgcgtcgatcgcgcgggcctcgtcggcgatcgcgtccccgacgtcgctgaagtcgtgtgagaaggccaggtaggcgacgccgtcggtgtcgacggccgccttctgtaggacgtcgaggtcggcgatgtcgccgcgcagcggttcggcgccgagtccgctgacggttgcggccgaagcctcggagcgggccaggccgatgacgtgatgaccggcggcgagcaattctttgacgacggccgagccgattcctccgctggcgccggtgacgagtacgcgcacgagctgctccttcgagtgatgagacaatggtcccatcaccctacaccagtgacgggacaaaggtcgcatcactaaagtggggccatggctcgctgggaacccgacgcgcgcgcacgcctg

SEQ ID NO: 615617 - DNA, 126 bp, Homo sapiens
aacaatctgaaaatgcaagtcttgtacgagtttgaagctaggaatccacgggaaactgactgtggtccaggtagagaagctggaggttctggaccacagcaagcggtggtgtctggagcgtgacag

SEQ ID NO: 615618 - DNA, 704 bp, Homo sapiens
gacgattggggggggagggggggggggcaggtaggtggggctttccctaatttatcttcatgtccagtgagcagtgttgcgtttttcctgtgtagcattgggaaatgatttactgggaattacaaaacctatttttcctttaaatttcagcttgggctctggctgctttttagaataatggcaagataaaaatcacacctgagggctgaaaacggagagggaatggggagactggatatttaagcagctggaatgggtttttcttttctttatttttaaagaaatggcactggcctatgatacgggtctctccagtgaaatggattactcctccattactctatggatacaatatggtgcatgctagtggtggtatttctatacagtagctggaaatggattaacttatacggtaggtgttatgtattcctatgacaaaaaaaattaagtcttcaaattttttaaaggtttttttttttaaatttaattttccctttggggggtaaagttggtctaccaaatagtgctggtaccaaatggatcggttgggatgtggctatagtgacatgcagtatatattgggtttcacaagggggggagcaaaagaaaccccagtgttagcttaatctaaaggtcggggtcgcatggtgaattatacctatcaccgtgtggggaaccacaatatgttctctgaatgagccttg

SEQ ID NO: 615619 - DNA, 1558 bp, Homo sapiens
agcggaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggcacccacaggcttctacagcctcttctccacctaagcagagtgggatgttttcaaagtgcaacaccccagctagcagggcccctggaacagcctcggcgccccctggaacactaatggccctccctggaacagacacggcacccccaccgagaacagcctcggtgccccctggaacagcctcagcaccccctggaacactaatggccctccctggaacagacacggcacccccaccgagaacagcctcggtgccccctggaacagcctcagcaccccctggaacactaatggccctccctggaacagatacggccccccgccagaacagacatggtgcccgctggaacactaatggtcctccctggaacagcctcggtgccccctggaacactaatggccctccctggaacagacacggcgcccccccacagaatagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacgtggttcgtgtccagctctgtcaacaaggccagctccacaagaggccccagctcagccctccccagtgggctcccctactcaggctctgggtcagcttcttcccaggaggtgtcctggcccctgtgctggccccgcctcgctgcctggacacctgtccgtgccaccctggtcactgagcaggacatccgcgtctgtggcccctgggaccctgcccccgacagccaggcctgggtttgtccttttaggtagagtgcctggtccaggtcattggaggagagtccacatggccacctctggcgtgttctagagaggccctcccgcgctgggtcaggaggcagcatcgggacaggagaagggggctgagctcctgttcctctctccctcccccgaggccaagaaacattcccatccgaatgtccactgcgctcacagattcctttcctcctaaaacttcagccttggccaggctcacggccaggattatggtggctcacgcctgtaatcccagtactgtgggaggccgaggcaggaggatcacgaggtcagaagatcgagaccatcctggccaacatggtgaaactctgtctctactaaaaatacaaaaattagctggacatggtggcgggcgcctatattcccagctactggggaggctgaggcaggagaatggcttggaggcagtagaactgcttgaaccctggaggcggaggttacagttatccgaggttgtgtcattgcactccagcctggggaacagagcgagactccatctc

SEQ ID NO: 615620 - DNA, 324 bp, Homo sapiens
  misc_feature (309)..(309): n is a, c, g, or t
ttgggggctccatgcaggtgtccactcgttttctcatggaaagaataagaccacccagagtccatatggaaggaataacttacctacctttccagaagtgggtaggtagaagtgataaatgactaagtccactggcctcccactcggccttcttagcttcacgtgcccaaagctcccttactaaccaatgacagacttataagcatcctcctcttatttgccgcaaaagaaaaagaagaggtagtagctctaatctacgattataacaagaccgtcgtctggcatatctaatctgggtgagcatcagangtgatgccaccaatt

SEQ ID NO: 615621 - DNA, 515 bp, Homo sapiens
  misc_feature (11)..(11): n is a, c, g, or t
  misc_feature (432)..(432): n is a, c, g, or t
  misc_feature (448)..(448): n is a, c, g, or t
  misc_feature (495)..(495): n is a, c, g, or t
tttgctattgnaataacagtgatatcatacacatacatatatgtcccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgattccacctgcctcagctgcccaaagttctggggattacaggcatgagtcgctgcacccgaccacctttgctttttcagttaacttttgattaagggcaaaatgtatctgcagggaaaggtgcgtatcatacacacatgggtccagtggaatttgttaacaaactngtcctaaggatcgggncattattcagtggccccccagatccccacattaggggtaaccaccancttggatttttaatggtata

SEQ ID NO: 615622 - DNA, 990 bp, Homo sapiens
agcggaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagctgccatgtgactgcagctggagcagctgcctctggagaggagcggctggggctggcaggagcacagccctcttctcccgagtgaaaagagttaactgctcttagaagaacgaaaataattctccgtggtggctcttctcatgcaggcatggcaaccgtactgctttcttgttcatccattcctttgttctttcatctaataaagtttttggaagcaaaaaaacctcgtgccg

SEQ ID NO: 615623 - DNA, 1104 bp, Homo sapiens
  misc_feature (1010)..(1010): n is a, c, g, or t
  misc_feature (1071)..(1071): n is a, c, g, or t
agcggaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagacagtaccctgaggtgacctccttgagcctggagaagctgagtccgaaggcgctgagcaggcaggtcttgcgtctgcaggagcggtacggcgtaccccagcgctgtgtcccaacgcggccattcagcagcgcctggcggccctgcggcacctgtgccacaagcgggtttgttggagaagagcctgtcacaggagaactggaccgaccatgtgcagacggcagcgtccgtgccacccgaaccaacccagcggantgcctgtggggccgggtgggggctgagagtcacagagaggtgcaagcgcctgggcgaggcnggaagaggaaggcaggccccccgccccgtgcac

SEQ ID NO: 615624 - DNA, 683 bp, Homo sapiens
agcggaacgtccgggccgcatctcggcggcggcgagggctgagcgcgggagctgcctccgagccggagccccagccctaggccctgcgcgagctgccccgccctacccccgtccagcgtcctgtcgcctcctcgcccgacttcggcctgtccctctctcacgcgctcagtcctcgactcttcgcgcccaccgacagactatcggcactcggtctcccgcgcctggcgggctccgcgccgagcctctgggcccagtggccaagcggcgtgcggcacgagccggtgacgtatccacgatgaccttggaagcggcatccatgctttgcgacattcgctgagacagacgcacgacaccgccatctctggatccggcacgacacggggatcgacagcatgctgggcagcatcctcggacgtcccagagacagcacccgaaagcgcaacaatcgacgacagggaccatggacagagacactccggcatatacgcccagacaagacgccgatagacagcgcgggacaaccagcagcccccgaagccgcgcagggagccgtgagcgaaccacgcggactgggagcacaggccgaatcagaacgactgaccgccgacagcacacgttactggccggggcccgggggagcgagcaccacgaggccgaccacggcctcaccgaaccgagagcag

SEQ ID NO: 615625 - DNA, 1121 bp, Homo sapiens
agcggaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccaggtgagtcccgtggggcgctggcagctggcaccagatggcatcctgggagccctggttagggaagggagtgtaggggggcaccaggcgcgtgggaaagctctccccaggaagttttggtgtttgggtcacaactgccatgtgactgcagctggagcagctgcctctggagaggagcggctggggctggcaggagcacagccctcttctcccgagtgaaaagagttaactgctcttagaagaacgaaaataattctccgtggtggctcttctcatgcaggcatggcaaccgtactgctttcttgttcatccattcctttgttctttcatctaataaagtttttggaagcaaaaaaacctcgtgccg

SEQ ID NO: 615626 - DNA, 1262 bp, Homo sapiens
  misc_feature (56)..(56): n is a, c, g, or t
  misc_feature (144)..(144): n is a, c, g, or t
gctagcgtgccccgctgctgcggcggacagccaggagggaagtggaagtggccgtnggcgggtatgggactagctggcgtgtgccctgagacgctcagcggctatatactcgtcggtggggccggcggtcagtctgcggcacgncagaagacggtgcagtgaaggagagtgggcgtctggcggggtcccagtttcagcagagccgctgcagccatggccccactctccttcactgaaccgtcttgctgccgctgccggtagaagctgagcgacggagcgccaccgacgtagtatatagcccgctgatcggcagcaagacggtgcggagtgaggaggagagtgggtgtcgtggcttgggtccgtgagtgtcagcaagagcacgctgtcgagcccagggttcgccagatcaaaggctgggagagatgtcaatccccagcgaggggaccgtgttggagggcgggagctaggggtgtcaaggatgtaaccttggtagaatcgtcgtacatgggggccagaacgggtgtgcgtcgtgatagggacgttcgcttgcgggggctcttgagctccattggcactgttggcagccatacgaccaaggccagagcatgagtgagagccaatagcattgatgcctcttgaggtccaatggggagtcgcgaattgagtgtcttggtcgagagttcgttcattgatggctttaggggagtgagtagatgggagggcccgagaatagtagagaggcgggatgggcaacgttgggctcctggaattgatcggcactcgaaggattatgtcgacaaggagcatgagagtctatgacgtcaaattgatttttgctgcgtgtccatctcttgtggacatccgtggtcataacgaggtttgcgagtggtggtacaggaatgtgaggcagaattgctcgcgaatggtgcaacctgtgagtggtgcgaggccctcaacatgaagctgacacacccaattatcatctaacaggtctgagggcctgggcacgaataattcctcaagccgatcctatttagctgccacggccttgttttggaggcgtgcacttggaaatggtgtcaaaatcacggacgaacagacttgtggtatgcggccaagagacacgaaaaacagagccggacaatatgagaagaccacgcatataggagtacaggagggcgcctaccacagacacactccacgagaagcaaacagggtatcgaaaaagcgcgacacctacgcagcagaacaatagataatcg

SEQ ID NO: 615627 - DNA, 379 bp, Homo sapiens
  misc_feature (12)..(12): n is a, c, g, or t
  misc_feature (362)..(362): n is a, c, g, or t
gagtataactantgtataaataaatgtatagcttaattgactgaagtgtaatgaaaatgaaagtgtaattggactgtgtttagatctgtgttttccaaaacagagggaaaaccggtaacattaggctgtcagtggtctcaagagcaccattaacaaagcttgattttttaaattaattgctgttctatacagtggataagagccaattctccctgtcatggtgttcctggaactgaaactatatcccagcctcctctgtcatggtaaaaattatcatatatacatttgctcacctatgtgcctaattttaaaagcaaatattttctggctaaacttttggaggggggatgggttttctaggnccctgggaaactggagg

SEQ ID NO: 615628 - DNA, 425 bp, Homo sapiens
  misc_feature (56)..(56): n is a, c, g, or t
  misc_feature (144)..(144): n is a, c, g, or t
  misc_feature (321)..(321): n is a, c, g, or t
  misc_feature (339)..(339): n is a, c, g, or t
  misc_feature (358)..(358): n is a, c, g, or t
  misc_feature (398)..(398): n is a, c, g, or t
  misc_feature (408)..(408): n is a, c, g, or t
gctagcgtgccccgctgctgcggcggacagccaggagggaagtggaagtggccgtnggcgggtatgggactagctggcgtgtgccctgagacgctcagcggctatatactcgtcggtggggccggcggtcagtctgcggcacgncagaagacggtgcagtgaaggagagtgggcgtctggcggggtcccagtttcagcagagccgctgcagccatggccccaatcaaggtgggagatgccatccagcagtggaggtgtttgaaggggagccagggaacaaggtgaacctggcagagcttgttcaagggcaagaagggtgtnctgttttgagttcctggntgcctttcacccctggatntttccaagacacacctgccagggtttgttggagcaggctnaaggttcttnaaggccaagggattcca

SEQ ID NO: 615629 - DNA, 912 bp, Homo sapiens
gggaatgcttatgggaacagattatgaaactcaatggggccgttctggaaggagagacagatgatgggcgatactcaacaatcttcgaactctgaagcagtgatgtcttggacacatatcgggcacacgacagtgcatgggagtggtcgcagcgagcagcagatcatgcgacctgcttagaatgtaaacttgcgaaatctgagcacgagataacagggttagaacaaactgtgataaggttaggagagtcataggtatcacgttacaaagaatcagactggctgaccaatgcagaataccctagaagatgacatcttaaggcagagaagagggggaaactccatggagagctccgctcgtgtcattggataaagagcagaggagctcgaggtgagcaacggccagttagtgaagcgtctggaacagatgaaagcaagtcggagtgcactctggtcccatgcagtataattccgagctctgatcaggcaccctggttgggtgcagctggacgagccttgttttcgtgtggctttatctctgtcctgtgtgggagcggctgtgtcttcccctggcttccgtgagacgaagaccgtggcgagcttggcgcttaggggctcccgtgccatggctcaccccaggagccccagcgggccaccaggtgcctctgtctgcagagccctggccgggctggcgccgacgctcagaactgcaggtacttcataagcacaccagggcctcgagggagctctgtgtctgaccgcacagagctctgaatgccgctggagtgatgatcaaggtaaagattcacgtgggacctgggggtattttggccagtgtctggggaagataagggaggttcgggggcccttgggggaccactgggcagcgaaatctaaccgtttaaaaatgacg

SEQ ID NO: 615630 - DNA, 875 bp, Homo sapiens
  misc_feature (34)..(34): n is a, c, g, or t
  misc_feature (38)..(38): n is a, c, g, or t
gacttataagagctccttgtgcggcgccattttnagcntctcggtctgtggcagcagcgttggcccggccccgggagcggagagcgaggggaggcggagacggaggaaggtctgaggagcagcttcagtccccgaccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgcagacattagatgagggcatgcagatcccatctacacagtgcgatgctgctcatcccactaatgtccagcgtatggctgaaccatcacagatgctgaaacattgcagttgtaaacttgattcactatcaagatgatgcagaaattgccacaagtgcaatccctgaactggccaaaactgctaaatgacgaggacacggtggtaggtcaatacagggcgcagacaatggctccatcaccattacaaaaaagggaagctcccacaccaggcaacaatgcacgaaccccacagcaagggcactgccacgaagtcccctgcggcatacac

SEQ ID NO: 615631 - DNA, 183 bp, Homo sapiens
ccctgactagctctgacagtcccgactagccctgacagcactgactagccctgacaacccctgactagccctgacagcccctgactagccctgacagccccgactagccctgacagcccccgactacgcccgacagccccgactagccctgacagcccgatcaatgaccgtaaataatgcttg

SEQ ID NO: 615632 - DNA, 1013 bp, Homo sapiens
  misc_feature (815)..(815): n is a, c, g, or t
tggacgctgtgtgtgtacttgctgacgtgccgccgtgatgcgcaggaacaccggtccacctggcaagtctgactactctctctactatcatgcaactattggaatgattatctcgaaaaaggtacatagtgggagtagaccggggggttcaacgcagatgaccgaccatacaggatgtcactgcacttgaagatgtgtctgtattgatgagacttcaaaacaggcatgctatacgctctgccatgcaggaagccgagcctgtgaaagagcacaaccgattcttctggcaggaagaggtgatgaactccatattgcggggtggaatctgaggcatcagtgtactgcaaagaacgtaactcactgaagatcgattgaatctgattgctggccagaaaaggttgcagaccgcttccacgctgagttccagccaatgcacccatgctctaggtgctctgtggctatccataaggacgggtgttgggacctagcacagtagatcgtttgatataagctatagcgtgatcgaacaagtgaacaatctccgaggggcccgatagaaatccttagagatgcatgtgcaggtgatcgaagatggcaaaaaacttggcgaagcgctggaaggcaacgctgtggaagatgctcatggatctcccccgttctactgtgcgcctgtcattcaggaggtgtcgagagtgtgtgatctacatcgtgagtgctagatatggggaagaactactgagttgttgtttctggtggggtccgtatgatagtgaggttaggatggcgaatgagttaccaaggtgggtttgaaggcncatttatatgaaggggtagaagaaaaggtgtttgggggaggattagtgcaatgggaaaggaggggtagaaaaagacagtcgtgggtacgtgggcgtgtccacttttgggttgtcgttgtgtaaaaattaagggaggtgtaaaggaagtttaaagggggtgaaaacgcggtatagtagttctatatttatgttttgaag

SEQ ID NO: 615633 - DNA, 356 bp, Homo sapiens
  misc_feature (239)..(239): n is a, c, g, or t
aggattagaatagaaaagtaatactgcaatgctttgaaagatacaaatatttacttattgcttgaaacttagagttagattgactgcccttcctttctttccttccatgtttacctcttaacatatacacagtatgtagaagagaatagtataaacccacttttctcaaccgagtttacaacagtcagatcttgctttcatacatattccccgacagttcctagtatatctctttaacncgttaaattagttcaactatgtatatcttaacagacttaacacaaacaggtcaaacatgcagtaccacatatcacagcaaaatgacataattcctttaatactttcaacacatcagg

SEQ ID NO: 615634 - DNA, 218 bp, Homo sapiens
tgacgtgggttgggcatatgctctgtcatcacacagcagaagcatgggggcatggtcagagccccccccaacactgacacagtcagactcagcacacgccatggtgctgaatagccaaagccggcactacacaccacacagttggcgaccaaacctgaggctgtgaagatgcatcatctgcctattagtggctgtaaagagagtgatgaagattattt

SEQ ID NO: 615635 - DNA, 384 bp, Homo sapiens
gggagaatctgcatctgtaaagaatcttggaggtcacagtggctcatgcctatgatcccagccctgtgcgaggtggaggcggctggatcacctgaggtcaggaatttgagaccagtctggccaacatggtgaaagcccgtctctactaaaaatacaaaaattagccaggcgtggtggcgggcacctgtaatcccagctactcgggaggctgaggctggagaatcgtttgaacccaggaggcgaagtttgcactgagccaaagccatgccactgcacttcagcctgggcgacagagtgagacactgtctcacaaacacaaaacaaacaaacaaaagacatggttaagacttcaggctctgaagtcagaggcctaaattaacagcc

SEQ ID NO: 615636 - DNA, 310 bp, Homo sapiens
  misc_feature (110)..(111): n is a, c, g, or t
cccaaaaagttgtttgttttgtttttggaagtttgctaaaaaaccaaaaaagggaaaaaattttttgttttttttgagatttgaagcgggaaaacctgatagggggggcnncttccgttttttcccccaaaaaaaattgtgaggcaaaattttttttttcctgggccaaaaaaaaaaaaaaaaaaaaaaattttttcaaaatttcctttgtcaaaaaaaaatttgtttttcaaaaatttccccccccgttcatggttaaaaattttttggggcaataaaaaaacccctccggaaaataaaaaataagata

SEQ ID NO: 615637 - DNA, 120 bp, Homo sapiens
gtcagctgggagagctagactaagttggtcatgatgcagaagcatacatcaaatgcagtcggcattgtcaatgctcttgcaatcatccaggttctgggatcatcagttccaaggttttct

SEQ ID NO: 615638 - DNA, 786 bp, Homo sapiens
  misc_feature (584)..(584): n is a, c, g, or t
gatggagaaacatttcaagaatgggatggcggtggctcgtttcctggagaccaatccccgggtagaaaaggttgtttatcctgggctaccctctcaccctcagcatgagctggccaaacgccagtgctcgggctgcccagggatggtcagtttctacatcaagggtgctctgcagcatgctaaggccttcctcaaaaatctaaagctgtttactctggcagagagcctgggaggatatgagagtctggctgagcttccagcaatcatgacccatgcctctgtgcctgagaaggacagagctaccctcgggatcaatgacacactgatacgactttctgtgggcctagaggatgaacaggaccttcttgaagacctggatcgagctttgaaggcagcgcacccttaaaagttcgagtcaaagctgtcattccagtgctgccatcaggagcagcatccaaggggccaaatcttcggaataactggacagatcattacggagcatacgcagaactgcactgaatattttaaggccctaatgagtttacagctgtaaccttccatggatcttcccttaagaactgtcntctgtttatcttctaactaacaggttgttctgttagtatcatttcggtaattttgctatatttgtgtccaaggaagtaagagttgttctgttttgggatcatgttgtcttttttctttcttcagtagcttatgatatattttaatcatgtttacaatgttacaatttagtattgatgttttatgaagttaaattattaaatg

SEQ ID NO: 615639 - DNA, 263 bp, Homo sapiens
tgtcttaaagcttaaagcacttttaaatgttactgttttttaataaacatgaatctggcgggtacggtggctcatgcctgtaatcctagcactttgggaggctgaggtgggcaggtaacgaggtcccaggagatggagaccgtcctagctaacacggtgaaaccccatctctactaaaaatgcaaaaagaaattagccgggtatggcggtgtgtgcccgtagtcccagctactcgggaggctgaggcaggagagtggcgtgaa

SEQ ID NO: 615640 - DNA, 424 bp, Homo sapiens
ccaacaccacgagagcaacgttgtctctgaagtacccatgcctgtgtgggtaggagcagcttttggggtaacctctgccttgccgctgctgttcctagtgacctcagccagcagggtgtgtggtgtgtccttccaactcacatactcgatccttcctcgactctttcgctaatggcaagctttggggcgcagactgtgagggtgtgtacgcgcggcacaaaggtctgcactcagtggtacatgcgggttgcccagcagggttcacacacgggtttaccattagaccttggtgtgtgtctgtttgtctgtctgcctgccagtgtgctactactttcccagatgtgtacaacttccatgctctgcccagagcacctcatgtacagattgcagcccattcagtcaccttcaataaaggaagcaatgc

SEQ ID NO: 615641 - DNA, 206 bp, Homo sapiens
tcctcctcctccctgcttccttcttcctcctcccttgcctcctctcccacagtatcacaccacactggatctcgatgagcagccttcctctgacaatgctcagttttggatcctcctttaacaagtacaacttttcctttcaaacaagtacaaccacccatgcagtctggtccggcgcagtgaccaggttggcgcttctccaaagc

SEQ ID NO: 615642 - DNA, 1130 bp, Homo sapiens
  misc_feature (341)..(341): n is a, c, g, or t
  misc_feature (356)..(356): n is a, c, g, or t
  misc_feature (391)..(391): n is a, c, g, or t
  misc_feature (619)..(619): n is a, c, g, or t
  misc_feature (693)..(693): n is a, c, g, or t
aactaattacacatagtgagtgacacatggtctgatcctgccttaacgggtgacattccgatccacgactacgcaagatgaatgatggccattgccctgacctataacttgatagaccattaccgtcgttgaaattcacttctacctgtgctcaatccctgtgcatcaaaaaagctccatacacgtgaaggcagcctttggtgaacccaccaggcccgagcgcacctcgagagagagcgaaccccgttctgtgactgtaagtaatcgcatcaagacatacctgagataatccttgattaaccaaatactctccagccgctcgaatcgtccacttatctgcnttgagcgtcctcctntcatgtgaggacttcgagatcccatccctagtcgnacctctggtggtggactccacaacagtctatgtgattttgtctgcgactatctaatagcctcctggtgttgcgattgggtgttactttcgatcagcggatagcgtcgtagcttggaacaggatggaggtaacaacgagggtccccgcctagccaaaccctaattcctcaagagatataatttaaggcaaggttatcggggattagccttgaaaggacctcaggtggtntctcaatcataaattcgcttaagagtacatagtgcgttgactgcgtcagaaagctacgcgtggtgcgctacaangagacaggctcctaacgctttgttccttttgagcccatcgccccaagagggctagcttagtgacgttggcacagggccgtagaaagtccaaaattgaaggcctcctagcgcaaaagacttcatttggcagtggtcactagagcagtttgtccccacgagaaaagtccttggacttgaagtgctacgactccggaaaaagaatcgaccagcctttagagaccgaatgtgggacccacatgtgacctataacagggttgggggatccatgacacaggagacattcgccaaaccagggaaactccgtctttgtccattataccaactcaaggacacccccccggtctagacactctcacataatatctcacacgggcgcgatctcgtattcacaaccagcgcactagttgttctgttcacacacaacggagagcgcgctt

SEQ ID NO: 615643 - DNA, 186 bp, Homo sapiens
ctgctccgcccctctctgagacagaatagggaagggacttgcacctggcagacaggacagataatgaacatactagcgagcctaacacatgtgggcatattcttttccataccttcttgcctgttgtaacaagctaaccccagccacagcagcagagagaggtcgcatcctaacttagctgaccag

SEQ ID NO: 615644 - DNA, 617 bp, Homo sapiens
tgcgggtgatctagaggatcccttctcttctttctttctttcctttctctctcctccttcctttctctattcctttcttcctctctttctttcttccttcctttctctcttccttcctctctcccttcctttctctctcccttcctttctctcttccttccttccctctctctctttcttcctttctttcattcgtttttgaaacaggatctagctctgttgtccaggctggagtggacatagttcactgcagcctccaactcttgggctcaagcaatcttcctgcctcagcctcctttgcagctgaggaccatcgttgcaacgatggtcctcagctattcaggaggctgaggcaggaggctatcagatagttggaaatgtggctgggcgcggtgactcacgcctgtaatcccagcactttgggaggccaaggagggtagatcatttgagatcaggagtttgagaccagcctgacaaacatggtgaaacctcgtctctactaaaaacacaaaaaaattagctgggcatggtggtgccttctcctgaggcaggagaatcgcttgaacccaggaggtggaggccgcagtaagctgagatcgcgccactgcactccagcc

SEQ ID NO: 615645 - DNA, 1175 bp, Homo sapiens
  misc_feature (964)..(964): n is a, c, g, or t
  misc_feature (992)..(992): n is a, c, g, or t
  misc_feature (1118)..(1118): n is a, c, g, or t
  misc_feature (1120)..(1121): n is a, c, g, or t
tctttactcgctcggcttggttgtttgttctccctctggcttgccttcccttgtcattgttgtggtgttttttgtagatgttatcttccgtgccctccttggtttcctcgcctgatctctggctcggattctctgttcgggtgtccgtatctccgtgtaggtttctggctcgtcctcgcatgtcctggatggcctttccccattgcctgatgttcttggggagcgtaccagcctccgctggtatgtggcatgtttagctctaatttttgactcatatcgtggggtatcagattggtggtcccttcaagcttgttcctgtgagcagaacgcatttggtaactaatcattcagaaccagttctacccgtcttacttggtaatgtttacatttgtacgctggatagctactcaagtactttcgggtgcttcaagccatacctccaatcagttgtatctgcgtgctcttcaaatcacaccagtaggctttgactgtttcgtttccgccccgcaattgtactgtgtgaatacggcatagtgccaaacatcttacgtacacccaagagaactgagtgcagtattaaaggggtggtagtagctgctgatttatgatgagaagtcatcggtcagaaaatcagcttggattggtgcacaagctgttttattgggtaacagccctgggatgttttacgtagcttgaggcaagtctggatggtggcaagaaagtccttggggaagctgctggtctgggtgctgctggcctccaagctaggcatgtgggaagggctatgtgagaccacacatggcggtagccccaagcagcagcaccctgcaagccagcactggccagcatgctcagaccagctctgcagagccgcagccgctgtgggcagggggtgtggcaggagctcccagcactggagacccagcggactcaacccagttaccgtcaccatggggcctgtttntgagcaaggtctcgaaagcgcaggccgncctggctgagcagcaccgccctttcccagctgcactcgccctgtggacagccccgacacaccactttcctgagctgtcgctcactcagattgtccgtttgctatgccgaatgcagccaaaattccntnntacaatttgtgatgcctaccgattaatctgatcctgttttaagtttcaacgcgg

SEQ ID NO: 615646 - DNA, 348 bp, Homo sapiens
actaccgtgcgccatcatcaatatcccgggccagaggggtgcatgggttaccaggcaacgaccctacatgacacatcatgatcacccaaaactgggtggtatcggaatccacaggggacaggtgagaacagcgaagacttaaggaggggcaggtgaccacccaaagttacagtagcaaattagggatggacagaatggagccgtgatgctctctccacagtgccacactccttcctctcacaacgatgccctctttcctgcaatagcttaagtacacccagattcatcgatatgttcataggtgttcctgagacgcaccaacggacgcgagaacttctaccaaaactg

SEQ ID NO: 615647 - DNA, 807 bp, Homo sapiens
  misc_feature (422)..(422): n is a, c, g, or t
  misc_feature (424)..(428): n is a, c, g, or t
  misc_feature (430)..(430): n is a, c, g, or t
  misc_feature (432)..(432): n is a, c, g, or t
  misc_feature (435)..(436): n is a, c, g, or t
  misc_feature (440)..(441): n is a, c, g, or t
  misc_feature (450)..(450): n is a, c, g, or t
  misc_feature (460)..(460): n is a, c, g, or t
  misc_feature (463)..(466): n is a, c, g, or t
  misc_feature (473)..(473): n is a, c, g, or t
  misc_feature (475)..(475): n is a, c, g, or t
  misc_feature (485)..(485): n is a, c, g, or t
  misc_feature (488)..(488): n is a, c, g, or t
  misc_feature (492)..(492): n is a, c, g, or t
  misc_feature (525)..(525): n is a, c, g, or t
  misc_feature (535)..(535): n is a, c, g, or t
  misc_feature (537)..(537): n is a, c, g, or t
  misc_feature (547)..(547): n is a, c, g, or t
  misc_feature (551)..(551): n is a, c, g, or t
  misc_feature (555)..(555): n is a, c, g, or t
  misc_feature (557)..(558): n is a, c, g, or t
  misc_feature (587)..(587): n is a, c, g, or t
  misc_feature (589)..(589): n is a, c, g, or t
  misc_feature (677)..(677): n is a, c, g, or t
  misc_feature (724)..(724): n is a, c, g, or t
  misc_feature (774)..(774): n is a, c, g, or t
gtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgancnnnnncncnacnngccnnctttcatcncacaccacanatnnnnaccatcncngcccctcccngcncctncccaccctccacccacagcctcacgggtccacnacttggcgtntntttacatgtncctnccgngnnttctttcgctggaaagagggacaggggcncncacccgtcaccacgccccaacactccccccgaaccagagccgtgcacttgtgcctggtaggagagagacaggacagacgcgcttttcncgagacaaggacccccatgtcacggcagcttcacagacgcggctcgngccaccggggtcctggcgggtgggacccgcggcctccacgcggcgcaggncagcctgccaccctctgggcctcgtacatgtgc

SEQ ID NO: 615648 - DNA, 440 bp, Homo sapiens
tgctcctgtccggcaatggccacctgattttctctgcttcaatgcttccaactctatggatgattgtcatctgttgttgtagttgtcgatgttgttgttgttttgagatggagtttcactcttgttgcccaggctggagtgcaattgtgggatttcagctcccccccaacctttgccttccaggttaaaagccattctcctgtctcagcctcccgagtagctgggattacagacatgtgccaccacgcacggctaattctgtatttttagtagagacggggtttctccacatgggtcaggctggtctcaaactcccaacctcaggtgatccacccgcctccgtctcaaagtgctgagattacaggcatgagccactgtgcccggccgattgtcatctttatattatctcattaaaaattatcattaaagttgaaatgtga

SEQ ID NO: 615649 - DNA, 1848 bp, Homo sapiens
  misc_feature (1847)..(1848): n is a, c, g, or t
gagcagcgatctaagcgaagtgtgtacggagctggggaccaatgaggactcgtggactgacatgtcctgtgcggtgcgtgtataggtggagtatcagccgcatgtatgcgcgacacgcactgcggatgcactcccgagaggactagctcgtgccatgatctctactaacgtgagccggttacagagtacacgtagtgtttccaaggaatcactctcgtcaactcttaggcatcctttgcaatgtaaggcagctcaccaatgagtgttcaactagcgtgacacccagcatggagtctagagggaggagaggcagatgagatatgtcgtagagaagagcatcgactgcggcgcgcactcagtgcgctctcaacatcgtggcagatatcaaacgggtggtgaacgtcccgaactgcacgcgagactgtgtggtccgaagatagcgtgcccatggacaggtttgtcccgcatactcgctcgtacgtgccccactgtggggcctagcggcgctcgagaccaagtaacacacgcccttcaccaaactgggcgtccctttccccctagggaagtttgaaacgcgcattcgctaggaaaacgatcccgttgcgaagctaattcagcatgccccccacttacaggagcgcgggcacgtagtggcggccccgaattgccctagtcctccactttgcgagagggtgtctaggaggaggggtctcggggtagctccgacctcgctgtctcgatccatggaacccattgtgaggcccttccggggtaaccatacagatttccaaccggtagagccggtcctgcgaacgaagagcgaaaaagggtccctcgttcgaatctggaggatcgaggcaaatccctgaagaaaagccatcggggcttcaatgtcctgggtggacgttgtttcacggtcgggactaggggtgtggcccgtggttcccaaggcagggccgttaccaacccatcttatggagggtaacccccctgttggaatggcgcattgttgggcatggggcgccgggagaccccccccagggcgctcaagtctcaccccggggtgtggcgacccacctggcggacgaaccgcaatggtttgttccgacacacgtgtgggcttatcccccggtggggcgcatggtgggcgccggttccacattcgaacgggccttcccgtgcgtgttgggcgccagcggtcacccacgtggttgtggccctggaccccttcttggtgcccccttgttccgtggggggcaccttgtggagcgcgcctttggagggggttgcactggggttgcttggggtcctagccaatgccatcatttctggttctaccgaagagattctgcccgggataggccccgatgggaaccgtttccctgggagttgcattagcccgaaccgccagggcttcctgggggcggccttgaaaaagccaggcggggttcgccagctcagcaccggtaccaagcggccagacacggttccgggcacagggaacccgctcgggagaggccggcgcgcccccagatagaggtcccgtgatccaccgagtggagggggagcgacggcggaagacacaccccgagggggtgtaagcaaggagcacgcgtcaccccgctatgaagaacgacaggccgcggaagtaagccccaacacggcgtggctgacagaggaaggggggcaccccacacacgaaacgatgatagattggatagagagacaaacaacgagaggacgtgacagagtgataaacgatcgatgggaggcgcaccgacgggagtctactgaccaacgcagcgagcgcagcgcacttaatgagacacagacgacgagcagaacgnn

SEQ ID NO: 615650 - DNA, 435 bp, Homo sapiens
gcgaatattgtgcgtagtcaccggggtcagcagtggatacgtgccttgagcttcggcaaagtctgtggcttcgatagccaggtagtgatgcccatgtagtcaggaaatccctgaagtcatgcattccacgtgatgggagaagtcgactcactgtccttactggatgcagagattgtcctggtggcagttacatgtatactttggcaaatggccattaccgcagacgccaatgcagcaacagttacaatggatgaagccatgtctgagaaggagtgatactgcaacttctatgggagcctccccagagttcgtgatatggaggcgctcactgacgattgcgggacaagatagcgcggtaagccggcccgactgtacatagtatagctttaccaaaatacaacagctgaggctgaacttaaagaggtaccctgatgg

SEQ ID NO: 615651 - DNA, 891 bp, Homo sapiens
cgcgcgactcggcctgttttgggtggcagaccccccgtttatggcgacaacgatggtggcgccgctcgccccgtgtgtggctgtcaaccagccgccggggtatagatatccgcgggagtgtcagccgtttatatggagcgggacaacttcgggcaccagtcgaaattgtggggaggcccaagagcgccatttgcaagcctcggcaaggaaatttgcacgacaacattggtagtagattatattccgccgctgcagaagattggcagtaacgtgggagacccacaattacaaggactgcccccctttggggcctccctttttcggagaaaccatctccacaaaatacggcattggagagccaaaaacccgttgggtatttagagctggcaagttttagcatacaatctgtcttcaaaccatctggggcattgttctgctggaacgtgaataacagttttggttaccacccgacactattctggaccacaacacgctattttccctcccacaagatggcccgcgtgctatcagcgcgatgttgtcgctggagaagacatcactcgtctgacaaactcgcttgtcttggggtatcattctcttcaaggggcccccccttattggtggcaccaacagacactcaatacagaacgcctgttgtgctgcaacgaattcatcattttcacgcgagggtctgcacgtgtcattcacctcgtcttttctttatggcccacgactaggggccgggacgctcctggtcggagttgccggccgacgctgccgtcctttcgctattggctcattgtcccgtttgccccgacggggagtgttgtcaccgagggcgttgacattatgctgttaggggaaagatagcttgttcccccccacaaaaca

SEQ ID NO: 615652 - DNA, 133 bp, Homo sapiens
gctgagcatcttgcatcaagacgattgatcctccaaaaacaagaagggggttctgccctagcacgccaccaacgtcatgaggtcctggctcttccagcacatcggggtaagagcaggggcccgcttttgtgtt

SEQ ID NO: 615653 - DNA, 1390 bp, Homo sapiens
  misc_feature (650)..(650): n is a, c, g, or t
gagccggcttggaggtgtgagaggtttactcagctctaggtgagattcttcaagcactcactatgtcaacgggaaacgggatgtgacccattactcttcatattggacggaagatggcgagggatcaaatactgcgagtctacgatacaagctaatagaggcaccactttgcggtcatcccgatatggcaagtaggcggtgttatcgcaagcaactctagttggcatatgtgcgtatgatcatgaaaggctgcatagagcaagggcgaaaatgactcacataatgtcgctattgccatcgtggatctcacgattgcagttgtgggcaagctcgcaaaaggtcgtataaagttgggttagtggagccaattggaacttggttggggtatatggggcgcataatctcgcatagagattatcggaggatatctctgtggggagaaaattactccatagagcgctctaacgcagaaggaaaggaagaagtagcgatgttctttagtgcgatcatatagctatggaaggggacgcgtgtggcttattcagtctataggcatgtgatcttgtaagtctaagtttcacaaagggtttatgctgtggtttgattgggtttgggtagaggcttaaaactttagaatatgggttgagttnaggtgctttctaagagtagaggtgagagcaatggaggccactgtatgtaggacacattagtttggcggctttcgcgttttttcaatttgccacagtgggcgttgtggactgttttatagagctttgggggtatgaatcccggggaaaggtttagccttaaagcttgaaacatataggcgtattttaccctaaaattgtaaagcgggtccaactttctaaaagggagcacggttacaagagggttattaaatcttttgagaaaaccatttggttctaacgccgtgaaaaagttggcaagcttatggtattaggggtggttagcggcaaacatttggtcgcgcaatcattttcgttcttcaagagaatttttgttaagaagggaatggtaaatgtgttggaggttttactttaaatggaagcagtgaaactatggggtcccaaaatgccttgtgacatgggttaaggcttccgcacgttgggttgtcggccttgtgcgaacgacaatgtggttccagcgaaatagttgtatcgggagttcggttctggcactttgaggaaaggtgccttcatttttggcgcccaaggtgtctgaatttcacacaccttgttttggtccattggcgctgtgtgtatctgggggagacccttgtggcgtaggacatcctggcgttagcgaaagcttgcgttggtacccaaccaaatggttggccttgggcaattctctcaagcttgtgttacag

SEQ ID NO: 615654 - DNA, 830 bp, Homo sapiens
agagaaaaaaaaaaattcaagggtgttaccaaggcagcctcagaaagagccgggtggcccagggggtccttcgttgtctggtgtggctggcaggaggccaaggagtgcgagtagacgtggtctcactggcctaggggttggtgggctcacatcctgccctgcagggagaggggggcccgtcgtccaaccctctctgaaaaactgcagtagactgttgaccattccagggccccaacctaaatggttcttgtcgctatccttgcccgcctgacgatgtctgtgccgcggcacccttgtgcataagttgaaagatggcatgaagctggagcaataaccccacttcctggatttccctgaaatatggagcccagaagcagcaggtgacagggagcttcccttaaccctgggggtgggtgggcacacagaccacctcctggtcctgtcccctgcaggtagtattcacagtgtggatgtaacctgggaggagggaggaaggagctgagatgaaggagattcaggtaaacagtagccacaggggccaggacccccttcctgaggatcccggtccttcctcgcagcaggtgcttagtcctctcctagggagaagcacggaacgattcctacaggcctcagtcccatgtctaagggatacctaggtaacgaaatggtcctttgagtggtactcagatactatactcctcttcctcctccccctgcgtactctgggctgtcaatttagctctcgggccaaagaaatactcatcaaggagctggtcccaagaagcctgatacggacggtcatgtgcaacattagcccaagtcttatctgg

SEQ ID NO: 615655 - DNA, 274 bp, Homo sapiens
tagaggatctcacggacggcattcacccaggagctacgccggtgctccgaggcgtcgtggccacccccaggtagccagaggggccctggtgcaaacatttaatcctgggctgtgcgggccgaggccgttgcttttccttccgggctctacagtggcatcaatatggagaggtcattccgggcactgcgcgcggattcgaatcccgatgtggattgttagcctgcagacatcccacgcataagagcctaggccagaccgcccgctccgtcgaagg

SEQ ID NO: 615656 - DNA, 313 bp, Homo sapiens
ataattgcatggaaacacactacacatagaatacgttcactgtatgggtaacactcctattaacaattatccctaaagaaatcaagtgcaatgctcaacctagtgaccctgaataagatgttatcttctcccatagcagatgctaattcctgatcacaacatactggtacacaaaatgctatcatttactaattctctataatctgtgaccaataaaaggatatgctttccaaggtctatttaaagtatcagacactccaggtatacctcaaacacagatttcaagaaaggagatcgctgtcgtaactagggg

SEQ ID NO: 615657 - DNA, 123 bp, Homo sapiens
tcgttgccttctgcttccagcgtatggtgcgacacattgctcagctactttataacagatcagtgctccctgagtgccactataggcgctatggaagatgcgcgatacgcaaatctggttggc

SEQ ID NO: 615658 - DNA, 421 bp, Homo sapiens
aactaggtgactgaagtgactcaatcctgccgatgtgcctaggtaattgcaagcccgcgctgccacgtctgatctggttcgcggtttttcctggtcgttaattgaaaaaccctggcttggacgaccctttctccagctcctaaccgcgagtgatccgccagcctcggcctcccgaggtgccgggattgcagatggagtctcgttcactcagtgctcagtggtgtccaggctggagtgcagcggcgtgatctcggctcgctacaaccacctcccagccgcctgccttggcctcccaaagagccgagattgcagcctctgcccggccgccaccccgtctgggaagtgaggagcgtctctgcttggccacccatcgtctgggatgtggggagcccctctgcctggctgcccagtctggagggtg

SEQ ID NO: 615659 - DNA, 1153 bp, Homo sapiens
  misc_feature (461)..(461): n is a, c, g, or t
ggcccgagaaggagccgcccaagccagagcaggtcgagtgccggggcgctctaccatgttccggggacattgcccatgcaacatgcgaggccaactgtacctccctggggtccagcattgcaggacctccccaccaatgtgaaggaccatggtgcagctaggccctgagcgcctaggtgggaggacctccaggccacgtattccagtcatccagctccttccaggacctgtccagtcaggcattctggcccagatgccgtgatgcgtgtcgccagtgtcccgtcgaggccctggaccacatggtggaattattgtggcccagaacatcgcctgtacagcgtagagctcgtgggaccctttgcccctggatatctagtgagaagagctcgccggtaggagaatgaagtagggggagaaggagaggactcaggcggagcgcgcgcgatcgtcctagtaatctngcaagctggtagctcgtggaggatctctgcaatcctcgggggcgtcgatgttctaatactttatgtgtcgaaagctcagctctcaatcccaggactcttcgtgtgcttgtccatcttgggaagcgtaatggctcttcattaaccgggacatcaacccaggattgacctcattcttctcaggcctctcgtgaagtcttgcgagagaagcctgattctgagtacctacatcctaattctgcatcagtatagagcagtagagtggtccagaataaagaagtatcttgaccagggaaaaagggtaacatgccgcctggcaggaaacttatttttttcccattgttcacagtatcgatggaaaatattcaagcccagggctgcgggatgggctcaacgagcctgctaagtccccaggcacacttttggggaaggggcaggaatggcacgggacgccggcgaaagcaaccaggaagaggatccaaaggggtcggtttcagcaaggacacccaacgacccagagggggcgacaaccaatgagcggttgaaaaaacacccccgggtccttctttaaggttaacatcaaacgtcaccacgacacacgaacaactacactggagacgccccgacgagcacaatggggtaagcgccacggggagggtgcacatggagagaatccacccaccgttaagggaacg

SEQ ID NO: 615660 - DNA, 320 bp, Homo sapiens
ggtcgacgataatttatgcatttcacaataagtctaaaaacctaattcattttaaaagattgaaagttagaatggctgggtgtggtggctcacgcccataatcccagcatttgggaggccaaggtggcagaatcacctgaagtctggagttccagaccagcctggccaaaatggtgaaaccctgtctctactaaaaatacaaaacttagcccggtgtggtggcaggtgcctgtaatcccagctacttgggagtctggagcaggagaattgcttggacctgggaggcagaggttgcagtgagctgagactgtgggccactg

SEQ ID NO: 615661 - DNA, 322 bp, Homo sapiens
  misc_feature (73)..(73): n is a, c, g, or t
  misc_feature (220)..(220): n is a, c, g, or t
  misc_feature (284)..(284): n is a, c, g, or t
  misc_feature (294)..(294): n is a, c, g, or t
gcaaatataagttgtcttacattaagctggtggacattaaagagatttgcaataacgtaaagcaaaataatantttacatagttaaatgaacgtgtctataaaataaacctgttagccaagagatggtagaaattagtgcatttttaggctaggatgtatttatattccaaaggaagaataataattatactatgtaaaatcaagtttaataataaaggntttttgttgttgttgtgttttttgtttttttttttgagacagcctgggcaacagagcaaggctnccatctcggnaaaaaagggaattcccctttggcagata

SEQ ID NO: 615662 - DNA, 1509 bp, Homo sapiens
  misc_feature (258)..(258): n is a, c, g, or t
  misc_feature (474)..(474): n is a, c, g, or t
  misc_feature (577)..(577): n is a, c, g, or t
  misc_feature (583)..(583): n is a, c, g, or t
  misc_feature (1200)..(1200): n is a, c, g, or t
cccagtatccgagtccatctagcacacagcacaacatgtctgctcgtccttgcatgtaaccatcttgttcctcgtgcagggcctgtccccttctttgcattctccctctgcatgagtgcatggcagggccatgtgttagagattcacgccaccatattaccatcatcagcccgacttgtcacaccaggcgaagcacgcatggaacacagtctctcaacccttagttacctggatcacaagtatgacgtctcacttgangagggcgtaggggtccgaggggaatgagtcgaagtcacttccagtaaacgcaattgtccacgcggatagtaaatctcgcatatggtgagcagtctgtcggaagtgggctgctacaagtcaaagtggacaaagaagcgtgccaagaagtttctccccatggcctgtactgtgttagagggtccacacaagggaaatcactatcaaactgcgcggagnagaatacatgcgcgagacacaccagagttctaatcactgcgccactagaggggccgtgtggtacaataagtgtttgagccctaaactcagttggtaactctgnaagccnagcgttcgtcccaatacattgtccacacgaaaaactgcctacgcaagccaatgtaagcgcgcctatggcaacttcccccaaattgagaggggcaccgcggatgtggtttcccgccctcgaaataggtggggttcttaggaaggcccaaaacattcaaaccgacgccaacactttattctttacccttaccttacagtataaggggtaggttccgggtgtccaccgaataaataacacgccgttaatatgtcccttatttctgccatttattgcacttaagtcgccccacaaccgttggttatgcactgtttcggcaatggccatcattgcaccaatgtggtttaactcccaaaaagactccgttcccacgggcggggcttcaggtaccatgggcgcgcaggggtacgcctcccttttgaccaatggtggtgtacaagccctgtgtggggcaaaacgcccatgcggtcgggggaatgggccagcgccattgagaggggcggcgcagggggacagagcaacaacttgtaggcgggaagaaaaggagggaacgacccaccgagagaccatatccccgaagggtccaaaggccgctgaaaacgtcatggtcgcacacttanaggaggagcgaggcccattggttattgttaggaaaccccctgtggcgtgtccacaagggcgtatgggttttgccaaaccttccaatcaatttagcagggccttaccaatagctccccccaccccatagtgtccaagggtattcaacttcactattgagagagaaaagtatcgccccacattgtttccctccggtgtttgaagacacaccattctcattgtgcccaccgacacgagaagtgtggggattttccgcgcctgtgtgacattactcctattgtgacatcatccaactttgtactctccgcatt

SEQ ID NO: 615663 - DNA, 491 bp, Homo sapiens
ccgcgttgattagtgtgtactgggaaaacctggcggcgatacacagccacgacacacagtcgtgaccttggacatgtctctgaatgtccttgagtgccccagccagcagcctggacttgaacccaatctaacatctctggcacagacctgacaatagctgtgcagtgacgctccccatccaccctgccttgagaggatgtgcagagaaaactttacacgactattctccaaatacaggtgtgccaagcttgtagtgtcatacccaaaaagactccaggctgtaatcactgccaaagatgcttcagcaaagtactgagtaaagggtctgaatacttatgcatatgtgatatttccagttttttttcttcatcattatggggtattgtgtgtggcttgatgacgaaaaaatataatttaatcaattttagaatacacctgtaacataaccaaatgtggaaaaagtcaatgggtctgaacaccttccgaatatc

SEQ ID NO: 615664 - DNA, 110 bp, Homo sapiens
gggggccccttttttctttttaaaaggggggggggaccctcccccccaaaattttttgccccatttttcccgggggttttttgggaaaaaaaaaaaaattccccccagga

SEQ ID NO: 615665 - DNA, 134 bp, Homo sapiens
ctcgtgtacccatgttgataaaaacacggcagtgaacaattgtcagaaaatgaatgagcttcatcaactattgagaaaattgactcagttcctgtgctgaaagtacatgagtgaccactgtactgagaatgtgt

SEQ ID NO: 615666 - DNA, 164 bp, Homo sapiens
gtggaggatactatttgcctttaacttctgctttcctgaaatttaccactgcctttaaatactctagcttgtagagtcatcatggagattggagtctcaagacatgcagctgcccatattctcactcaccaatgaccctgacaaatagttaattcctaccacgg

SEQ ID NO: 615667 - DNA, 1315 bp, Homo sapiens
  misc_feature (384)..(384): n is a, c, g, or t
tgcctcgggcaggatgttctgtagcaccctagtccttacgcgactgatggctaatctgtacaaggtgtgatcatggcatcacttggttgactccaaatcttgcatcgcgtccatttcgctagcttgaccgttgctgacttcactgttgcataacgactaccctcacaggagatagtcgcacatcaggtatctacacaaattctcgatctgttatcactccattctcccaatacactctgcgtgtgtacaaaatccagaccgaagactatcgagtcacatagtaaatccagctgtgtggattatatgctaatgggctagtgtaggatcctaactactagcgtgtataaccttgatgccacccaatgagctaagagtataatggcnctgtacagttcatcatagtgaggtacgtccactcattgagacaacagttttggaattaaacatgccaattagcttcaacatggtggttaatttgagcaatgtgtacctagaaggatcttttgggaaggtccttctattaaactgttgaactctacttgatttgaaaaggtatagaaagaattaagtagctgcttgggctttcgttacctaaacaaataagtgtgatagctcaaatgtttgttccatgatctggcatgaaccaggcaatcccctagagtaggttgttggcttagcgtgcatactatgaaatgcttcttggcctaccatctcgatgtatatataagctcacaatccctttggatttccggccattttaagtctcttttagcgctccaggaaagatgccacataggacgaaagcgagataatggttaagtcgtattgagaagacgtgttgggacagccactgcgtgtgtgacttgtactttgcactgtcgtagaattaattattttgtcctggataatatattgtacctaggagcagcttgtataggtaggtcagcttactcttttttgcgcttgtgcacatatatcggttaagggttctcataggggtccaagaataagatacttgtccgagtggacattgtggatctaacgagaagacttcaggtggttaaagtacaaattggagctgggttcgactggctacgatcgattcgcataaatcggtgtgatggacgccacttacccggacatacagaataagtttttaacaagaacgcgaccaatgcggtggcgagacggccggctaagcaaagttccctgcagctcgtaacaatggaagttggtgaaatttgtgccaggcatagttagtcgacacttaacttgatcaacgtcaacgccagtagtttttccacaccgggcggaa

SEQ ID NO: 615668 - DNA, 1572 bp, Homo sapiens
  misc_feature (247)..(247): n is a, c, g, or t
tccctgacccccagttgcctgcaggctggggaaaattcttgctgaaacactgtgactaatccacttgggattcccttgctggtaactctgggcccatagatttgggagaccagtgtggctaatctttctgggggagagctggcacccccagtgtttggggctggtggctgggtggagcaccttcctgggtggtttttttcttctcttccatggtcggctctctgtgtgtttagagatgcgcccaccnctctggtggcacatctctttacgtgtcaccacaagtgtgtacaccttataacagagactcacatatggactctctgatggtgtatactctgagtcttatacaaagactctgtgagagagagagagtcatcacagacagcgtgtgtgagagcgagactatatcactgccgcgctgagacacaacactcacgcggacactatatatctcacaaagagacactctctgtgtgtcacactcccaagtgtgtccgagacgctgtgtcaccacagcgtgagtgagggtatctcctctgtgtgtgtgcttctctcataatgtgagtatttctccccctctgtgatgttatacacagttatatcatcaacactactacacaccaccgtagaggagtagtagtagttgcgcacactaaaacactatattataatacccgccccatacttcatcattgatgaggcacaactaatgtgttgaggtaggactcctcagtggagccccctgtggaaaactctcatctcttctcgggaaaccatattcttcctccgggagtagagaaaacaaactctcaatatcggcaagtctccccaaaaagaaacctactctgctgtgcggccacaaatacaatcgctcccttatataaaaaaacacccgccccgagtcttccgcgttgctctccgacggagtgttggatgggttgtctcacaagatctttgtggcggcccaactttctgcacaaagcggatttatctgcggaacgcggaaatctcctcgttgatatctccgcaaaaaccaaacaagcgtgggagcaagtggatacaaacctgcctcgtgttgtccgttaaacacagcacgaggggagcgttgacgcccctgcgacaagaggagtgcccccccctccacagacaatccgttgggcaacaccagccgcccctcataaactcctcttgcctactcaagttaagcacacttttaatattccaaaacagaagaagtaactcaccacgtgcgcactaggctacaataagcgggtgaggagaaacaacatctcctttaaacacccatctttttctcaaaacaacagggtgtgactctcattaaccacggtgtggaccataaacacgaataatgtgaggccccgctttgtgctacaattagccaatatttggacgcccccatatacttgtcagtagaacaaccttttggggtgagtagcgtctcacccaaagggccacttttacccacaccatctgtcccccaaataaatgtgggaacaactgatgtaaaacccctttgtgtatttgatcactcaccatgataaaaaaccgtgg

SEQ ID NO: 615669 - DNA, 732 bp, Homo sapiens
gcttgaccagcaccattggcggtaggcaagaacaaggcgccgtttacgagtagggcggcatagaacacgggagccaagaagagagtggttgatctcgatttttctacagaaagattggtatgatgtgaacagcgtgctgcttatgttcaaatataagaccatattggacatgggactgctcgtcaccagggacccagggaaccaaaattggatctgatggtctcaagggtcgtgtgttagaagtgagtcttgttgatttgcagaatggatgtaaattgcgatttagaacaattcaagtgtgatttagtgaagatgtgttcagggtatgataagatgttgattaacttctcgatggcatggtgtcttactcgcgtgtacaaaatgtgtgcgctatggttctaaaatgtggtagaatgatgatgtgaagctcgacagttcgaatgctcgaacgacatacacgaatgtgttgagctctggctgtacgatgcttgtgtctcgtggtgggggtttctgagctaaatagagacacggccacaacaactcgagactatcggagagacgctcttagtgcctcaggaagcgcatacaggctctcgccacacactcacggaagtaaggatgatgggcagcactcactgacgctcggagaggtgcttagacaaaaatgactttgaaaataaggttggtgcaataatgttggagttctcagaacaacaattgtaaaatgatctt

SEQ ID NO: 615670 - DNA, 127 bp, Homo sapiens
ccaaatataaccatacacttagagacttatctcttatactatatcctctatcattcttattgccacgactacctcctcggactcctggccgctattttacagcaaccccgtgatcgtggggttgtaa

SEQ ID NO: 615671 - DNA, 220 bp, Homo sapiens
ttcacagtgcttctactcccagcaaccaccccctcttctgaactgcctttagaaaatgaaaagtagaaccttttctgaaaagagagggcagcgccttagaaaaacacacaatacattggcactgtgctcagtgtgaaacgttgccacatggacctagtgccacaagacaccataaggcctatgctggctctttaggaactggtctaccctgctgggcccc

SEQ ID NO: 615672 - DNA, 897 bp, Homo sapiens
agcgggtccgggtcgcgcaggcgggggcggtgcagctgggcggaggcggccgtgggccgccatggagcagaatgtcactgatggactgagggcggcacgccccatggttccaccgactagcctgggtctaccagaatcttcctgacgcctgggcccggcctgacgttgctggccgcgcgggcatggtgtgaaccgcaatgtgcatggccgatgtcgccgggaacggaagttcactgtgtgacggcgagcgagttctaccagcttacataccgaggtggcccagcgatggtgccccgacaatccgcaagactgtgccagtgtctctggtacgtagggagttccatgcgggcatgtattgagcactggtgcccatgtcgttggagggtgcatgacgcgctgcggggaacacgagcagaccaaggtcctgcgaccatcagcgttctcccattccgggataccaggtatcgcgtccgtgctccaaggactgaactgtgaaggatctgggagcaaacgaggcttgacgcagtcgtcggctgactgcaccgagcggcggcgacaatgctgtaccgtactaacgtggaggctacacccaagatcgtcccaggttcaacgaaggaacgacgtcgactacttgcttggcctcgaggcggatggtaccatggtggccagcacaactccgtcaatccgtgcggatcatttggctgtcattcagccctagaactccattcgaccgctgctggtccacgcgtgcgggaaagaaaggccctatgaacgtgtcttggctcgttgggtcaccgaggaccagccttaatctcggggaaacctgaagccgaaatccagagatatcagcatcctgcatcgaggctgtggctcacccagtgcctccaggatgtggag

SEQ ID NO: 615673 - DNA, 677 bp, Homo sapiens
  misc_feature (162)..(162): n is a, c, g, or t
gtgctgttttcttttaaaaaaaaaaaaaaaaaattcattttcttggggtaagagctagagagaaggccccaaggcttctatgggtttcttctaattctaatggctaaaaggtatggagtattgtcacttacccggggcttctggtaccactggtggtcaatnaacaatggcggtagtactggtttacctaaattaacctcatgggtctgttgtgcaccggcatcattggaggtaaacatctccatcataatggctttctccaatctttggtcaacaaccgctcaaaatttttggggcgccatatttgtgtaatgtgccagttgttgaccacttaacgcattttgtgtctcacaccaaggcctttggaataaccttaataccgtgtgacacaaccacacggggtgtttaaagatactcctcgtgatccgtgaactccttgggcaagtcagacacctccttttagagactcctgcgggtgggcctccaaattcttatataagaacgtgggagggattgaacttattttcacagatggtccaaggacttggtttgcaagatattttagggatggacgtgtattggtacaatactaccggcggatagccatataggtatttgtaggtcattgaagacttcaaggggggaaactaagacctattttgtggacaaaaagatgc

SEQ ID NO: 615674 - DNA, 112 bp, Homo sapiens
catagtatagtccttaccactgtcttctcttactgttttcttatataaaagccgttacctctctcatcttttctattcccaggtgacaatataggagattacgatccattcc

SEQ ID NO: 615675 - DNA, 578 bp, Homo sapiens
cagtctggatagtataacaaacattggcagaagcgttctgtgagtttagtacgcactaacgatgtaagcacctgccgttatcatgaccattctcagtctacttttttaagctaccgtatcttaaattattgaaaatttattaatcgctgaatatataataacctttgcttgtatgtaaccgaaaatggtttaagagccaacatttagagtatgacaatggagctgaacagtttttaatgcgcaagaggttctgtccttgtgtataactggtaaccttaatttactgtgtaaagatggttacattatatcctaagcttggttggtgggagacaatagagaatgcttgttaggtatgtcaaaaaaatcttatctttgtagattttggtcaagtgtattatacgagctatatttttcatttgccagaaagacagctttgtataaccgctttgggaagtttctgctctgtaaatgtctttagagctgacagtctgtaaggtttgtttttctcttcatgctagagtgtcagtgggtggttttgtgcactggtccaaaattcacaggtcttaaatgtttggggg

SEQ ID NO: 615676 - DNA, 246 bp, Homo sapiens
tactctacaggatcgtgcatgtacgggtcactctatttgtacttgaggagcaggcctgtcccgacatcaggcgcagaagctgcacttctccgacgcccctttgcagatgcagccctgggcacacttggccacagcccacagtgcagcaggagcagcagctcttcttgcaggaggtgcatttgcactctttgcacttgccggacctggcgcaggtgcgggagacaccaggggcacaggagcagttgg

SEQ ID NO: 615677 - DNA, 673 bp, Homo sapiens
tgttggtttagtgtgccacaatattatgggtttaatttcagataattaagagtgaggtctttgtaaaaattgaagggtttttcttttttttctctctctcttttaaaaaatttattaaatatttatttctttttttagagatggggtctcgctgtgttgaccaggctggtctcaaactcctggcctctagcaatcctcctgtctcagcctctcaaagtgctgggatttcaggcatgagctaccacgcccagccaggtttttcttttttaaaccttcatctaaaatgtccaatttctggagttgtttgtatctttatggtcaaataaattaacttgcaaataataggtaggattaaaataggactgaacagtagcactcatctaacttattataatatccacaatcaatttttatgggttttttttagtatgataacaggttattttataatgagtgctgggagacttctgcagtttaaaaaataagctcccgtaaagtacgggaggtcaaaaaaagccttttattcatacataactttcttttttcacatagatttcagttatttgtaactgatattggttaccatttctgatcttcatttttatcatccaaggtacggacatccgtattggaaggtcttctgccattctgtttttccaagaatgagttcggc

SEQ ID NO: 615678 - DNA, 264 bp, Homo sapiens
ctggcgaggcagtctcagtgaagaggaggacagcgaggaaactgtggcagacaggcagagaagcaagcaggaggagagctgggactcttaaaggtctggacttttcccagaagcatcgtgcttggggggtgcacaggcagaaatgccccgggaaaggtcgcctgggtgagctgcagatggacagaggccagggtactgtgggtggcaggactgaggacacaattagtgagaaacaggcaggaggaagagactgcctcgccaaat

SEQ ID NO: 615679 - DNA, 105 bp, Homo sapiens
ctcccgagtagtgactcaggcatgaggatggtgaagtgaaaagaaaatcctgactccagaggggactattaatttaattccaggtgtaaaattacaaaaaaaaaa

SEQ ID NO: 615680 - DNA, 379 bp, Homo sapiens
tgatcctcgtcctgtattaacctagcgctgcatgaagaggatgagtgaaaatatgtcaggaaaagaggtagatgtcttgtccagacctatttacctcatcagacaaaggtttttgtattataatctgtttccttgaaaattgatttgactcctgctcttaaacacagagtagttgttccgtaatttccagaggaactggccgtcatctataacaaggttgcattttacttttgcatccagtttttatagtttgccacaaccaagccacccttcacagataaaatatgatgctggcatggcaatcagaccaaagcactgtccccaattgttgtcttaactatgactagacatgttatacagccatttatcttgtacaact

SEQ ID NO: 615681 - DNA, 129 bp, Homo sapiens
  misc_feature (46)..(46): n is a, c, g, or t
  misc_feature (53)..(53): n is a, c, g, or t
  misc_feature (101)..(101): n is a, c, g, or t
atctctcccaacttcagcttcatgggccagctgctgcagtttgagncccaggngctggctccgactgttcgggcagaggctggggagccccgcatggctgngctcgaccgagcacctccaccaccaccg

SEQ ID NO: 615682 - DNA, 837 bp, Homo sapiens
tattcttgaacctgcaaaatataggatggggtactaactgccgacatattagtgggccggttcattgaagcaatagattcccaaagaagggtaaaatgttcttgctgggagaaagggggtctgatgcgtgaacagcttgcagatcacattaactcagatagggacaggccctctatgtcttagctggtccaagtaggggaataccgagccagagtgttagttcaaagcttcttctctatccaggcaaaggagctaggaatgtaagtgttctgaaagaacggtcaatgtagtgcgagtctacaccatgcctgggaggagtagatgactcgctttgagttatgacagtgtgcttgttgatcttcgacataatgtatagctcgcacggagttgcgactcgcgtaggccatcggccacagatagaaaacatgcatgatatgaggactatccttaatgtcctatggacaacctaacattgtgtatcttataggtgagatgattgattggagagccacagttttctaacaaagtatcttatgaccgctatctccttgtagatgtgagataaaaattgctaacttctgtataacgtaaacgcaggttcaagttgtacatatgtaaagataatattgcctgattacgccggttgaaataaaagtatgttaaatggaagggagtgtgtatttatttttcacgttagaagacatgaagaaattttaagaagataaacatcgatattgtgaaccatgcagcgtgaaaagataaagtttgatgttcaatatataggcagaaaaaaatgttgtgtcaaaatgatgaatgtaacatcaggaggaaacgtgg

SEQ ID NO: 615683 - DNA, 136 bp, Homo sapiens
tcccgattaagcatgtgtgagctccgttctgaaggcttgggcaaaagtgtctctatcacagtagctctaaggggctcctcagacagccccagcaggtaatccatggagagaagctgggactgcctggtgttggcca

SEQ ID NO: 615684 - DNA, 489 bp, Homo sapiens
  misc_feature (158)..(158): n is a, c, g, or t
cacgactcgtagatcgagatatgtctcggactgtggtcagctcaagaacattgaaggagctgctggagatgacattgcgctgcagtcctgccgtcaaagtgtagccaaggcgccagccaccgtagatggccacgttgctgggggacagcagctcaggnaagtcacagtgatcaaaggaagccagcaggaggcacttggcagcctgcttgtacttcctggcggccagctctgccaagcctgcggcacacttgagcttgttgaggatggcctgggtctggctgtcacgctctcctcgctcggcaatctctggggtggactcagccttgctgaacgtagctgagcacatgagaccaattctgcaagtagacgctgaccttgatgacattgaggcacatgtcgatgacgtgttgggcgctggtgcagtagtcccgggcccgggaatagcacttgagggcgttgctgacgtccccacagtcctggtagtggtcg

SEQ ID NO: 615685 - DNA, 951 bp, Homo sapiens
tcgttagtggtcttaggcattgtctgctggtgccgtattagtgatactggtataagtgctgggtttcgtatgtttttgttattgtcgctgtcctttaagcgcggcctggtcggcaggtgaagtttgccaccttatcatcattgcgtgatgctcttttgggcgtcgacgcatcaaggttgttcccatcctttcgtgtgaatgggagatattaaagtggtgtgtcgcagaccataccagtggttgaagtgagtaaaaataggtataatccagttgaggcagaatatgtatcgggggatatagaccactgagtttccgcaggggccctgcctcgcctaagacagcctagagaggacggcaatgaagaagataaagtaaatcgaggagattgagacccaaggtcagcagccacctgcaacgtcggtaccgccgcaacttcaattaccgacgcagacgccgcagaagatccctaaaccacaagatggcataagagacatttaagcagtccgatccaccagctgagaattcgtccgctcccgaggctgagcagggcggggctgactacatgcctggtcttaccatctgctagcctatcatcccggtttgtagtcatccaacaagtagaaatatgaaattccagcaataagagaaggggaacaaaagattggaggctgaagacctaagagtgcttgcttatcttgcccgttgaccagatgaatagaagctgattcttgcattaatcgtagtgcatgcatggggttctcggtgagttattgtctgtacctaaagaagtcttctttgttggtaataaacaaacgtgttttggtattcaaagcctggtttctctcaatacgccggttaaaggtttttaaattgtttcatatctggatcaagttgaggattattaagaacttcatttttaattggtaattaagattccaccttgactttttt

SEQ ID NO: 615686 - DNA, 112 bp, Homo sapiens
gtgaagtagaaaatagaaatgccagtaaacaacataatgtttaatttacaacttacattaggggtttggggggaatgctgaatggatgatgatggagcatgatgacattgag

SEQ ID NO: 615687 - DNA, 317 bp, Homo sapiens
tctcatacctcaccagcagaccaaagatgacctcgtgtcagactagtgggctgatgcagcggtagagcagcatgcatcgaggcctgagggtgcagggcgcccatactcttggcctggaggaatagctcctaactagagtaaagtttccacgagggtcccaggcagagcatgcagagctgggaaccggaggctccaacagtccttgccttgtccataggaacctacctatcagagcacctttctaacagactggacttgcccagctccgtagttagttggccaatctaggttacctggtagctatactggcccaggtt

SEQ ID NO: 615688 - DNA, 506 bp, Homo sapiens
  misc_feature (18)..(18): n is a, c, g, or t
  misc_feature (66)..(66): n is a, c, g, or t
  misc_feature (503)..(503): n is a, c, g, or t
  misc_feature (505)..(505): n is a, c, g, or t
aaacaaggtttctcaaancagcactgttgacatgatctggatcatcttttctaaaggtctgggcantgtagggtgtatgggagcacccggcctctacccactaaaggccagaagcatccgtcagtcataacaatcaaaagtacctcccagacattgtcaaatgttaagtgcgccttccccaggctggggtgaaatcactcccatttgaaaaccacttcccaggtgaggcacagtggctcacactcgtaattacagcactttgggagggcaaggcaggtgtttcacctgaggtcaggagttcaagaccagcctggtcaacatggtgaaaccccatccctactaaaaacacaaaaattagccaggcatggtggtgcatgactgtcatctcagctactcaagaggttgaggcaggagaattgcttgaacctgggaggcagaggttgcagtgagctgagatcgcgccactacactccagcctgggtgacagagtgagactccatttnant

SEQ ID NO: 615689 - DNA, 751 bp, Homo sapiens
ggtgcaatttcccgggctctccgcgcggtccggtggaatggtcagtgccgtaatggcgtacttggcgtccggaccctacctgataccatcagctaagaaagtgtgttgcggctttataagcgggcgctacgccagctcgaatcgtggtgcgtccagatagaccatattaccgaatcctatgccttgctctgtaactgatgagtcccgtgcttagaaatgcataacactacacgagggtgaatacacggactaagtcggcagagaaggcgcagcccagctgtctgaaggaggccgatgaacaggttctggttaccgatcagcattcacagccgtacatcttacctctgaactctaccgtggcgtggacaaccctcactaaatgtagggagaatcatctgacttagcgttacaaccagggctacccccattgaaattgggcttgctttcacgaatgggaacctcgggcaattcccgtaatcgtggaagcataggggcataactgataatacctttgactttcaccactttttgcccaaccaggaagagagcgatcactatcgctggtcacacgcaaaaaccattggcgcgttgcaacgccggggggacaccgtccctgggggcgaaaccggaggtaggagactatgcgaggcacgagggcttcgccttcgaaatgcggtggttaccgttgctagccctttgtggttggttgcccttcctgaccccttgggaatagccgtctagggtctgaaca

SEQ ID NO: 615690 - DNA, 497 bp, Homo sapiens
gggtattcaattctagctgcgattctttagcagcagtgtttgactctagtgatgcttcctctgtattagagaagtcttgtaaataggccttgcatataatgatctaaacttgagggggggaaacaagggttgtttgattttcctggttccgcttcgggatttcacagattttcggagaaagaagtgtcttgtttgtccatcttgcatatgggggaaagtccgagcacaagcaattcaagtgtaagcctcggacttttaaagtacgcttgataatttattgcaagagtaaatattatctgtgttgacaattgtgattttaaaaacccctttccgatgccttctctgttttgatccagacacctgtataaaaactctggattgttttatatagagctgcataatcagtgtttgtaaatgtaaaaaaaaaaataccaaggtgctttgtttttaaagaacattgtgatgtaaagttgtatcaaataaaactcattgcaaca

SEQ ID NO: 615691 - DNA, 628 bp, Homo sapiens
gaccagtagtgggcatggagaaagatgtgctcctgtgggcccagacagggcgactgacatgtgctcaaatgccccaagtgcgacaagaactgtgtacttctgccgagagggtgagctccctgggtgaaggactggcacaatggttctgcctcaatgtgctgagctgctgcagcaagactgctggactgccctgttgtggtgccatcgccgagcatgactgggaagccgttctgccacaatgcctgtgctacgccaccctgttcggacccaaaggctgtgaacatctggggtgcgcgtggctcctacatctacgagaagcccctggctggagggtggccgcaggtcaccggtgccccatctgagggtcccctgctgggccctgagcaagaggagcgggaatgtgcgagctggaccacctcgaaggtgggcccatgcatgaagcctccatgttgtcacacagctattccacgcggggatgcccaagacactgtgccacagcgggctgacaagcaaatgaacggttgtacctatcagctagaggaagggtgacgatcatcatgaggcaaaggatatggcacgcggaacctgacatgcgctgcaaagcgcaagaggaagaaacatgagacaa

SEQ ID NO: 615692 - DNA, 349 bp, Homo sapiens
acgagtgcgtgtcgctgttgaagtcagaggagacacctggttgctccaggtgtagcccagatgccttgagggggcctccgacgctgcttcaccaccttctgatgtcatcatatgtggcaggttatctagacggcgggtcaggtccacccactgacacgttggcagtgggggaccacgggaaggccatgccaagtggagctatcccagttccagcgtcagggcatgacactttgccccaacagcgccttggccaggcgcccagtagaggcagggatgatgttctggagagccccgcggcatcacgcccgttaccggagggccatccacaaggtcttcctgggggttgggc

SEQ ID NO: 615693 - DNA, 390 bp, Homo sapiens
tccccaacccacttagtgttacaaaaagaggcagaagctgatcagagaggaggttgggggaatttggccgtatgctcagaggcattggtagctaagtgactttttcccagacaggctggtctcctgtaagagagagagagaactgacagattatgcgagagaatgcgtccgccaccatcaaggtcagaagcctgcccctactctcattatgtgttgctagccaacacactccttcagtttgtttccagctgatcatctttctgtcttctgcattcccagttcgtaatctgcactctcttctctctccacgggccccagagcagatgggtcacttcttttggtttcaaatacaatttagtggccatcttccctcccatctttttcattaaa

SEQ ID NO: 615694 - DNA, 989 bp, Homo sapiens
  misc_feature (377)..(377): n is a, c, g, or t
gctcgtgtgtgtgtggacacaccttgtgagctccgtcgcacgccgcgatcttctcatgtcggcgcgacccccaacttgtgtgggcgcccgcgtgtgcgccccgccgtggggtgtgtttcccccctctgtgaagatggtgcgcccggcccactgtgtgttcccccccgcccccccccccgcggggggttccttactcccgcctggtgcccccccctcgtgaggggaccattttccgctcccgcggtgccattagacgagttccattgtgaacggcagtccgcacagtttttagaagcgtcgtcggaagtggcttgccgaatcctcctagtcccctctgcgtggcttactcaaaccacggggttttctccctcctcccnctgctggcatcaccccggcggccttcattggggggtcacacatcaaacggtacatttttctcccagtggtcccgcgcaaccggtctcacgcccccttcgtttggggtgctcccaccccccggggggagactccctcggctgcttatgttgctccgcctgttcatccgtggcagaattccatccgccatgcctgttactccgcccccctcgctccgcattcactcgtcctgcgatgcatatattctatacacccgtggctctcaccactcatttgtgtggcgccccccgtcacgcacatttcttcccacattatgtgtttcatccatgcctccacattctgccccattcatctacctcccgcgggatcctctctccacaccccactatttctttcaccccccactgcatatcaaccccttgttcttaatcccccccaagttcatcagttagagatagattaactaacaccccgtcaaatctctctctcattttttttgcctgtcagattacttggctagcctggctattttttctatcagaagcctcatccgcatcacacaagcggataaatagaaactcctcacctctccacccccccacccccacataaca

SEQ ID NO: 615695 - DNA, 111 bp, Homo sapiens
ccaggaaaccacttttaccattattacggattccctggccggtgttttatgaaaagaaaccggtttgagcgtttatagcgaatggatcgcttgagcccatgagttggacgc

SEQ ID NO: 615696 - DNA, 784 bp, Homo sapiens
  misc_feature (483)..(483): n is a, c, g, or t
  misc_feature (735)..(735): n is a, c, g, or t
ccagcccatgacccctatcaggagccctgctcagtcctcctaatgacctccggactatccatgtgattacatcttccagttccataacgctcctcatactgaggactactaatcaacatattgaatcatataccaatgatggcgcgactgctaccacagatacagagcactgtaccaatggtccacactacaacaacacaccttagtccacacaataggccttcagtatacgcggatacttctctattctatatacactgcagaaaggtttcttctcttctatctgctacgtgcaatttctttcattgcacgactcctatttagacacgagctacgcatggcaccgtgagggcgcactcttaaaaacccccacacaaactctaaaggcgtaagcgggccaaaccatagggctctcacgccaaatcaagtgccaattcaaatctcaccgcctaaaaattagcgcacttgaaaatagattcacgnaacgttctccttaaaacgataatacacgctcaatataacttcgaccattctatgcgtagataatctaacatctaactctgaatatttacatccacttaagttatactataccgaaaaatttccactaccgtaaaatcccaaaacttaaaatatcatacgcacgaactggcatttgaatttaccataattctaatataacttggtgcgtcattctatgttatatatacacacgcctcccacttaaacataganctcatacaagaagcctatcatatcgtaagcattctcaaccctttttacc

SEQ ID NO: 615697 - DNA, 186 bp, Homo sapiens
atccctaatatgctgtggacctgctgacatgacaataaaggattagaatattacataaactaagtagataaagcagtggcagggtatgagaggactgactccaattttgcacgttcaactgtggataacatgctatcaaactgtaccgtatgctctacgagacatctttcatgacaaggaacagtc

SEQ ID NO: 615698 - DNA, 240 bp, Homo sapiens
gtttgtctgataatgtttagataatttgcaatataaactgtagaacttgttaggcatgaaatcaagcagaagagaaagaaaaatgctggaacgtgcttgatgtattagataaaaggcatgtgtaaagaagggtcgtcgaccctgactgcgagaataagaatcgcttgaggtgagcatatacagagggctaacacgtgcctgtgcatagcaaataaggattggtaaaatacataagaggaa

SEQ ID NO: 615699 - DNA, 898 bp, Homo sapiens
  misc_feature (705)..(705): n is a, c, g, or t
atctctgtatttgctttttatgtgccagtgtgcaaagagctgtcatcatttcgcttttttatttacttagtttgggagaatgaaatgatgtgagtactgaatgtctaataatgagtttggacttggccttttaaaattagttactgtaattatattaactggtaatgtgtggtatggatcatggtctaaatttagtagatgggctgggcatagtggctcattcctctaattccttgcacttgtgggaggccgaggcaggagggtggcttgagtttgagaccagcctgagcaaatagtgagaccctgttctggcaaaaagttaaaaagttgtgtgagccatggtggtgtgcacctgtgttcccagctactcgggagtgctgaggcaggagagtcactgtggcccagggggtcacgggctgccctgagccatgatcgtgccactggctcgaccctggtgtgacagaccaagaacctgtcactaaactaaacaaaaaaaacacacaaaaaaaaatttttgcgggcgctctcgccccaaaaaatctcccacaacactcttgggcgcgcggcccacgctagttaacgcaaccggcacagctgttcccacagacacccggcacccgacagggctggggcttccccaaaaaaaccgcggggcacccggcgtgcttacccaccaaacgggtctgggacacacgggccacacanggggcacggggccaatatcccgcccctctcagtgcaacacacacgcacaacgcagaacacacagaacacgcacacacacagccacgccacctgaagaccgacagcgcaacaacacgcacgacacagctccaacaaccagagcaagccagcacacaacccaagcaacacgccacacacgccacccaccctccga

SEQ ID NO: 615700 - DNA, 140 bp, Homo sapiens
catgtagccacagcacagatcatttcatattgcttccgtgagagatgtggcagagtcagctaaatacatattgacgccggatgagaagatagcgatgatatatggtagcgcgagagtgaaatatagcatcgtggtgtcta

SEQ ID NO: 615701 - DNA, 588 bp, Homo sapiens
  misc_feature (287)..(287): n is a, c, g, or t
agcgggaagaaaagccaccctgggagcaaagcaagttagggttgtaagagacatttctgagattaaagcagccagatctatgatggggtgggtacgggtggttaaagagaaacagaacgtgagaatgactcatgagactattaaactgacttaactgaaattttaaaaaagggggaaataccaactacgatgcacccccccccccaccacaccaggtttaatgctactcaaggtctatggctgggaaaggccacttgttttccttcagttaagtgctgagaacgtgnttgggtctgccagaagacaccccattagaggattccattcctttagaccttcagtttaacggccgtggatcgtggaaagctggtggctttcaaacaaattccgagccccttgcattcctccagagattcacagcttgacattagaacgtgtagtgtgctctgcggcaggcagccagtgttgttgcattcagccagcagccttccccattcagcacccttacagtgtggaatgggtggggcattcccccaacaacaccccttccaaaattcaggaaaacatattcttcacaggaaaattgac

SEQ ID NO: 615702 - DNA, 212 bp, Homo sapiens
gggaggtaaaggaaatgacaaagaaaccagaaatgtcagcagaggagaagccaacctttctaaaaaggagattgcttgcaaaaaaactcaaaaaaaagattgcttgcaaagaaactcaaaaaagaagttttttataagtaataattaagaaccatttaacaaaatggaaggtccaattgtttttaaaataaattatttagtccctcccctga

SEQ ID NO: 615703 - DNA, 164 bp, Homo sapiens
tgagtcgactctaaggatcctcgctacgtcatactatggcgaactgtaccagcagtacgtgcaaaccagatctagtaaaaagattgctgttcaaacgattgaaagcttactttgctgaggtgttaaacagttaaaacacaaaaattaaaagccctcatatgagg

SEQ ID NO: 615704 - DNA, 333 bp, Homo sapiens
  misc_feature (41)..(41): n is a, c, g, or t
cagatcctggcccaaagcagcaaagtccttctttctggcanctgcgctccaggtggctgtcccacgccggtctccgcgcctgcccggtgcgcgggtggcgtccgctccaccttcccttcgtctcctccggctccgcgttcagggagcgactgtccttaagatcgtgcccccctgcccggagccgcccttcagttcatcgcccgtcttcccagaagcgctgctgcggccccggcggactgatgaggagcctggagatccgcgatggcaccgatggccccgcggtgtgcgctccggggtctgagagcgctccgcccgcgggcagctgcggccgct

SEQ ID NO: 615705 - DNA, 386 bp, Homo sapiens
tttttttcgctgataaaatctcttttaggttattccaataaaaaatccattcacacagaaatatccatctcttgcaaaaaccattttcaaataaattctgtgtaaaccaaatttttccaaaattcttccaaagattctttagatcacagggtgcttccaaaaaaaaaaaaaaagaaattctcactaatagaaattttttttttaattccaacgcaaaaagtttgtgcttgattaaggctcagttatcacttgaacagaatgtacttctatatgtacgtgctaattatgaaactcacagcgcattcacagtgtacggtacacagccccacacaggcacacagctcccacatgtttcgtaagtgacacgacacagtgcgagtttttct

SEQ ID NO: 615706 - DNA, 358 bp, Homo sapiens
cggagtggcctggcgagcagatgcatggtggcactgatggagagggtctcccagctcgctcaatggtgttcgggcgtggtgcggcacctggcggcacctgtgcactcagccgtcgatacacgggtcgattgggacaagaaagacgatgtggttttcagggaggcccagagatttggagaagcggatgaagttctcctttagttccgaagtcagctccttggttctcccgtagagggtgatcttgaagtactccctgttttgagaaactttcttgaagaacaccatagcatgctggttgtagttggtgctcaccactcggacgaggtaactcgttaatccagggtaactcttaatgttg

SEQ ID NO: 615707 - DNA, 944 bp, Homo sapiens
acttgaggtagaccaaagacgaagagtcgaacaaaaaagaacaccgacagcaaacaataattcgcgcacatcgttcctggcgtcctcggtttcaatgcacagcggtttcccgccctggtttgcctcactcggacatccccttgtggggcccccgcccgttggtggccgttgcggaacccctggtgccagggtccggtatcctccctggggcccctctcccccccggccatgtgtccccgcggcttccaaaacacacccttcttgggtcttatttcgccgccatatcgctcctgccagtgtcgccccatttttcgcccgcctgtccgcctgggacaaagacttcccgggtttcagcctctcttcctgcgtgatggccacaacaccggttggtcccgccccgtttctttccccggccactcatagaccccccctcgtacaaggagacgggtcgtaccccccgcgccccctcatagcccccctcgcccctctgggagtaactctcgtcccccccccgccttctggatctatcacgccccggggggtgttcgcccccgccggagcacccccctcttcttgggaaggctctcccctgggactctcccttctccctagacgtgggggaccggccaaccccttctcacaaaccagattgggggcccccccggcaaccgcgccccgcgagtgggtggcccccggagtggggctggccacgtatcttctttggaagcggcctctctcccagcacggagttagagcgcctcttggtgccccccggaaagtgtttcttagcggcgccccctccctacgtgaattcgggtctttgcccctgagacacgttgtgcctccctccggccccggtggcgcggcgcgttccttcatcgttgcccgcaccaggcccggttgcgccccagtcgggaacatataaactttttgaccccataaca

SEQ ID NO: 615708 - DNA, 1266 bp, Homo sapiens
gcaagatcagcctggccaacatggtgaaaccccatctctaccaaaaaaaaaaaaaaaaaaaaaggtgcaattagctgtgcttggggatttggcccttgtattcccagttgcttgggaggctgaggggggaaaattggctggggcctgacgagctgggaggtatagggtggagaaactggagatattggccaccaattggcactggtaagcctggagttgactagaagcgagaccctggttctcaggaaaagaaatgttattgggggaagggtttatttcaaaggactctaacgttttaaaattcagggcggtggcacgcttcagccgccttgtaattcccaggacatttttggagagaaggcttagaggcagaggcagaattcaccattgaggggctcagggaggtcacaagagaccaggccttgggccggagcatttgtagaacccccattctcgtactataaaaatatacagaaaaattataacccgggggaattgagtgggggggtgaaacacttgtgtgggttcccaaggtttaattgggagaaggcatagagggcacgagaagaattcttcttgagaacccttggagagggttttgcggagagaggctgtgagaattcagcacccgaagtgtgggacactattaacaagccctgttgggtgtttgtcaccagataagacagagaaagtgtcgccagagcagtgaagaagagaagagaaaatcaagagagaggaaatttctataactatgtgagagaaaagtgatagggaaacagccatatataaatatgagaatattgaggggactatggggggagaatataaaagaaagtttcgctgtatatgcatatattataggcctttgttgtgtgtaaacaacggcgagggtttgttatgcaaacgagtgaacttattaaacgaggtgggtgtgataacaccaaagaattattgagaagagggggagaggaaaacattatagacaaggtgtttgggggggcaaacactttgtagtgaagagaaagcaataagacgtagttattaatcaacgagtggaaaataatttgtgacaaaaaagagtgttagctataagagagatatatatgtgagaactgcaaaaagagtaacaatgagaaaacagaggaggaaatagtaaaaagaacacacagggagtatagaagattgattaaagacatcaaaaccacactgagggagagaaaatagtttgaagattaacaggaaggaaaaagagggagaaatatatag

SEQ ID NO: 615709 - DNA, 103 bp, Homo sapiens
ggatcaggcacagcatgccaggaggaccctgctggacgagctagtgaccctgtgacttgctgctgccaccaggagtgaggggtccatgttccaaagtgtacag

SEQ ID NO: 615710 - DNA, 217 bp, Homo sapiens
cgtaccatctatgctctgtgtacctgcaccttaggaggctatagttagcagaatcattcagaatagcaacaaactatgataaatatacagcatatatacatatctagatagcaaaatacgatcagtagaattgtggcatattacgaatgaaatatcatatgcgaagagcatacgatgtattagaaaccataatggaagtcactagatggttacaggt

SEQ ID NO: 615711 - DNA, 1006 bp, Homo sapiens
  misc_feature (998)..(998): n is a, c, g, or t
  misc_feature (1001)..(1003): n is a, c, g, or t
tgggaggacaatggtgagaagagggaacctaagaattcctggactctgactgggcgtgagaaatggccggaagtagcttcgagtccgtcattcaagcagtagaggctctggagaaaaactggagcgcatctgcttaaagggccgcccagggtcaggatggaggggcaaagtccgagcagggggtttcctcccatattggatcacgatgaaaactgcacagaaagtccgtgctcagtttcttccatggttacagaacacaggccccagaccaggaaggcattctgctaaagaaggggacccgaaacctcagctaccagcgccgatggttcatcctccgaggaaacctcctcttctacctagaacactagaccgaccatgcacccctgggcctcatcctgttagagaactgccaggtggaaccacaccttaaggctgcagaaccctatgcctttaccatcctgacccctggggtggagggcacaggtgggcgggcctacaagctggctgcagaaacccaggaagagctggagacttggctgtgggcactggctggcgcgagctggaggcggctggctgggctgctgtcccccctccccccccaccaaaacccaatactgggagctgtgccaggcaactggccaagaacccatctcatccccagaggacagtggctttctagccactgtgagtaccccctccagcttccaggagttgcatgagcactttgggaaggagatccgggtgctgcacgtggtacatagagagctccaggcagccagtgacaatggagacagcagatcccaggcaaagatggagcaggagctcaaccagtgtctgatgagtgactgagagatggacccaaagctaagaggtacctacttgccaagacagcagactgcttcaacagagacccaggtcctggctctgtccctccctccctcgtccttaccccatccccccctcatcaaataacaaggcagaaaacaggcccaggtacnacnnnaaa

SEQ ID NO: 615712 - DNA, 319 bp, Homo sapiens
tccagatatttgaacgataaaaaactcctctagtcacatgtgaaagaactgacatcctgagcagtctctcagaaccacagatgcaatcaaattagaactcaggataaagaaactcatgcaaaaccacacagctacatggaaattgaacaacctgctcctgaaagattcctgggcaaataatgaaattaaggcagatatcaagaagttctatgaaaccaatgagaacaaagagacaatgtaccagaatctctgggacacagagattctgctaaagcagtggtaagagggaaatttatgcccactaaatgctattgaaact

SEQ ID NO: 615713 - DNA, 957 bp, Homo sapiens
  misc_feature (949)..(949): n is a, c, g, or t
  misc_feature (952)..(954): n is a, c, g, or t
tgggaggacaatggtgagaagagggaacctaagaattcctggactctgactgggcgtgagaaatggccggaagtagcttcgagtccgtcattcaagcagtagaggctctggagaaaaactggagcgcatctgcttaaagggccgcccagggtcaggatggaggggcaaagtccgagcagggggtttcctcccatattggatcacgatgaaaactgcacagaaagtccgtgctcagtttcttccatggttacagaacacaggccccagaccaggaaggcattctgctaaagaaggggacccgaaacctcagctaccagcgccgatggttcatcctccgaggaaacctcctcttctacctagaacactagaccgaccatgcacccctgggcctcatcctgttagagaactgccaggtggaaccacaccttaaggctgcagaaccctatgcctttaccatcctgacccctggggtggagggcacaggtgggcgggcctacaagctggctgcagaaacccaggaagagctggagacttggctgtgggcactggctggcgcgagctggaggcggctggctgggctgctgtcccccctccccccccaccaaaacccaatactgggagctgtgccaggcaactggccaagaacccatctcatccccagaggacagtggctttctagccactgtgagtaccccctccagcttccaggagttgcatgagcactttgggaaggagatccgggtgctgcacgtggtacaaagatggagcaggagctcaaccagtgtctgatgagtgactgagagatggacccaaagctaagaggtacctacttgccaagacagcagactgcttcaacagagacccaggtcctggctctgtccctccctccctcgtccttaccccatccccccctcatcaaataacaaggcagaaaacaggcccaggtacnacnnnaaa

SEQ ID NO: 615714 - DNA, 905 bp, Homo sapiens
caaggactgttgactacaatctaaggctgactgaccattggctacaaaagaggaagtagaaagtagttgaagacaggaagtgggaacatataattaatggagtacctagtgaggatctaggccggcttggcatattaatccgcagataagtaccctggtaagttctcatgaaacaagtagactcggataactttgatacacagacctaatttccaaaatggccacgtcttggttcctgtctttaatatctaaatacttactgaggtcctccatcttctatattatgaattttcatttattaagcaaatgtcatattaccttgcaaattcagaagagaagaacaccatatactgtgtccagagtataatgaacctgcagagttgtgcttcttactgctaattctgggagctttcacagtactgtcatcatttgtaaatggcaattctgcttttctgtttctgctccttctggagcagtgctactctgtaatatttcctgaggcttatccacctcagtcatatcttcacgaaatgtctgtgacctggcagggatctttgtcttaaaaatctattcaaattcgatgtcacaattagggagacagatagttactcatcttgggctcttgtgcaaatagcccttgtatgtatgtaccttcagagtattccacagtatgttctaacgcacaggaagttcctagaacgggggcccaacattcaggacttgaggatgttccttcggataccctcagaaagtcacacataaccgggcttggtggaccaggctgtagctccagctactggcaggtggggcggagaaccctctacaccagggttgcttcacttcacacaaactgcatctccatcgtcaaacatgttccaacaaatccagggccatggcacgagaca

SEQ ID NO: 615715 - DNA, 261 bp, Homo sapiens
  misc_feature (253)..(253): n is a, c, g, or t
  misc_feature (256)..(258): n is a, c, g, or t
tgggagtggttgatggtgagccaaaggcaagcattgttagtggagatggcagatcccatgcaaagatggagcaggagctcaaccagtgtctgatgagtgactgagagatggacccaaagctaagaggtacctacttgccaagacagcagactgcttcaacagagacccaggtcctggctctgtccctccctccctcgtccttaccccatccccccctcatcaaataacaaggcagaaaacaggcccaggtacnacnnnaaa

SEQ ID NO: 615716 - DNA, 147 bp, Homo sapiens
  misc_feature (104)..(104): n is a, c, g, or t
tggtcactttatataaaaatcatgatgtacaaaattgaagtgtgacatgacatatgaatctgtgactgaagtcccctcgagtgctctgggtgcacatgcgccgnccacacaactctggcatgaaacataaactaatgcaaccagtgc

SEQ ID NO: 615717 - DNA, 178 bp, Homo sapiens
ccctgcactctttgagaggatgtagctgccgtcactccagcagctgagtgccatactgtctgcaggtagtcatgcaggcaaagatgagactaacggtctcatgtgggagaaccctcttgcgggaggccgggtagcttgagctaacgggtccggctgcccttgcttgctttggtggcgt

SEQ ID NO: 615718 - DNA, 167 bp, Homo sapiens
  misc_feature (13)..(13): n is a, c, g, or t
atagagtaggccncaggcatcatacaagtttttgcacacaactagtgacatgggattcgcctctctgctgactttgcttttcttagtttttttatttttaaatcccagttgtgctttgatttaagtcttattcacttgctttgttagtaagtttagatttcaaactg

SEQ ID NO: 615719 - DNA, 657 bp, Homo sapiens
actctcgtggtatctatgggagatgcagcagcgaagcacagccaccagggagtggccatttggggttgggacagggagggtgtctttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaacgaaatagagccaactgattttgtatgtaaataccatagatcaactttaaccatcggtaacataaacgacctgcaccaccaagtagcagccgacctcttacccaagccgctcattcaccaccgttcctatttcctacctggtcactgcgaaaccttgtcttccactatgtgatccagccctggttcttggctgtggtcacgcagactgccagctgatacgggttattccgatgctgtgttaggcctcaatcttcatcttgtctctttcgtactccgttcatggcctttactgatttctagtgtatactcctgtagtctcatgattcgtgagatgattccaaggccatgaggtaataaaaagtatgttgtacatactgcattaactcgtcttgcaa

SEQ ID NO: 615720 - DNA, 666 bp, Homo sapiens
  misc_feature (325)..(325): n is a, c, g, or t
  misc_feature (428)..(428): n is a, c, g, or t
  misc_feature (570)..(570): n is a, c, g, or t
ttgtagtagttctattgctcaatcccacctatagtgagaatatgcggtgtttggtttttgttcttgcgatagtttactgagaatgatgatttccaatttcatccatgtccctacaaaggacatgaactcatcatttttatggctgcatagtattccacggtgtatatgtgccacattttcttaatccagtctatcattgttggacatttgggttggttccaagtctttgctatggtgaatagtgctgcaataaacatacgtgtgcatgtgtctttatagcagcatgatttacaatagaacaactacaaccgcggttgtagttgtnctattgccattttagaaagctctgatgtgaattcaaattttacctctgttacttaaagccaacaattttaaggcagtagttttactggccatttaagctcttngtacagtgtcaatttgtaaaaaagaaaaaacgaaaaaaaatctcaaataaaacatgagataacattttaagacttccaaatcagagaagtgcttcaaattattgggtgtggcttatttttaacatgtaaagcatatactgtngttagtattgcgtcattatcgcatgttgagtcgggccaatttctatatgccgggaaggcaggccaatcgcaggatcttattaagtgtactttgcat

SEQ ID NO: 615721 - DNA, 1225 bp, Homo sapiens
gtgttccagtgagcctgaatcagaaatgtcatcctcagtgcactgccagacttacctgtcctactcaccgatttgaagcattcaatatcactaagcatcttccataaaccaatgcaatggccatgcattccagtgagtggcacagacaatttcctgtctttcaatccctgcaactgcaggaggagctctgcccagtgtagcaagcacaggagcatcaaggcaggcattgttgcacccaggcagtgcaaggcctgcaagacaaggcttttccagcatttggcaatccccctgtggctgtactcatgcgctgccttccggagcagtggggccgcactcattatcaccaagttgggctgcatctcaatccgcaacagcaagcatctggctcttgctagcttggcgcaccacatgtgcagtcaaattggcacatcggtgtgcacaccactcgtcaattcccaatggccatcattctcgcacttgcatttcacagccacgtggctggcattccaaccacagccattttggctgcctcaccttgttggccagtgtcttgagcgcttggagccaatgcatacccaagcaggacactggtaaccaaatcacccaaattcgcactgggccacatctacttctacaccactcatttaccaaagaaacactttggaacatcccttaagcttcgtgcgtcggttcaattcgcttgtggggccaacccactcccatcttcacttttcggcgacatcttttcacaccgagtacaggggtatcaaattggccttccaaatctctggtgcaaacccgacattatgtgcgggcacttctgagcacccttcgaacagcccttcgtttgggagcaaaacgccaacacatgactctggagctttagtgtcccaaagaccgacaccccaatggggcgccatgaaatggaccagccaaacccttttccacagattcctttcaacacttggggctttctacttacaccaactcagggtttgtcagaccagtgctccttctttcgccaagtcaacaacaaatcgacagtgggtcacaagcgagaatatttacgcccttacacgttgtgggacacgattaaatgctcgtgacaatctcatgtctggggttcagcaccattggtggcttatcattatgatgaggcatcgctcatcacctagtgacacaatcggaggtcccaagaccacatgctagtctctaccatccaacc

SEQ ID NO: 615722 - DNA, 293 bp, Homo sapiens
agatccctcgagatgccggttgtcacggtggctcaccctgtgtaatcacattttgggaggccgaggtgggtagatcacgaggtcaggagttcaatgatcaacctggacaagcttgaacccgggaggcagagattgcagtgagccgagatcatgccactacactccagcctgggcgacagagtaagactccgtctcgggggcggggcaagcaaatgaaacaagatggacaaaaaaaaaaaaccgggtatgatcaggattagtggggctcgaccggtgatccacttggcctgggt

SEQ ID NO: 615723 - DNA, 620 bp, Homo sapiens
  misc_feature (4)..(4): n is a, c, g, or t
  misc_feature (53)..(53): n is a, c, g, or t
  misc_feature (133)..(134): n is a, c, g, or t
  misc_feature (201)..(201): n is a, c, g, or t
  misc_feature (226)..(226): n is a, c, g, or t
  misc_feature (235)..(235): n is a, c, g, or t
  misc_feature (237)..(237): n is a, c, g, or t
  misc_feature (243)..(243): n is a, c, g, or t
  misc_feature (267)..(268): n is a, c, g, or t
  misc_feature (279)..(279): n is a, c, g, or t
  misc_feature (382)..(382): n is a, c, g, or t
  misc_feature (524)..(524): n is a, c, g, or t
tttnggaaaactgctttcctctgagaaccttattctgaatgtcatcaactttnccaaaccttctaagtccagagctaacttagtactgtttaagttactattgactgaatttccttcatttctgtttagccanntgttaccaaggtaagctgggaatgaagtatccaacttctttcagagcattttaggacattatggcanctttagaaggctgtcttgtttctanccaagggananccagcncaggttttggatactagagaaagnnatttgcttgtnctattgccattttagaaagctctgatgtgaattcaaattttacctctgttacttaaagccaacaattttaaggcagtagttttactggccatttaagctcttngtacagtgtcaatttgtaaaaaagaaaaaacgaaaaaaaatctcaaataaaacatgagataacattttaagacttccaaatcagagaagtgcttcaaattattgggtgtggcttatttttaacatgtaaagcatatactgtngttagtattgcgtcattatcgcatgttgagtcgggccaatttctatatgccgggaaggcaggccaatcgcaggatcttattaagtgtactttgcat

SEQ ID NO: 615724 - DNA, 219 bp, Homo sapiens
cgactctagacggactccccggctcgccgacgcacactaccacggccacggactccccactgtggggtggggacggaccacgggttgactcctttccactctacactgtggttctacgacacaccctcactggacttccacggcaacgacacgcttacgcgctgtacctcctgggacacggggacactacttgcacgggtacccgacgctcgacacttc

SEQ ID NO: 615725 - DNA, 378 bp, Homo sapiens
  misc_feature (50)..(50): n is a, c, g, or t
  misc_feature (344)..(344): n is a, c, g, or t
gagctgcttaggaggctgaggcaggagaatcgcttgaaaccggaagtggnaggttgcagtgagccaagatcgtgccactgcacaccagcctgggtgaaagcaaaattctctctcaaaataataaatgaataaaataaataagtaaatgggcttttttttaaggtaagactttagaagtactttgctaataaatattcttacggagaagtttcatatagtgtcttccgctattttagaagtatgaagcttggaaaatatatcttgaaatttttgttatcagatcgatgaggtcctgagacagggaagacaaagctgaagccatgtccggccatattgatccagtntcttgatagccacttttatggcagctaagactcc

SEQ ID NO: 615726 - DNA, 141 bp, Homo sapiens
aatcgacatttttaatcctttagcaataaacgataatttaactatgctatactaaccccatggttggtcaatttcgtgccagccgccgcggtcacactctttacgccggcttctattgacttgggttaatcgttgtcgacg

SEQ ID NO: 615727 - DNA, 209 bp, Homo sapiens
taaattccccccccctgggccttgttttcccctaattccagggcagattccagggcccaaagctgggcagacatcccaggataacccaggcctgggggggggccccccggcctgctgggggggtttgacctggggggattggagggaaatgacctgccccccccccccccccaaagggtggggttaaaggactgttttttttcccctta

SEQ ID NO: 615728 - DNA, 329 bp, Homo sapiens
  misc_feature (49)..(49): n is a, c, g, or t
  misc_feature (69)..(69): n is a, c, g, or t
  misc_feature (97)..(97): n is a, c, g, or t
  misc_feature (222)..(222): n is a, c, g, or t
aaacggcagtatgctgatggttagcgtcacggtacggcggtgaaaacgngtcgatgagaagattctctnggctggtcgctgccgctctgttattggnagggtgtgcaggcgaaaaaggcattgtcgagaaagagggatatcagcttgatacccgacgccaggcgcaggcggcgtatccgcgcattaaagtgctggtgatccactacaccgcagatgattttnatagctcgctggcgacactgaccgataagcaggtcagctcgcattatctggtccctgcggtaccaccgcgatacaacggtaaaccgcgcatctggcaactggtgccg

SEQ ID NO: 615729 - DNA, 288 bp, Homo sapiens
  misc_feature (88)..(88): n is a, c, g, or t
  misc_feature (91)..(91): n is a, c, g, or t
  misc_feature (266)..(267): n is a, c, g, or t
cacctataggaccctaagacacacacacgcacacaaggctctaggtagacgagaagggacacacacacacacgcacacaaggcttcanggnagacgagaagggacacacacacacacgcacacaaggcttcaggggacacgaagaagggacacacagcaatgtgtgttcccatgtggcaccctggcacagaagctgggcgcacaccttggcaacaccctcccaacatctcccaccccgggaggctcatccccacccccagaagtgnntctgtctttgggggttaccga

SEQ ID NO: 615730 - DNA, 488 bp, Homo sapiens
  misc_feature (8)..(8): n is a, c, g, or t
  misc_feature (20)..(20): n is a, c, g, or t
  misc_feature (25)..(25): n is a, c, g, or t
  misc_feature (488)..(488): n is a, c, g, or t
catcgacncccattgcaatngatcntaatgagttggatgttctgtttagcgccaggggtgagcaagctgacgaaactgctggcggcgcgcgctagcagtgccacctgtgacgtgggtgctcgcgtgtaccccagcggtcaacagaaggatgacagcgactttcgcccacgctccctgcatagagaagtaggctaagccgaacatgacgccccagtgagccccgctgatgatatctatgatgacctcaggaacgcgcattgcgtacgccatgatcatagcagcggtgcacgaccagttcatcatcatgtcccatgctcatacggtgtccagtgatggcgccaggatagatggagcagttgcattcatgcacaaactcatggtgctgaggccagatgatcagctgaactgcaagcatcactccgtcgcagaggtcccacacgtagagagctgagcagagcgagtgtgacaccacccatgtcgattgcgtn

SEQ ID NO: 615731 - DNA, 359 bp, Homo sapiens
taccctggagcttcagtgccccaccggggctgcggagagtcccaggccctggcctgggaccgggagcggctgtcctgatgtgccaagtgttgctatgctctagtggtgtccctgctcccctgctgtgtgttgcctggctgcgctcaccctgtgatgctctctcatcctgctaaattgtgctttgtgtgggaacgaatgtaacattggcgtaaccccgttctctggccctggaacctggtggtggtttgcccatatgcctttcccctgttgaaacccctggcctggaccttttgggcacccccccctggcccgaatttaaaattttcccttttcccccacctttgggcccctttgggcgg

SEQ ID NO: 615732 - DNA, 869 bp, Homo sapiens
  misc_feature (97)..(97): n is a, c, g, or t
  misc_feature (111)..(112): n is a, c, g, or t
  misc_feature (129)..(129): n is a, c, g, or t
  misc_feature (133)..(134): n is a, c, g, or t
  misc_feature (137)..(137): n is a, c, g, or t
  misc_feature (147)..(147): n is a, c, g, or t
  misc_feature (393)..(393): n is a, c, g, or t
  misc_feature (407)..(407): n is a, c, g, or t
  misc_feature (468)..(469): n is a, c, g, or t
cctttttttttaaaaagttgccaaaaatgggcttttttattttggagggccttacttgtggtgcttgggcaacatgtctgcaaaagtcccacagctnccaggctgaaaggnnccattgttccgtgctcncccnngcngttaggacanttcagctcgctatgtgcttgtccaggcaggagggacaggagtgccaagtttctattagtgtaacatgattgatttaaaaacaaaacaaaacaaaacaaaaacaaaaaaaactgcttatgcactgtgaaaaaggctcagggacgaaccaggtcagatcccacttgtgcgcctaatctcaggtggtccacccgagaccccttgagcaccaaccctagtcccccgcgcggcccttattcgctccgacangatgaaagaaacantcatgaaccaggaaaactcgcaaactgcaggcacagtcgcattgtgggaaggactgtcgcnnagagaagaaggtggttcatagcaatcagtccacagcacatgacaagaaacttcagttctccttagagaagtgacggggtgaacaatatctctggtattcgaaagaaggcgaagtatgtttacaaagccaatggaaccagttgatccgacgtttaatcataccgctaacacgttcaaggcgatctcttggcatgctgaatcactttcaccattacaggccatgctgagacaaagcagctgacagaaatgctacccagcatcttaaaccagcttggtgcggatagtctgactagtttaaggagactggccgagctctgcccaaaccatctgtggatcgaaaagcaccacttgctactggacaggatgatgctgcatgaagttccagatcttgtggagaaatt

SEQ ID NO: 615733 - DNA, 202 bp, Homo sapiens
gagggagagtatgtggtagcaaatatatgctggatgctaaacaagggggtgtcgctctggagagagaaggctcagcggatggggacagtgtcaccttccatgtgcagggctggtacctgggagaggaatttgggctccgctttcacctgctccagcagggaacgaactgcatgctatttagcctacctgtaattgactgatg

SEQ ID NO: 615734 - DNA, 1551 bp, Homo sapiens
gctccaacccgccgctaccgcgccgctgtgggagatgaccccagtcaggagcccaagaggtcagctatcgtgtggtgctgcgaatgagccagctggctgccagcctcaggccagccctttccctgggcggtgaggaccccggtggctgtggcagggaagggaccctgaggttccatctgcgcttaatggatgacagttcgtagaggaaccctcgaagttgcgagctagaacaggtaggcttggccaaatccatggatagctgtatgctgcgtgcactagggctcagtgtgcgccagcggcgtgtgacaagtgccgtgaaccacactacgaaggtccggccgacacctgtgtatttctgtacttgtcaagcagacggtgtggagcccttacccgataatccctgcagtgactagctgtagccactaactaatcaggctttccccagtcgttgcttgccccctgaacggatcgcactagccgttcaaccaacaaaggcccttaagcacctggggttgaaacgtcgccttgggacctggctgggacaccggaaattgaggcattgacgatactttcaggtcactggaagaactcccggcctttaacgagggatcaaaggctgggaccgtaccgacgaacatgccttgctgccccaaccaatgcatacaatcaaacattgcttgcgaacatgcgcttgagacgtcaccgtggccccacaggagggacccccttgtgccacaaacaacacgggtataggtaaacttctggggaacttctgggcggcgatcaagactggcaactttgtgcagctcaggagttcccgagaggggatactacgaggcagcgggacttaaactattcacgagggcaggacaagttggcgagattcccctgagacagcgacccagagcaaaacacgacaaaggccgacgtccatggtacacccacatctgctgtgcgacccgtggttacaaggttaaggaaagttttcgcaagcggtgtgacacctcggctactttaattatgtcgagccgcaccatggatcaagagcgaaccacgtgtacacgtggataaggcacaccgcaatagaacttgtgcaacagggagatataacggacacacggcaagcagagggattgcacgaaggcgaagcattacaacccctcagaactataaaaagggcgtatggacacatggtgcgtacatacagacacgatacacgcgggagcaaccacatgcggagacaggcaccacgcgagccactagatgcgtgaatcaaaagaggaggagatgacacaccagcagacacagacggaacaaccacggtgagggtgcccacagaaggacacagaggacaagacgagagacacacggaggacattgacagccgaagcacaacgaccagcgtcgacgaccacgacaacccgactgacaacaccacagcagagaccacccgtcaaagcagtagatcatgaagagataaaccgtccagaggactaacaagtcacacacaacacggagaggaggcaacagacaccaccgagaatgcatgca

SEQ ID NO: 615735 - DNA, 1612 bp, Homo sapiens
  misc_feature (482)..(482): n is a, c, g, or t
  misc_feature (824)..(824): n is a, c, g, or t
tacggcaggtcacgcgctggcgccagcggcgacaggagccgagcgaccgggcaaaaatacacgggaggccgtcgtcgcgtaaaagagtccgcggatcctctctcggtaaagcgacactcatcgctccaccggcagccgtccccctccgctcgtgcggcgtccgcccgggcgtggagcgcgcctgaggccgcatcgctgacgtggcatatagtgaccggcggaggcgtggcgggacggaaggtggacgatgggcaatggacagcagtgctcttcgcctgccggggagctcgcgttgatagtgacccacagatttggctgtgcctacgttcttgcgaggcgtgtcgccttcattgagcatctcagcctggccccgtttgcctggcgagcgctgagggcggcgctcagggtatctctctgcttctatacccatcgtacggcgccccacgatgcgcgactcgtacggtgtttccacgtggctgganccctacttgggtggtaacgcacttgtgccccgggacgtctttgcctgcgcgtacgcatggggaccttgtcatgcttgttggcttcacacacatgggcatcgcacttggacactcacggcgcgtacccgcacggcacacttgcgccggagacctgtgccagccagcgggcagcgtccatgcccgatgcgaacggcgcaaacagggtccaccccacattgggggagcctggcccggcatgtcgcgcgggcccaaaacgggtggcccgtagcattgcctgtgggaagcgtatgcaattgcacctctgatatcccccttgtggactggccatcccatgcgcagctngtgtgcgcctaagacatttcacgtaacggggtatactaaggttcaagacaggtcggcagtcctaggtgaagaacacccgaatacgggttggctgtgccgtgcccggggcgccataaacgggggcatccccggttgacaggcgcccctgggggagacatagaataccatggcgcacggccacggaaagaggaacgggaagcggtacccagcggcccccaggcgttggccgcccttcacgggggaccgtccgtaacatcccgcggcggggaccacattaccggctcctacacacgcaacggcaaggcggcctagacacccggcggatcggccaggaccgaaggcgcctcacggcagaagggcaactaagcaaagccgcggtgggctaggcacatgagcatgggcaggtcccacgcggcggacccatgacgccacacgagtcgaaacgcccccacggaaaccccgccactccagggaagccttcttggcaacgtggcccacccaaaacgggccgggcagtaccaacaaaacggggttgtcccacccccggagattaccccacagcaacatccgggggtcgtataacaaaccccaaggggcccactcgagcagagggccaacacccaccacaccgcaggcacaccacaccaccagcgccacagcacgcaccccatggcactcctagctgcagcgtacaccccagctctgggccgagcaccacccccaacaaccacgacacgtgcaagacactagctcgagccgaacatctcacacaccctacgaacgcacag

SEQ ID NO: 615736 - DNA, 710 bp, Homo sapiens
  misc_feature (30)..(30): n is a, c, g, or t
  misc_feature (65)..(65): n is a, c, g, or t
  misc_feature (75)..(75): n is a, c, g, or t
  misc_feature (77)..(77): n is a, c, g, or t
  misc_feature (111)..(111): n is a, c, g, or t
  misc_feature (119)..(120): n is a, c, g, or t
  misc_feature (123)..(123): n is a, c, g, or t
  misc_feature (139)..(139): n is a, c, g, or t
  misc_feature (157)..(157): n is a, c, g, or t
  misc_feature (166)..(166): n is a, c, g, or t
  misc_feature (202)..(202): n is a, c, g, or t
  misc_feature (235)..(235): n is a, c, g, or t
  misc_feature (259)..(259): n is a, c, g, or t
  misc_feature (282)..(282): n is a, c, g, or t
  misc_feature (378)..(378): n is a, c, g, or t
  misc_feature (402)..(402): n is a, c, g, or t
  misc_feature (548)..(548): n is a, c, g, or t
  misc_feature (555)..(555): n is a, c, g, or t
  misc_feature (574)..(574): n is a, c, g, or t
  misc_feature (682)..(682): n is a, c, g, or t
gggggggctggttcgggggacggggtttantatgtcagtgaagaccctgcctctctctgttacangatgcctaangnggaatagtggtgcttcccgccccgctccctcttnttttgggnncancagtcttttctcaganccctcccttgccaaggcngcccttccnaaaacatgagagcttttgtttggggaaatttttttngctcccttttgctggagaggaaatgaattttanctaggtccccccgagaagcaacanagagtgttaaagaagccactganaaggtagtccaagatctggctttaggttttgttgccctggctttcttgtctttggacaagtgtccattcaccagttatcccgcctggccggaagcngatatctttctgtgtttttctggntccaactaacatttttccaatgtctgttgcatgccaggtactgagcaaaaaccttcttcctataaatttcatttaatgccattaaggccaagaaggtggcataaccaacttcctttttcagctgaggaaacaggagcacagtgaanaactaantggctgggatttgtcctangtcccctgaactccaagcacagtgctatctccactagaccaagctgccttgtctctgggctcaagagaagcctgcataggagctgaaggtcaagaggttgcaggcttntctcatatgcccatacttgggcctccct

SEQ ID NO: 615737 - DNA, 1373 bp, Homo sapiens
  misc_feature (116)..(116): n is a, c, g, or t
  misc_feature (181)..(181): n is a, c, g, or t
  misc_feature (1071)..(1071): n is a, c, g, or t
  misc_feature (1114)..(1114): n is a, c, g, or t
tcccaaggttcacggggttaataagggagtcgggagggaaaaacacccaggagttccccaggccatctccacattgtgtctcccgcggcatgtgtgtgacgatctccagccgtggncttttcttcgtggtctccttttcgtggacaagaggcgtggccaagcgaggcagcagccttcaagngggagtgtgggataggagcgtggggcgccttcgtggcacgcccttaatctcgagaaggatatgaactcgtggttgtgggtgaaaactctctcggctctcgagactctccttgtgtgtgtgtgggccagaacacaaaactcgagagttctccgagggagagtgaaagcccacctctcgcggcggagggggaaactcgcgggaactcttcgggtgcgaagccccccgagggaagtgggtgtgatatatagcgcgagtgccgagccgaagtctttttccgcgtctctcttttgtgaagagagaggcgctcttctctcgaagctgtgtgctcccaagttcgcaggggcctctcgcgggggaaactcggtgtggaggtttatgagaggggtctcccacgtggggggtggtttttccccctctctccacagcgcgcgcgcggcccccccagagggtgtgttcccccaccgggggtgtgtctctcccccacacaagaggccccacacgcagagtgttgtctaattgtgtcagagacacacacaccacgcggtgtgtgtgtctctccctgtgaccaaaaaagggggtggggctctccccatgtgaggagaggagaccaagaaagtgtctatctctccccaggaggagagcccggggagataaaaccctccttttctaaacccccaccaacgggggggcacattctctctataattgtcgtcttcgaggaggaagtatttggccgggagaaaaagaaacaacagcaggcaggggcgtgttaacctattttggaaccaacatttgtggtcgggccaacccattggttggtggctcccaaataatttagacggctgtgtggggttttcacccccgtgttagtaaagcccccccaccagaangagctttttttattcttctcctttggtgggtggtccacacccncacaaacagatggtgtggttgggttggacattcacacaggacaccctttcctgttagggcgccacgcaggggggtttacctacttccccccccccttatttaatttataaatgtctgtagggaacgactagtactctccaccagcgaaaaatactttactcaccacattttcctacggacgagatatattaaaaaagcggcccccccaagtggggtgtgtttttaaacacccccgctgtgtgggcgattttttaaatag

SEQ ID NO: 615738 - DNA, 610 bp, Homo sapiens
gccgcgccgtcgtcgcgccgccgcgtcgtcgccgcctccgccgcggaggaagacagcgccggccgtgcaccggcagcgacccccgccgcagtagtcccaccgtcattaggcctcgggccagcgggcaggagctgcctcgggcaggaggaaaggatagtcaggaatgaatgatcggagaggatgtggaagacgggttcggaggatggaagaaatgagaagatgcactgaaaagtacgcgtgtgataggatagtgtacgtagaaactggtgccgaggttgagtgaagtggatcaacatgaggagtgcaagttagctggtgctgaagaagataaaagtggttgcgtatagtggagctattagaagaagcgattgaaatggagattatgggagggcaattcatgagcgaaaacaagtactgtttccttgcagtttgtggacaatgatttcatgcgagtaggtgattagtgataggtgaatatggatggaagttgtgggagaattatgattgttcctggtaggggaaaacttagagttggaacgtttcataaaatagaggatattggaatgagaacataataatgttgagcgatattgggaagaagagtatcaaa

SEQ ID NO: 615739 - DNA, 190 bp, Homo sapiens
cgaagtgatatgaacacacacttctcaatagaaaaataagatatttatgcttccatttctttaggagcgttgagtgaccaagggtttggaaaagaggagatgagtgtctgctggagcttagccatctgtgtgcaccagtcgcttggtccacataatgcagctgtccagcgagtgcagctgtgagcgtaga

SEQ ID NO: 615740 - DNA, 247 bp, Homo sapiens
aaagggggggaaaaggggggcccccccccccccccccccccccccttgggggttttggggtttttttttttggggtccccaaaaacggggggcccccttttttctgggggggggggccctttggttaggggggttccgggggggcccctttttttttttaaaattacccccccgaattgtttttttgttttttttttgggggttttttttcccccccctttttttttttttttggggccccccccca

SEQ ID NO: 615741 - DNA, 148 bp, Homo sapiens
cttcagtgggagacacttctggatggtaatgcaatgtccatggaggcgagcaggactggtttctgttgctaccatgcaagctgttatttcagccaagagccccggaaattccacctgatgctcaaccacgcagagggctcctggggaa

SEQ ID NO: 615742 - DNA, 156 bp, Homo sapiens
cggcctacgcgtacaggatgcagtaggagaagtcgggcagcttcaggtcgggatccccctcctgcctatcaaggcctgtaccgcatgcctgggaggcaacgatgatcagtttcttcccccacctgtcaaaggcttccaccattgtacagcgaggct

SEQ ID NO: 615743 - DNA, 413 bp, Homo sapiens
  misc_feature (329)..(329): n is a, c, g, or t
ccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagnaatacaaagcaaagattgtttttgcagttggggacttctggggtaggacgttgtctgctatctccagttccacagacccaacca

SEQ ID NO: 615744 - DNA, 1047 bp, Homo sapiens
aattacattctcatcttctcttatcggtatgtgtccctcatgatgtactcctccctcttggtttgtttattccaagtgtgctggtgttctcccatgtggtcattctgttctatcagacccccctcatttcactgtgtgtatgacacgcctggtatggtccgccctcccctctgtggttgatatatgtctcccacaaacgtgtggggatcgcgccgcatccgcttctcgtgctatcgtctctttgctaattgaacctaactcaatccaatcctacgctgccgatttcaaggccctgtacggatgcctgccatcccttaattaccattgatggtgtccactgttgttcgcactttacgttcttcatcagatcaagtctttttgctcatcattccttccgtattccactctcactcctcttttttcccggcgtggcgcttttccttattgaaggcctatatcgagcacttggtggcgtgataggggttatcttactaccctgcccatatcgcatgtccatgatacgtcactcaataccacagggacaatgcacagttttgtagtgtgtatctcaatgctcgtcgtgatcagatgcgtatgcccgggcccctcttattggtgatggctcctcctttccagccgctggcaggcttattgatgaccctgttccccctgtctcagccctgtcctcacacatactgccgttatccccattctactcccctgactatgcaacgttgcccctagtggcttgtcccctaaccccgtgcagcaacaaaagctcaagtctggcgggcaccgagacgtaatctgatagaatagcttagaagtcagcgtcttccattcgcgacgtaaaagacccccattcttccttatgcgggtaatgatgtggatagctggtctcagcgcctggaccccaccaactgaggagaggaggcttagaacaggtgagccccatccattactcaatggggcccttcactcggcctggagaaggccattttacacacacacaaaacatacacacacacacacacacacatatcacaa

SEQ ID NO: 615745 - DNA, 330 bp, Homo sapiens
gttatgaggatcatcaacgagcctacggcagctgctattgcttatggcttggataagagggagggggagaagaacatcctggtgtttgaccttggttgccgaaccctcgattgttgcttttcttaacatttacaatgtggtcttcggaggtgtgtgccactctattgagagactctatctctggtgtgagagagactctttaaccagcgtgtctatatgcacactcttatctcactctacacaaagaaggacgcgcacagatgtcacaggagacactagagctgctgcagagactctccgcgcgatagagaagagcacacgcgcctctct

SEQ ID NO: 615746 - DNA, 507 bp, Homo sapiens
ggtaccccgaacctgcatgctggttttcccggtacagccatggcgagtccactacgatcgacccggaccgtggcttgccgattgcgccgtcgaaaacattatcatggctttaccgccgctgaggttcgacccggtcggccctttacaccgtgtactccggccaccagatttccctggaagtgctggagcgctgcgaaaccttctgccgcaagatccgcgcaagcgtcttggggacaagtgcgacctgctgttaggcacccacccggcaaatagtgccgtcgtcggcgatccgcctgtgccaagcgcctggagaaatacgacccgctgtggttcgttatccccggaacaccgggcccaggaagaggccatggccccaggtcggcggccaagaaccagcatccccatcgccaccggagaagcgggcttgaccaccaagtacgagttcttcaagctcctgcaggccgggcggtgcgtcgatccttgcaatgaacgttgcccgttgtggcg

SEQ ID NO: 615747 - DNA, 892 bp, Homo sapiens
  misc_feature (616)..(616): n is a, c, g, or t
  misc_feature (693)..(693): n is a, c, g, or t
cgcccctttttttttgggggttctataacccgagggcacacccaccgcgggggggagctcctcttaaggctcctctaatagggcgcctcttttccccccccggggtggggttcccccccgcgcgcttcgttggtgttagtaccaacctcgcggctttttgtcgcacccccctttttgcccccgcctcttgttgtagggcccgcggagttttctcttttgcgtcgggccccacaccccgagtgcgcggtgtgtagatcccccccccgctatgtagtggcggccccgaggaagaccccccctgtgtgtcttcctcgcgggggagattttcctcccccctcttggtgaatcacgtctccccgcgcagcaccaaattgtttgtctcctctgcttgcggcgcacccgggtggggccccacctaggggtgagtgagcccttctctttgtggctggccccccccccctgaaagttgggcccccccccctagtggggacagtgttgttctccgcggggcgcgcttttcccctccttggcgcgacgctttggtttgtctctcgcccaagactcttgtggcgcacgcgcgggacacaccgcgccgctgtggggagacaccttctcnctcctctggggtgtggcgcacccagagaattgtcttgttgtgaaccgctgtgcgacacacgaagaggatgtctcctngctgtgggacccccctctgcttctccgcgttgtaacccgcgggggggcccccgccgcgcttcatgcgagccccacgccgaaagaccgcggccccctcctcgggggggcgttttatttttcgccccgggccccttttccccccccttccccttttccggggttttttttcccccccccccaaaaaagtcctttttcccga

SEQ ID NO: 615748 - DNA, 688 bp, Homo sapiens
attggggtgatgggtggccgctgctaggtttggaggtgcgtgggtagtgggtcgcttcggtgtggtgggaacgtgggtctgtgggggtttgtaggagtgtcgtttgtgttgtgggcgcttggtgtggtggtggtactgtgttgtgtcggtgggaaaaggtggggcaggtggcctctccggcgtgtcacttagggtggtgtggtggagtccccctggcgaccgaggggtggcgggcacggccggatgtgggagggggtggcggtgtggttctccgcaagtcctgctgtggtataacgattagactcggaattgtgtgtgtgagtctaagtttcgtaaggcgaagacgatggagcagggagggtatagagttgatctacttacaggtcgttttttaagtccacttgtggtcgcgaccatcttctactgatgtataatcacgcttactggtattgctctctatcactcttatgctatgactgtgtctgacttcttgtgatagtcgtctggccgtcgtgggacaatatgggcaagctaccagtattgtagttggggcctggtagtcttggccctcgtgagaatgttgatgtgggcaggaggggtaccctgtcaagaacgttttatatattctccccaaccccccccttttattagggaaaaaaaatgttgaaaaaagaaaaccaaatataaa

SEQ ID NO: 615749 - DNA, 401 bp, Homo sapiens
  misc_feature (129)..(129): n is a, c, g, or t
  misc_feature (167)..(170): n is a, c, g, or t
  misc_feature (191)..(191): n is a, c, g, or t
gcaggtcagtttcctcaagggtaaacagttgtagactggactatattggaagattcttccaggtttggaattttgtggtacatatggagtattcacttttaaataaaaacgtacacccccccacccccnaaacacacacacacacacacaatgaaaactagcaggtnnnnaaatattctagcttattttanacttcatttgtcctgggaggctgaggcgggcgttaccagttgaggccaggagttcgagaccagcctggccaacatggtgaaaccccgcctttactaaaaatacaaaagttagtccgggcgcagtgtctcatgcctgtaaccccagcattttgggagtccaaggcgggtggatgacttgaggtcaggagttcaagaccagcctggccaaca

SEQ ID NO: 615750 - DNA, 106 bp, Homo sapiens
aaaacaccgtctatgtagctagaatagtgggaagattaataggtagaggcgaccaacctaccgagcctgttgatatctgtttgtcctgtataaaatcttagtttga

SEQ ID NO: 615751 - DNA, 383 bp, Homo sapiens
atatctacatacttagaaacgatgaatactgaaataatagggggtacatcaaaacacgttagtccaggggcagttgctcagacctgtgagcccagcacttttggaggccaaggcaggcagatcacttgagtctaagagatccagaccatcctgcccaagagggtgaaaccccatctctactaaaaatacaaaaattagctgggtgtgatggcgggaacctgtaatcccagctacttgggaggctgaggcagggagaattgcttgaacctgggaagcggagggggcagggagccgaaacgtgccattgcacttcagcctgggggacagagcgagactccatctcagaaacaaaaaacaaaccttgagtgatgatggacttgaat

SEQ ID NO: 615752 - DNA, 150 bp, Homo sapiens
cagagtccaaacagtgcccagagtccaaacagtgcccagagtccaaacagtgcccagagtccaaacagtgcccagagtccaaacagtgccatttaatccccaccctgggctctgggagcagcccgctgagtggactggagtggagcattg

SEQ ID NO: 615753 - DNA, 1448 bp, Homo sapiens
  misc_feature (894)..(894): n is a, c, g, or t
  misc_feature (1447)..(1447): n is a, c, g, or t
ggctcatagtgcccaggagttcttcgaacccgggtccggcggatttgttcctcgggagtgcggtgaaggcggtgcaccctgacgcgtgagtccttttattgactcggcccgcgtgccccatcactccagggtggatcctggctgcgcgtacatgcggccaagaattgaactgctgaggattcggtgagaggatctctgagcaggagtgcagtagacattgacgtgacacgcgtgaaagtatacccatatgtacacagtgtgctgtggctctgtgaacatagggagtggcaaatgggaggacattatcttggtgctatctagatgtagcatatggaggagacatgatgcgctggtgcatgggatcgagggataccatggatagatgtgactgattgtgtcagcgtaacaacgcacagaggtcaaccatgatggaccacatttatggagtacagcttatactggtcatgatggagacttttgtaagctagcctcacgggtacagtgtaaactgtaggcctaggaccaatgtggcgggaggtggtctcgatctagcgcgctctggggacgcaccgactggcagtttgtcattggacatcgtgggatgactggtggtcaactccacaacgtgtgtcccactcataacgatggtgctaccgcgcacgtcctcctagagagccaagcctgtcgttcgtgagaacctggctgggaccggtgaactgtaccagatatactcgtaatttgtaaagaatctctaatagtagatggggaatggattagcctcgtttttgaaccgggctacggagcgaacgcgtgggaaaattacaggtagctggcggaagacttcacaaggatcaaactgctagtgggatattgatatacggcacatggagactntgtgagaagattggagaatgtgtccaagcggggcggattgcgttccatataagtgctgtgaaagaaaaaaaagtaatcaatgggtttgctctcagcaattgagccataggggtaaatgaacgcgaattggtggaaattagagaacgagggaccagggttgatgtaatgaagtggcggtttacacaatggatattatatctgagggagttagtggaacctttaggagcgagtcacacaaaaacaaagcacttaacgccatcacacaacaaacactgacggccattaagcgaaccccactgaccaacatccacgacccaagcacaactccagtaacacgacgagagcaacaacagacaacacgaagagcccgaagaagcgcaacaagagaccgtctgggcacagaatggaggaacaggagccaccagaggaacaatatgatagaccacacaacagcactccacacaaatcgaagaacaggaggaccccaccatcaagcaacacaatgtactaatcaacctcggcccgacgacttataaatgatcgatattaaggnc

SEQ ID NO: 615754 - DNA, 250 bp, Homo sapiens
  misc_feature (43)..(43): n is a, c, g, or t
gctcgacactgctattcagaatatataaaagaggctgggcacngtggctcatacctataatcccagtactttgggaggccaaggtgggtggatcacttgagtccaggagttctagatcagtctgagcaacggcgcgaaactccgtctctacaaaaattaaaaaattagccaggtgtggtggtgtgcacctgtaatcccagctacttgggaggctgagacacaagaatcacctaaatgtgggaggtcgacg

SEQ ID NO: 615755 - DNA, 155 bp, Homo sapiens
gcagatatgacaaaaattatgcaataaaacggttcaggtgtatatccatatgtgcttccctatccctattaggaaagtacactgtccgcccaagagacaggatggacggacttcttccagacgctacatacaagcgcaagcccactggaatcacc

SEQ ID NO: 615756 - DNA, 233 bp, Homo sapiens
ccgcatcggagcacatcgcgtagtgcaggacacacggggcgtgggacggtgtctgtgtgagagcagcatctgtgtgtatgcagtgttatctaaggacacacccacagacacggacacgtccttacgcagagaacagccgctgcctcttagtgttcaggatgatacgtttttccttaatatcatccttcgctttgcacatcatactgaatacgtgtgtatgtgacttttactgc

SEQ ID NO: 615757 - DNA, 1004 bp, Homo sapiens
ctctactaaaaaaaaaaaaaaaaaaaaaattagccgggcattggtgggcaggcacctgtaatcccagctacccaagaaggctgaggcgggagaaatcacttgaatgtggaggcagaggttgccgtgtgtggggaaaagcaagaagagatcaaatgggccctgtgtctgtgtacaaaagaagtagacatggtgagactccatttggttctgtactaagaaaaattcttctgccttgagatgctgtagaccttaccccaaacccatgctctctgaaacatgcgctgtgtcaaactcagggttacactggatcaagggcggtgcacagatgtgcttggttaaacagatgcttgaaggcagcatgccccttaaagagtcatcaccatctccctaatctcaagtaacccagggacacaaacactgcggaaggccgcagggacctctgcctaggaaagccaggtatgggccaaggtttctccccatgttgacagtctgaaattatggcctcgtgggaagggcaaagacctgaccgtcccccagcccgacacccgtaaagggtctgtgctgaggaggattagtaaaagaggaaggaatgcctcttgccagtggcaacaacgaggaaggcatctggtctcctgcccgaccctgggcaatggaatgtctcggaataaaacctgattgtacgtaccatctacctcgcgactacgggaacaaacgcgccttaagacgctgaaggttggcacccctgcgctgcagccaaacgtcgtgcctatggtacacgcctttcacaatggcttaaatggtagtaaggcagatattaaagagagggcaacccaggacccatataaactcacctttaacccatggatactatagcatgcgaaacacccctatagggtaccacggaatgatatggacatagcaaggacaccctactacccccaacatactataggacctatagtagaaccccttacatcaacaatcccccccttctcagaggaaca

SEQ ID NO: 615758 - DNA, 308 bp, Homo sapiens
ctccaaatggaatccatctttcagtatgcttgtcggctgtttatctttggagaaatgtgtgttcaattcctttgcccattttcaaattgggttatatgcttatttttagagttgtaaaagttctttatatattgtggataatatacctttatcacataaatgatttgcaactattttctcctataagttgtcttttcactttctaggtaatatcctttgatgtgcaaaagttttttatttttatgagttccaatttatctatttttgtggttgttgctcatgcttttggtgtcacatgtaataatctg

SEQ ID NO: 615759 - DNA, 341 bp, Homo sapiens
agaaatttgaaccctcatacactgcttatgaggataaattatatctcagtaagatggagctgctttggaaagcaatctggcagttcctcaaaaagttaaatatagagttaccatatgacccaacagttccacttctaggtacatacccaagacagagaataacatacatccacacaaaaacttgttaatgaatgttcatagcagcattacttataatagccaaaaagtggaaataatccaaatatccatcaatttgtgaatgaatacataaaatgtgtttacataatgggaaaattattttccaatggaaaaggaagtggaactaattacaaggctacaac

SEQ ID NO: 615760 - DNA, 206 bp, Homo sapiens
cccactctcctctattccgaactgtctgacgtcctgtgcctgtcttgtccttaatttttaatatttttctatttggctttatttttctcttttcctcacttttgtattttatttatttttttttattaaaaaaaaaaacaagggggggcagcaaaaaaaaacccctatggaaaccctttttttttatcagcggggcgggcaacaca

SEQ ID NO: 615761 - DNA, 437 bp, Homo sapiens
ggtatatacattcttggccggcggttccgcagcctggattattcctggttgcagctcacctccttcctttacagtttttgtcaacagagccggcggcagggtatcatccaacggaaccgcacggagcgcctttccgaccttttggactggaaaaacctaggccgggtaggaccccccctttcctatcctttcctggcaaatcaacaggtcctggctaagggtttttggtgcagggggcagggtctcatcctacttggaacaggtgctgtccctttaaacaatgaaccaggccggtcgcgatggtgggtcatggttgtaatcccagccctttgggaggcctaacaggaaggattgcatgagctcaggagttaaaagaccagcctgggccacctttttttttttctaaaaataaaaaaaaatcagccgagaaaaaaaaa

SEQ ID NO: 615762 - DNA, 193 bp, Homo sapiens
ctagaggatcctgagcagctcgtgatctctcaaaccccagcacttctacaaaccacaactcctttccatcctaagcatggttagctcggtcagaattcttacacaagagccaggaccacaccctgtagcctttctgtccaaacaactagaccttactggttttagccctagccctacatgtctagcgtgcgag

SEQ ID NO: 615763 - DNA, 399 bp, Homo sapiens
tccggttcaaaagaacaacgagaggcagaaacgaagacattccactcgcgcgggcgagccggtagacatcacacagtacacactggccccatcgcccccactcgggcggggccccccaaagaagcgcctcggcccaggatagacgcagcgcaaaaggttgccgcacaagcatgctatacaaaaagagtggtcgcatgcccgcccctgcatggtgggaagaaacagaaccgcccctgcaataacatacagaggcggcatgcaaccgcggggtcgccgacacgccccgccggccttgtggagagcggaatgatggtttcaacgccaccagtgctcgcacgaaccacccaaccgcgggccgatggcgcctcaggaaaaaccaacgccccccccacaaataca

SEQ ID NO: 615764 - DNA, 672 bp, Homo sapiens
ttttggtgctgattgcttatcccagacatcaccaccatagccagccaatttaccagacttgactgcctcggcaacatcttctgcgacacaaatagcacctctagcggtattcaccaagtatgcaccatctttcatgtgggaaataagctttttattgaataaaccccttgagtccttgtgcaatggacagttgatggtaacaacatctgactgagcaaccatatcctccaatttctctactctctgaacaatatcacctctgccattgaaaagcttgctggcctcgttcaatctattgattgcttccgcaggtagttcctggtagtcgtagtacagtaacttcttcggattaaatgcgaccaatctttccagaaccctatatccaattctaccggcacctaccgttgaaattattttgtcttccagatcatactcattttttagccacgccggcaatatcccactcaccattaattgcttattgatgaccaccattatagtttcttatcaaaaccaaaattgtggccataacgtgctctgcgacagaaacgacgttagaaccagtaacttcggtgaccgtgattttccgttcatttgcagcttctaaatcgacatggtctgaaccgacgccagcggttacacagagcttcaggttaggagcttctgcaatcc

SEQ ID NO: 615765 - DNA, 183 bp, Homo sapiens
atacctgcgtgtactgcacatgtgtcccagtgcttaaagtataattaaaaaaaaaaaaagttctggtgcattatatgtaaatcttatcccaggtaaaaaagaaacagtaggatgtgagaaaaataaaggtttctactggaaatatggatggggggaagtaatagggatgtctggggattgggt

SEQ ID NO: 615766 - DNA, 251 bp, Homo sapiens
cagtcactttcctcctgcccacgatttgtccctgatgctgtcagaagatcccagctgatcacggccctttctctgcggtcagagggagaatacaggcgcagctctgcaggtccagctgttgcaggtgggatgcttatattcccacaggaacaaaggtctccatgatgatacggggtctctcatagtcatatcgatagcctgatggcccttggcataattgctggtgtcggggtagaagatgtcttggagtt

SEQ ID NO: 615767 - DNA, 937 bp, Homo sapiens
  misc_feature (201)..(201): n is a, c, g, or t
  misc_feature (210)..(210): n is a, c, g, or t
  misc_feature (268)..(268): n is a, c, g, or t
  misc_feature (286)..(286): n is a, c, g, or t
  misc_feature (291)..(291): n is a, c, g, or t
  misc_feature (298)..(298): n is a, c, g, or t
  misc_feature (305)..(305): n is a, c, g, or t
  misc_feature (308)..(308): n is a, c, g, or t
  misc_feature (315)..(315): n is a, c, g, or t
  misc_feature (317)..(317): n is a, c, g, or t
  misc_feature (334)..(334): n is a, c, g, or t
  misc_feature (336)..(336): n is a, c, g, or t
  misc_feature (345)..(345): n is a, c, g, or t
  misc_feature (937)..(937): n is a, c, g, or t
gtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgnagcccaggnctgcgttgtatgctttccatccactcaccttaccccatagcatcttgcggcccagaanccagagccatttgtctcngaccntaaatcnataatcncanaccccanancgggagagagcagtganancatgcaggnctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaaaaaatcaccctacactctccacactactttacaattcactgggccgcgtn

SEQ ID NO: 615768 - DNA, 118 bp, Homo sapiens
gttaagtcatttccattttaacgttatgaacaaagctatccagtgcacaggagcccagatggccgacataggaactgtgagataataaaatttttttattatattttttttatttttt

SEQ ID NO: 615769 - DNA, 114 bp, Homo sapiens
ctcttgcttgggacggcggcatggtgctctcagaaccactctgtggcagagagcctgtctgtgagggtgtatcacagtgcagggtcattcagaagacttgaggcaggctgatgt

SEQ ID NO: 615770 - DNA, 255 bp, Homo sapiens
tgacgaaccgagctcgtacccctttctagcgtctacgacgtaggacagacggcacagagcattcccagactattgatggtagtatgcatattatatatgctttaacactatataagtctggattctttcagaagcatgtgagataagcccaattcaaacttttagacaaaaataaagaaattttatttcttacaaattgggaagttcaaagggtaaccttctttgagcacaggtggacgtcatcgaagaaccaat

SEQ ID NO: 615771 - DNA, 127 bp, Homo sapiens
gcactaaactgttacctcaacccaatccgcctggaccgaacttttcattcaccgacatcatactatagtccgataagagattttgtatagccttccccatcaattattgttcatttaagcccaccca

SEQ ID NO: 615772 - DNA, 1495 bp, Homo sapiens
gggggaacaaacaaaaaaacaaaaaaaaaaaaaaaacaacattggtcggcgcgcgcgcccgcgggcccccgaagaaagtatttttaaaaccacactcagtggggaggcgcggggcgcccaagtaagaaagaggagaaacatggcggctcgaatacagctgggtgtagcacatagagagaaagaacacgtgcgcggcgagcgagaaagaccgggcgtggggatggtcttcaccacaatatacaacaaaaacgcgccggggcggggaaaacccagagacgcggttccgtagaacagaacatctccagagagtggagagagatacttggaggggagcgaactacaggggagggaggagttatctaaaccagagggaggggtagcaaaccgagagagagcgccgcgagatatagtatcaaaatatataaagagcgcccccggcaccgggggggttgggtggaaaagaaacagcaaaagcgaaaaagacgaaaagcaaaaagaaaagaacaaagcaacagagaagcacaaaaacaaggggagaggagagaggggaaaaagcggaagagagagggaagaagggagcagagagggggagagggaagggagaagagaggagaggggaagagacagagggaggaagacggaaggaggaacggggagaaggagaggaaaaagaaggaagagagagaagggacaggagagagaggaagaaaagagcaagagcggaggaggagaagaaagagagacaagagacgagaagagcgagaagaggacgaggaagagaaacaaaagagaagggaaggaaaaaaagcaaggacagacaaaggaaggaaggaagcgacagacaaaggaaaaggagaggaggagagaagagcaaaagagaaaggcaaagaacaaggaagagagaaggaaagaaagaagaaaacaagcaaagcagggcaagacagaagaccgaagaagaggaagaaaagagagagagagaggcgaagacggagagagaacagaaaagacaggaagaaacaagagaaagagaggagagagaaaccggagacaaggaagagagaagggagagaagacagagagaaggaaagaggagagcaaggagagaagaagacggaagagagagagaaaagcagaagaggagggaagaaagaacgaacagaagaaagagcaaaggaggaaggaagcaaacaaggaaagagggagcaaagagaagaagagggagcaagaggagaaggcacggaaggagaagagaaggaggaaaggggaagggagcaggagagagggagaccagcaaaggcgaagggaagaagaacacgagcagggagagaggcagggagcaggaaaagagagaggagaagagaagagagggaagggaagaagatagggaaaagcagggaacagagagagaggagaagggagcggagaaggagagagagaaggaaatagaagagaagagagagggagagacgagagaagagaaggacgcgacagggag

SEQ ID NO: 615773 - DNA, 414 bp, Homo sapiens
aacactcatcatttccccacctgccctcgctgtggcgacacacaccgtgctgagcgctttctcctggctccgtaacgaggtgctccgtgcggaggcatcattcctctttccgtctcagccagccctgtgctggccgcctaccctcatgaacgggcgtctttgtgctggcaggcgctcttgttgccccccagatctccctgtgccctgtgaggttggcctctgtggaccgccatctgacgcccctgatctctcccagatggtgggacgacgtgggggggctgtaacatccctttctgcagctccatcagtgccaagctcagccccccggttggctctctgggagtatgcgctccttcgtggctccggcgtcctgtcgctcctggatgtacagtggctcccgatagggtcaggcct

SEQ ID NO: 615774 - DNA, 712 bp, Homo sapiens
  misc_feature (182)..(182): n is a, c, g, or t
ttctctcccattacacataggttgtctcagcatgcaagagtttttcctttaaaaaaaaaaaaaaaaaaaaaaaaaaaagaaggttttttttaaaataaagagggggggagtattttatcccaagatgttttatcttttttgttaagaaataaagttataattttttttaaattttggagagngaggggatcaactccatgttcccaattggtctattgtgtctatggtggtgtatggtggccatacattatgtttcccctttgaaagaccgcgcttgtgccaagttctgcgtgggagggagcactcatgttgtggacgaggcaggggccattgtgaccctgcagggctgggggtcgtatatacgtggcacgcttgggagggtgggaactctattctcacacttttctagtgggagccttccggagtcccagggtttccacttggagggcctggtcctggtgctgggatgggcgggtttcaagacctccaataaaaatccctacccaggaattctggtactcgcgggggggcgttctctctgggttataaaccctttttaccagggtgacaacttcggataccaccctgtgggttgccatcctcgcgtggcggtaaacatcctggacgtacctcaccggcagaaatctggactgtcggcaatcccttgcccggactaccgtggcggctccacgctacacacaacaaacaaaag

SEQ ID NO: 615775 - DNA, 186 bp, Homo sapiens
gtgacaaggccccttccctgcaaacatggggttggctgggccagaaggttgcgatgaagaaaagcgggccagtctggattcggcaagaaggaatttacttcgactgttacctttgggatttctccagctctagacaacctcaaagactgtttttcctgtctgtttgcctaagtgagtagttgctcc

SEQ ID NO: 615776 - DNA, 1474 bp, Homo sapiens
ggtgtcgagcagcggacgcgggtctctgtgccgcaggatgcggggcctggtgtaaaggttgttgacaataaggcctactttaatagataccaatgtgacacattgaaaacgacgacggacgagggtaaacaactgcttgtagtgtatgctcgcgaaacggcattgcgttgactacatacgattaagaagataaattagctaacctatcacgccgaagagtacaggactgcaatagttccggtgttgaccaaacaagagcatactcaattgtgtcagatctgggtgtatgcccagtatacgacgcggggactatgattagtcttgctcagcggtattgccacgacggaaaacctcgactagatagctatagcgtgttggacacggtctgggacctagaaacatattgatcgctcgcaggtatatctgtacatcggcctcgcctgctgtggcacctggtagcgcttctccaatgactgcttttgtgcccaatggggaccatatgcatccttaatcgtagacgtgggccaatagcttgcgaagggtgcagttgagatgaaatgaacactaccagacggttgggccgacatcccaatacgaagtgggtctcgcgcccaagggtggctgggttcccccacgtcgtcgtaatatgtatgtaatgggaccgtgtgcgtatgaaaccagggataggccatgaggccagttaggtaacccatttaggacgcttctaaaggggcgatcgctccattgcaaaaaagggccggctggatggcgagttgccacaagactcatggggctgacttccagaattaaaaccacgataaggcatttaccacgatatctaacgcatcgagtttgaggtgaagaacgctaacaccaagggcaaaggcggatagagcactaagagtgggctggaacaacccttggtcacaagtcgtgtgaggaacaacaaaggagtattaaccttgtgggggcaatccacaccctaggtatggcatcgatatattgcccacttcgaaggcggtagctttctatcttcgggacattcaaccgacctaaaaggcaacctagcgtgtagaaattgggatagacaacgattgggtacaaaaagacccccgaagtaacgaaggcaccccttgtcgccttgacccttcttggggagcctggactcggccaggggagaattggtcatcaaagaaagacgccttgccatgtattatttggcttttaaggaggtgacccaacggcatttggaaggcttgaagtggcccattgacatccaacgtttagggaagtgaccaagggttgaaacccgacccaaggacaatgttcagggtatgcaacttcccaggatcgaatttcgactaatgcgcaccaagaactcggagactgacattcgttagacatcacgcctacgcaggtggtagggaaccactttgaaggggcgtggcttacattctatgtttagaagatacta

SEQ ID NO: 615777 - DNA, 206 bp, Homo sapiens
cccccagttttttttttttaaaaaatagggcccgggcccgcgggttcatgaggtcaggaaattgagcccttcctggctggcccggtgaacccccccattcaatggggcggtcaatccagtatttttaaggcccccggtcagctgttttttcccccttcgagggttgtgattaatttaaaatcaaaataaaggaattactgggttta

SEQ ID NO: 615778 - DNA, 106 bp, Homo sapiens
ggaaggaacgagagtctgtgaagaggcgcggaagaaactgggcccagatccccgcagcagcagtacaaagttttttgcctccagagcttcgagttagagcactaaa

SEQ ID NO: 615779 - DNA, 245 bp, Homo sapiens
agaagacgaggcatccttcctctcgtacgcagtgttgatggacgcaggcaggcccgtgcagaactggccaatgggcattgtggtatccatccatcacgttggttattgcctcacccgccagtaaccagcgtctccttgtaagatcaaaccatcgtcccactcggcagcatggcgcacgggtgtcagaagttccctgtctacagatgttgcggcccaaaaggtggtcctcgggttgggtaccgagg

SEQ ID NO: 615780 - DNA, 275 bp, Homo sapiens
ctcacactgcgcccggcggagcaccgaagttggcagtgtctcttagcagctgcgctggagacgaacggtgagcctgcatcattgcaggaacatgatgtgtaaatatgatcttttaggattacgagtgcagatggaagagcccctaggctcctccatgagagaacattcatctccccctatagaaagacatcaagggaccctacgtttccatccacagctctggcttccgggactatatggtgaagccggagctcctgcgggcgcactccgtgagg

SEQ ID NO: 615781 - DNA, 453 bp, Homo sapiens
atttaaaaaaaaaagaaaaaaaaatcctaaatattttctttaaaaaaaaatcccttgccaggcatggttgctcacacgtgtaatcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggaggctgcagtgggccaagatcctactccagcctaggtgacagagtgagatcctatctcaaaaaaaagaagaaaaaaatcctgcagggcacagtgactcacacctgtaatctcagcactggatcacttgaggccaggagtttgagaccagcctgagcaacatagcaaaaccctgtttctactga

SEQ ID NO: 615782 - DNA, 1005 bp, Homo sapiens
  misc_feature (56)..(56): n is a, c, g, or t
  misc_feature (549)..(549): n is a, c, g, or t
  misc_feature (626)..(626): n is a, c, g, or t
gtgcgcaactacaaatataaactaatcttataataaaccaaataacaaacaaagcnagaaataagtagtatgtgtcgacagtctggctgtgcccacaacattgtcggcgctgtgatagctcgccgtggttggagagcaggcttgttgtgcggtgctgtcgcgtaatgtggtgcaggagcgccctgtgtccttcgtagtgggccaggtgtccccggcttatgtgtgggccggttaaccacatatcaacggggttcgaaaaacacactgtggtggttcggaggaagcttcgggcttttcgaacttgcccgttgctctctggttataggcgttcttccctgcccagtgtgtagcttccgcctcataattcgccctgcccagattggggagaaacatttaagggtctgatccgagggttcacggaggaacagaatttctgggtggccacccacgagtgggcccaaatggggttaggaccccggctgcccgactcttaccgagtgtttctaagagggcgcagaaatttattctagtaacgccaggccacgttcntgatcagcgagtatgtctccgcacttagtgcctcgccaataatttcctcgtgcaccagaagtgatcgttcctccaantctgttaaagtagcataagataaagtgcacccatttttggaaggaccccccgagagcaacccatgatgcggcgattaattgggggtcgcacgccataacaccgcacctaacaatgctatggttcaactcttggcgatagtggcttttaacaatgacgtgtgcccagtgggttcaccgcactactatcctgagtgccgcccgcccattatgataaggagagacttattgtattctctctctgtgcggggccctccatatataaatacatactagtgatgttttggggacgccaataattatagattgagatgacgatcaccgaggggaacataagaaaaaacccccatacaattccaaaattcttcgggcaaacataaca

SEQ ID NO: 615783 - DNA, 407 bp, Homo sapiens
tctgctagtcgatctctagagtatcccgtgcagtcttctgaattcttgctcatttagtacccgtaaccccatcttcatcctcaatgatatcaagaccagaaaatgggatcgcttcatattggattgactagagtttaaatgcttattatctggtctcttttgcacgttctgacttgtaacagccgaggtactgtgtcctcggcatctgaatccaacctgtgaattatttctttgttcagtttgccttccacctctagaaaatgtctgatttttttccatccaaggttttttctgagttgcctggcaagttacattggaccaatttacaccacctgcacacatagatgattccacatgattcatggtcccagaatcaggatttctcaaagcccctgctgcaggctggt

SEQ ID NO: 615784 - DNA, 1038 bp, Homo sapiens
tccgatgggatgagcggatggcatgaggacgaacgtgcgcgttgtcagtcggcggaggtcggctgtgtagcgtgggcgagctcaggggctgtgtaggtggtcggtatggttggctgtgcagtgcgtggtggcggaaacgtgaggcgactgctgagcaagtatctgattcccatgttgtccctcggttaacccccagtttcggggaaaaacacgctgtccgctcctcttcgctggttaagccgcctcccccgcgagtgctggtgtagcagctctcctatttggagccgtttcgttcctccccaggcgcgtgagtgtcggggtcccccccgatgtcctctgtctggcgaggggaatccgcgccgcccaaaacttggtccggtggacgccataccctctgttagcggagggtttatccgcatttcgcgttccccgaaaactatttgcccgcggggatttgtgcccccccttttcgggccgcgggcggaacacataacatcgttacgtgcccccagagaggcctctcgttgctcgctagtatacaattcttctctggcgcggcgcgttaatattacacctgtctgttgtgcgccgcaccacacgcactctgttattcgcgactcatactgccgcgcgataagcccaccgcagactggtttaagcttcgtggggtctccctcgcgcagttattaagccagccccctacgtggtaacatcccggcctgtgctctcctgtgtagcgacacactcacctttgtcgcatacacgcacgcgtaatgttcttatctcatagtcactgaagtatgagaaacccacttggcttctagataacgacgaaattccttaatacttacaacaacctccccctctaccaccggtggggtaccaaaatcggaggcccccccccccatcccacccctcttttaacaaacccctaataaccataatatattttatgccacaaaaagggaagaggatacacccccccccaaggtggttccaaccaaccccccggccccccatacttttttcccaaaaaaa

SEQ ID NO: 615785 - DNA, 119 bp, Homo sapiens
tcagctcggtacctattggtgatggttcattgtccggatagtatatgtaagaggatagctattagaaggattatggatgcggtagcttgcgtggcggaaatacttggggcgctcctgcc

SEQ ID NO: 615786 - DNA, 503 bp, Homo sapiens
  misc_feature (229)..(229): n is a, c, g, or t
  misc_feature (231)..(231): n is a, c, g, or t
  misc_feature (242)..(242): n is a, c, g, or t
  misc_feature (297)..(297): n is a, c, g, or t
  misc_feature (430)..(430): n is a, c, g, or t
ctgtgtgccccaggagacacttacctttacatggcccgaagactctggtcttgcatggtgacaattgacaatcttgggactaaccccaagataggcaccccaaggtgttatgtgctttctaggcttaacctaagtgtttaaccattgttcaactaagaaggtatatatttaatttgaaggaaggaaccaaccattttatttaaacagagtcctttgggttgtgggcgananaagcgcgaganaccgacacagttggcgacacggtcaacggcggcaaggtggggcttggttggaacnaacacaaaaatttctcccagagaaatattttggtgggcggcttcccttatattgtggcgagtgcgcggcaagcaagaggacacacggggggcaagggaaacacttttgtgggcacagattcaaggtttatatnattggcgctatataggggaggggggattaagacaagaggcgtctatcactattcggctatccgttctcgcggg

SEQ ID NO: 615787 - DNA, 985 bp, Homo sapiens
  misc_feature (10)..(10): n is a, c, g, or t
  misc_feature (89)..(89): n is a, c, g, or t
  misc_feature (98)..(98): n is a, c, g, or t
  misc_feature (142)..(142): n is a, c, g, or t
  misc_feature (184)..(184): n is a, c, g, or t
  misc_feature (220)..(220): n is a, c, g, or t
  misc_feature (226)..(226): n is a, c, g, or t
  misc_feature (257)..(257): n is a, c, g, or t
  misc_feature (266)..(266): n is a, c, g, or t
  misc_feature (429)..(429): n is a, c, g, or t
  misc_feature (467)..(467): n is a, c, g, or t
  misc_feature (483)..(483): n is a, c, g, or t
  misc_feature (518)..(518): n is a, c, g, or t
  misc_feature (540)..(540): n is a, c, g, or t
  misc_feature (570)..(570): n is a, c, g, or t
  misc_feature (594)..(594): n is a, c, g, or t
  misc_feature (654)..(654): n is a, c, g, or t
  misc_feature (711)..(711): n is a, c, g, or t
  misc_feature (750)..(750): n is a, c, g, or t
  misc_feature (758)..(758): n is a, c, g, or t
  misc_feature (783)..(783): n is a, c, g, or t
  misc_feature (785)..(785): n is a, c, g, or t
  misc_feature (814)..(814): n is a, c, g, or t
  misc_feature (819)..(819): n is a, c, g, or t
  misc_feature (857)..(858): n is a, c, g, or t
  misc_feature (888)..(888): n is a, c, g, or t
  misc_feature (896)..(896): n is a, c, g, or t
  misc_feature (906)..(906): n is a, c, g, or t
  misc_feature (923)..(923): n is a, c, g, or t
  misc_feature (956)..(956): n is a, c, g, or t
gccacacgtncaggtgtagactgactacattgagtatcgctccaacaccgaacttcccttaacggtttaaaaaaagggtcatgagtgtnaacacagtncagcagtgttttcatgggagaacttaaggcaggcaggaggacancctcctctctgcccaggaccaccacgggagttctaggcactncacctcactgttcttcagaaagcggtaaagtgagcnggggcnaggccggtaatcaagggggccagattgagcnatgccacanccttcctcctagttcccatgccctcctgggagcctggaagccctgcttacttccgtttgtgttttttcttttgttccttacgttgctgttctctttggtccttcttcatccttgagttcaccaccttgaaatgacccctgattccagcgggccggcgcacttngcggcccaaaccttttttggctacaacgtaggtgaaanggcgtttctccttgcnaagcccagccttcttgtagagacttcgcagctgtnccactttctctcgttctgagangttcactgtgttcaccacggcttctgcctncttcctggtctgctccagcctctncagcatcctccttttctttctagccttagcctcagccaccttcttgatgggacgtgcatngatttcccgccagcgtttccggtaatgctccaacttcttcttaccaacaggtaactnttgtatccggtgctgcttttcctcttgcacaaaccactncggaagcnccccctcaccctcattaaatgtgtncnggttgaaggagttatctatgaggtctctnttggnctttttggaagaggcattacagccccagagcaaggctnnggggtcagtttcgatgttcgtgggtctcanaggactantaagaccgtnacatctgattaggccangctcgctcttacaggagggtgccagcctttctnctcatgcagtctgcataatgttgagagca

SEQ ID NO: 615788 - DNA, 150 bp, Homo sapiens
cgatagccttatgatcgtattcgtggaagcctgtggtttacatggtatgtgaaacgtaatgccgtcggaaatggtgaagggagactcgaagtactctgaggcttgtaggagggtaaaatagagacccagtaaaatttggcccttatcgag

SEQ ID NO: 615789 - DNA, 1503 bp, Homo sapiens
agcgggggatatgatttgctgctcgagtgcatctgcagggtctggctgaatagtcgttcgaagaccaattctgaaaagtgtatgctggccgacgaattagttattggcctccgactttaccttccaggcggtagagactctggactgagagtggctttcacaatggcaagggatcagtaacttgcaggacaccaagcaaagtatcagaaagcaaggaaatctgtatgatgtccaattccaattataaatatcccggcctctccgttatatgcaggaagctaggtttggacgggggaaaagtgtgtacctattgacacagatctccaagaggttggtctcattctcctttgggctgtaaagaaagattaatcctatattgtaatgatcatatatcgaagttgtgtatcaaaagagactaattggtattgaagctaagatttggaaaagccttcatcatccaaagcattgtgggtaatcgtgctttttactgaagcaatgatggcagtcttgtggcttggctattggaatatgggggtgaaacagtctctaaatgacttaatagaaagaacgattaaagcaggcaagaatcttttcaagaggcataattcacagttgctggaaattggagcgcgctaaggatttgtccagaaaaaatgtcatgggacaaagttacagttgaattaaggcgttgaaacacaaatgtgggggggctcccaggggaataatggacccgcacatgtcgttgtccggacaacccaggagggggtagtggccacctattttaacatcaaattatattattaataatttatttattatagttttttttaaacacacccgacgtaccctcacacttcgaccgtgcaccgccgcccaacagcagtacaccgccaaagactgcctagacacatacagagactcatacgagcccgacgcaagagacgaatagataaagacgaaggtgctgtagtaagagcgagcggagcggggacaagaaggagaggcagaacagagacacaggagcgcgccccagccgcacgacagacacgagacagaaacgaaccgtcccttaagcacccaacacgacgcgtcacgaacagccgcgccagagacagcagtagagcagcgagagaagcaaggaaacagagcttcctcagactgcagcactcaggaaagtagatgagcacgacgagaaacagcggagaacaccaaaccgagagaccacgaacacgagccagacagagcaggaagagcaagcagcgcgcacgtgcagaagagaaacgacccccagatgaacgcgaagcaggacacgaccacagcaagacgacaaccgaagacgcggcgaccacaacagacacgacgcccactagaagcgaagcgtcacgagagcaaaccgagagatgcgaaagaacaacaagggacagcacgcaagcaactcagaccggcaaccgcagagaacacgaagaaacgaggcacgaagagaacccagagcaccgcgccaac

SEQ ID NO: 615790 - DNA, 325 bp, Homo sapiens
  misc_feature (21)..(22): n is a, c, g, or t
  misc_feature (33)..(33): n is a, c, g, or t
  misc_feature (66)..(66): n is a, c, g, or t
  misc_feature (84)..(84): n is a, c, g, or t
  misc_feature (110)..(110): n is a, c, g, or t
  misc_feature (123)..(123): n is a, c, g, or t
  misc_feature (174)..(174): n is a, c, g, or t
tgaaatacccaccccccaaannatttataaatnaaagtacgggccgggcacagtggctcatgcctntaattccagcactttggnaggccaaggtggacagatcactttgngctcaggagtttnagaccatcctgggcaacatggtgaaacctgtctctacaaaaaatacaaaanttagctgggtgtggtgttgtgcacctatagtcccagctactccgaaggctgaggctggagaatggcttgagtccaggaaatggaggttgcagttgacctgagatcgcggcacttatacttcaccctgggcagcagagtgagatcctgactc

SEQ ID NO: 615791 - DNA, 214 bp, Homo sapiens
  misc_feature (53)..(53): n is a, c, g, or t
ttttggaaaacttgacttatcttcctcataaaagaggagaaccagataaaagnccaattgcagtaagttcccttatgccttttttcagtgggacagtttccagaatattaaacaattgttaaaatgtgaaccaacaaaaaatagattttggggacctagttactgccagaattttattatcagggtttactttataaaagatccttttttgata

SEQ ID NO: 615792 - DNA, 746 bp, Homo sapiens
  misc_feature (442)..(442): n is a, c, g, or t
  misc_feature (488)..(488): n is a, c, g, or t
  misc_feature (543)..(543): n is a, c, g, or t
  misc_feature (550)..(550): n is a, c, g, or t
  misc_feature (604)..(604): n is a, c, g, or t
  misc_feature (613)..(613): n is a, c, g, or t
  misc_feature (656)..(656): n is a, c, g, or t
  misc_feature (672)..(672): n is a, c, g, or t
  misc_feature (710)..(710): n is a, c, g, or t
  misc_feature (732)..(732): n is a, c, g, or t
ggggtgatcaataaacattatataatgaacacttccccgtgtcatccaaaagtttagaaaaatcttagtgattataagtgacttccagttttcttgctaatttggaaagaacgttatattgagcatgtttaccttcatccttttctgtatttctgaatattttcttagaatatacacctggaagacaaatttctggaaaagaagttactgtttcagagtatgttaagttttaaaagttgcttaacttttctttttttaagagaattttttccacttggtattcttactagtaatgtttgaaatacctaatataattgaaaatgtttgaatttgctaagttaaaagggatatcactttgatgacatgggattacattattttcctgttgatttattaagtatttatatgtcctttgaaatttttttggcggtggcattctttntattttaatatataaggttttgttactttttgataaacagtctttntacatacaaaatttattactgtttgcccatattatagcaaacatagtttcctttntactatnaaatcttgaagggttgtgggagtttttcatatacagtgggttaaaaatgtttangtacatatnatggatgtttacattctttcatggtaagtttatggtagaaaantaattactaataagcngaagttattctaccctaatattctctggtcggtgactngtttacacttagcggatacctntctagatattttct

SEQ ID NO: 615793 - DNA, 133 bp, Homo sapiens
  misc_feature (112)..(112): n is a, c, g, or t
  misc_feature (120)..(120): n is a, c, g, or t
gggtcgcgacaggtgcgctaggtagagcgccgggacctgtgacaggctggtagcacgcagaggggcgggttttagccagtattcatgtctgtagacaagatggtcatctccnttataganggcccatggactc

SEQ ID NO: 615794 - DNA, 843 bp, Homo sapiens
cacgtggtgactcacgcctataatcccagcactttgggaggccgaggcaggtggatcacctgaggtcaggagttcaagaccagcctgaccaacatggagaaaccccatctctactaaaaatacaaaattagccaggcgaggtggctcatgcctgtaatcccagctactctggaggctgaggcaggagaatcgcttgaactcgggaggtggaagttgcagtgagccaagatcacgccactgcacttcagcctgagcaacaagtgcaaaactctgtttcaaaaaaataaataaatgaattttaaaaagtaaaaagggccaggcgtagtggctcatgcctataatcccaacacttgtggaggccaaggcgggcagatcacaaggtcaagagatcaagaccatcctgccaacatgatgaaatctcctctactaaaaatacaaaaaattagccgagtgtggtactggcaggcctgtagtcccagctactcaggaggctgaggcaggagaatcgcttgattcctccaccaggaggcacaggttgtagtgagctgagatcgacaacaaatccagcctgcaacagagtgagattccatctccaaaaaattactaattcaacataacaaattaaaccaaaacaataaaaagcaaggtgggcatggtggctcaagcctgtaatcccagtcttctgggaggcaaagcagggggttcccaaggtcaggggtccgagaccaccttggccacatggtgaaccccgtctactaaggtcaaaataagccagctgggggtgtggcgcgtgaaccagcaacaaggagggggtgaagaacagaatgtttatggccccaccgg

SEQ ID NO: 615795 - DNA, 295 bp, Homo sapiens
ggtcgacaacggcgcatcgaccacaaacttgtcggtcaccacgatggacgctgccgcccggtcggtatgcacctggtaggtcacttcggtcatgccgccgtccttgggcaccagcttccagaagtcttcgacctgggcgacacggacataacctttctcttccggcaggtaggtcggcacttccttgagcgtgcgggtcaggctgccgtcagcgcccttggtggtggtgatctgcaagatcgagtcacgatcggtgaccgggaacggtgccttgaactgggtgtaggtccagctc

SEQ ID NO: 615796 - DNA, 307 bp, Homo sapiens
gtttttttttgggggccccccgaccctttttggaaaacccgcccccgttggtttttcccctgccccccttgaatgggtaagccccccccgggcatggcccgtcggggcaaagttcccaggaaaccatttttgcctgatggcccccccccttttggaacccccttttggttgggaagggcccttttcccccgggcttttttgtaatagaaaccccggatataaggtttccaacccccttggggttttcccccggggggtttttttttttgaatttgggttttttaaaagaaataaaaagtttaaggta

SEQ ID NO: 615797 - DNA, 3418 bp, Homo sapiens
agttaaaacaattttttaagagaaaggagataaccagagcatagccagcagaaggactcgcatgaggtttggtgggactgcctagggagaaggaggcagctggctgcgtgacagagcccagtgataggggagggcctgtgaccccttaaggagctgagacgctgtcacagagcaatgggagcgctgagtgatggagctggatttgtgcttttagaaaagctttgttggctgctgttgggagaatggattggaagggggtgagactgcagtcagagactcccataaggtagctgttactgtaatcacaacaacagatgcctacactccttcccaagacttccctctctgatcttagaagcattgtcaaatctgggttcccagcctgccatggcaagctgcttgctacttgggagtgaaaagcccttgtggagctttttcttattcggtgactgctcataaagtgccttcacctcgcttgccttattagccagtcctgcctccaaattaccaccacttgctcctttcaggagtctcttccccctaaagtccctattactccttctctctgctttcagatcagtaacagaaaaagtcaccttccctaagagtctgctccagtccagtagaaatgctttaaaatttttctggcctcagctgcccttcttgagcacagaaatttctagaatattgaatgaatcactggttctttataatcattttgtccagtttcaatcactgcattttaggaaagatttgaaaaactgaaggacaaagtggggccttagaggacttaggattctttcagaggaaagtaatctaaagaacaagttaatgtttcttcatcgtttgggaattagttattaaatggaagatgcctgaaaaattattctcttaatacagttcttcaggaggacagcattaaaaggcctggaattaaatagccacaaggcacatttagatgacacagcaggaagaactttccagtaaaaactattgaataggataccgtgttcaggcagaagtcaggagactctctttaggagagctgagaaataacttgagggggggggccacatctgggggaggattttataatttttaaatctcttaaactatacagctttgagatggaatgattaagctgagcaggcatttgttaacatcctgaaatacgatttccatcctgtccctagagcctgcccttggggtccactgtagactggccttctagaagaaaccgccttataaggctctcttggatagttcagtgacagaacacccttggatggagtccaaggccagctagccttcactgattcaaaattcctccctacagtggatgagattatgatgcttcctttacctcaagccacccctaccccacaaacaatctgacctcatctgtgtttttcattgttagacaaataacatcttgtttttagcagctggggaaccctgaattatcgtcaaaagaatttttaagccagggaatatgagtgtaacctttatttgaaatttaggagtggcacaattagaaagctttgaaatggaaggagacttaggtatatgtgaattaataagcccacttatttaaggtaatttcaaagatttcccagtgagtcttttactcttatgtggggatagcagtggaggactagaaatgttcaagggaagcttcccccagcctgtcatatatggcttttccaggtcaatcaagaccgtctcctccaccaggcctctgagagaaaatgagatcagaagaaaaaagccaggatgataatggggggagggggggaaacgtttacttatttattttttttacttaaaattgattgtgttaaatagttgacctctgttttatcccaagttggattaatggcaaaatgatatggcccttttgaaaaagctaatgtgttgaattgcctttactgttttacagaggagagcggtcaaagttaattagaaacagctggagctaacagtaagcctcacccccatcaatgtccctaccaggagagggttaccagggagaggagcagtcccgggaatccagggaggggcctctggtcccaaaagcaggccagagttgcagagaagttttgtgtctgaaaaataagaaaggttcatttcaggtgaaacagacctaggaaccctgtgttgacaaagccccattcatatggtatgaagttcccacagtaaagagcactgacaaggccaaggccaacccgacaggttcaaagcaggcttggccactgtgaaaaaacaaccccctcaaaacttcaggagaatgtatataataaatgaaggtacaatttcataccttcacaggattattgagaaggtcaaattacataacagatatgaaagcactgtgtaaactatgcggactatgctgcaccaaataactgtaaagaattattaactagactgtaaatgccttgagggcaaggaatgcatctgcaacgggtatttgtgaagtacttgacagtttgctaaggacttctgtggattttcctcatatgctactcataacaaccctggaaggtaaggggaattgttatcccaaattccaaataaagacactgcaggtcagacatcacacaggtggtaaatagcaattctggtacttactttagatattctgctacaggcttgctattcaaagtgtggtatgtagaccagcaacattgactctctgtgctatctttcttttttataaactcggaattatttcaaaataagaagtttctaacaaaagagattcagaagagtcaaacccttgggtgtgaaaaagttttaggaagactttcctgaatttattttgcctatattttgtttctgatgaatgagcaagggggttatatgatatatttgtgtctaaatacatctaaaagagctctttcattcgcataaaataaacatgctgtatgataacaaagtttatgtcagagttgagatggctctttatggtacatatatgctgtgccttctaaaaaatgtcatattatattcagtgaaagatgatgtttcttaaaatgaatgaatgtctctgaggtggccaacattagtccttctatagccagattagcaatcttagagcctggtcaggcacagtggctcttgtttgtaatcccagtactttgggaggccaaggtgggaggatctcttgagctcaggagttcaggaccagcctgggcaacatagtgagatctcatctctactaaaaataaaaatgaaattgttaattggccaggcacagtgggaagcacctgtagtcccagctactcaggaggctaaagtgagagggtggctctagcacagtcatcaaggctgcaggaggctatgatggagccactgcactccagcctagatgacaaggtgagacgctgtctcaaaaaaaagaagagaaagggaaaga

SEQ ID NO: 615798 - DNA, 493 bp, Homo sapiens
  misc_feature (44)..(44): n is a, c, g, or t
aaaggaaggagcaaacggccattgtgtatgcagaggtggattanaaggtaagaaatcaggggattaaagacttgggtgggtaggcatctctcaggagccccatctccgggggtgtcccctcctgggcagggttttgggaccctctgtgggtgacgcacaccctgggatggggctagtaaaaccttcaggcgcctttgggggtggactttggggcactttagtggacaggaaaaggaacgccttccaggaacctgtggactaagggtgcagggacttccctttgcaaggggtaacagaccgctggaaaacactgtccctttcaaagctcggtggctcacagggtgtcctgccccggttttcggacgaaaaaaatttcgggccacaagcatccccccatccctttcagggtgggggctggggatgttgcattttaaccttttgtatttattccctccccttttgcaggggtccgtgcggggtgaaattaaaaatt

SEQ ID NO: 615799 - DNA, 103 bp, Homo sapiens
catgcgtcagtgcaatctgtgctgcaagtgcacaaagtgacaacgtgctgaagtgacacgtgctgaatgacgtgctgaagtgacaccgtgctgaacgtgacaa

SEQ ID NO: 615800 - DNA, 626 bp, Homo sapiens
  misc_feature (31)..(31): n is a, c, g, or t
  misc_feature (77)..(77): n is a, c, g, or t
  misc_feature (565)..(565): n is a, c, g, or t
  misc_feature (567)..(567): n is a, c, g, or t
  misc_feature (570)..(571): n is a, c, g, or t
  misc_feature (573)..(573): n is a, c, g, or t
  misc_feature (577)..(577): n is a, c, g, or t
cccgactagcccgacagcatccacaggtcangccacccctcttcctgtcaccagcccttcctcagcatccacaggtnacgccaccctcttcctgtcaccagcccttcctcagcatccacaggtcacgccacccctcttcctgtcaccagcccttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 615801 - DNA, 400 bp, Homo sapiens
ggatcctccgggctgcaggaattcggcacgagaaaggacatgttttttttttgttgttgttgtttttgctaagtagtattgctgtacatgtgacacttttaaattcaatttagcattaataggctggacacggtggctgatgcctgtaatcccagcactgtgggaggccaaggtgagtggatcatgaggtcaggagatcgagaccatcctggacagcataatgaaaccctcgtctctacagaaaatacaaaagttagccggacggttgtcatgagcctgtagtcccagctactcgggtggctgaggcaggataattgcttgaacctgggaggtggaggttgtagtgagctgagatagtgccactgcactccagcctgggaacagagtgagacttcatctc

SEQ ID NO: 615802 - DNA, 329 bp, Homo sapiens
tcagacgctgaactatgtgtccacaggtcacgctacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacagccacccctcttcctgtcaccgacacttcctcagcatccacaggtcacgccacccttcttcctgtacggacacttcactcagcacatagttcagcgtctgagcagggatcct

SEQ ID NO: 615803 - DNA, 355 bp, Homo sapiens
  misc_feature (292)..(292): n is a, c, g, or t
  misc_feature (299)..(299): n is a, c, g, or t
  misc_feature (303)..(304): n is a, c, g, or t
  misc_feature (307)..(307): n is a, c, g, or t
  misc_feature (315)..(315): n is a, c, g, or t
gtaagagtgaaaccgtgtctcaacaacaacaacaacaacaacaaaaaagatttctttttcgtggccaggtgcagtgtcggtgacaccacccctcttcctgtcaccgacagcttcctcagtatccacaggtgacaccacccctcttcctgtcaccggcccttcctcagcatccacaggtcacgccacccctcttcctgtcaccgacacttcctcagtatccacaggtcacgccccacccctcttcctgtcaccgacacttcctcagcatccacaggtcacgccacccctcttnctgtcancagnnctncctcagcntccacagtatcctcgactcccctctgaagtgtacgttatg

SEQ ID NO: 615804 - DNA, 4663 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgacgcttcctcagcatccacaggtgacaccacctctcttcctgtcaccgacgcttcctcagcatccacaggtgacaccacccctcttcctgtcaccgacacttcctcagcatccacaggtgacaccacccctcttcctgtcaccaacgcttcctcagcatccacaggtcacgccacccctcttcatgtcaccaacgcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcgtcacaccacccctcttcctgtcaccgacgcttcgtcagtatccacaggtgacaccacccgtcttcctgtcaccagcccttcctcagcatccacaggtcacaccacccctcttcctgtcaccgacacttcctcagcatccacaggtcagacaccacccctcttcctgtcaccaatgcttcctcattatccacacgtcacgccacctctcttcatgtcaccagcccttcgtcgacgcggccgcgaatttagtagtagtagtagaccgccgctc

SEQ ID NO: 615805 - DNA, 462 bp, Homo sapiens
  misc_feature (5)..(5): n is a, c, g, or t
  misc_feature (22)..(22): n is a, c, g, or t
  misc_feature (48)..(48): n is a, c, g, or t
  misc_feature (66)..(66): n is a, c, g, or t
  misc_feature (101)..(101): n is a, c, g, or t
  misc_feature (114)..(114): n is a, c, g, or t
  misc_feature (122)..(122): n is a, c, g, or t
  misc_feature (148)..(148): n is a, c, g, or t
  misc_feature (449)..(451): n is a, c, g, or t
  misc_feature (454)..(454): n is a, c, g, or t
aaggnattccccgagacccagnaaggtttccacggccaggcgggccancgtcccctttggaaaccncctaagttcctatcctaaagggtacgggtatcctnccccctacctaanggcaaaanttagttccatgttcctaatgttcccngtttgacataaaaaaaagtttgagtattttttatacctgagagcgtatacttgctgcccagatttattaaatgatggagatagaaaaattgaagccaaaatactttatatttgatttgatttgagttctcatatatagaaagctacattttaaccaatatcctatttcccctaacgtgcatttgacttacaggtaataagcttcataacatgtttaattattaattttttaatacagttggccctccatatctgtgggttctatatccatgggttctgcatccatgggttaactgcaaaannntanatgttctg

SEQ ID NO: 615806 - DNA, 623 bp, Homo sapiens
agttaaaacaattttttaagagaaaggagataaccagagcatagccagcagaaggactcgcatgaggtttggtgggactgcctagggagaaggaggcagctggctgcgtgacagagcccagtgataggggagggcctgtgaccccttaaggagctgagacgctgtcacagagcaatgggagcgctgagtgatggagctggatttgtgcttttagaaaagctttgttggctgctgttgggagaatggattggaagggggtgagactgcagtcagagactcccataaggtagctgttactgtaatcacaacaacagatgcctacactccttcccaagacttccctctctgatcttagaagcattgtcaaatctgggttcccagcctgccatggcaagctgcttgctacttgggagtgaaaagcccttgtggagctttttcttattcggtgactgctcataaagtgccttcacctcgcttgccttattagccagtcctgcctccaaattaccaccacttgctcctttcaggagtctcttccccctaaagtccctattactccttctctctgctttcagatcagtaacagctacctttccgggaccaactcgagtgtatatgtatat

SEQ ID NO: 615807 - DNA, 104 bp, Homo sapiens
cataggggccatagcttctgcctccaaaattcctcccttcattggtccaaaatttgaagactgatggttttacttcccaaaatcattgtatcttccgccaacac

SEQ ID NO: 615808 - DNA, 4619 bp, Homo sapiens
  misc_feature (4558)..(4558): n is a, c, g, or t
  misc_feature (4560)..(4560): n is a, c, g, or t
  misc_feature (4563)..(4564): n is a, c, g, or t
  misc_feature (4566)..(4566): n is a, c, g, or t
  misc_feature (4570)..(4570): n is a, c, g, or t
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgacgcttcctcagcatccacaggtgacaccacctctcttcctgtcaccgacgcttcctcagcatccacaggtgacaccacccctcttcctgtcaccgacacttcctcagcatccacaggtgacaccacccctcttcctgtcaccaacgcttcctcagcatccacaggtcacgccacccctcttcatgtcaccaacgcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 615809 - DNA, 136 bp, Homo sapiens
caaagccctagacccattttttaaaaatttattggttttctactataaaatgaggatgctcaatgcttgcactaccagataggtagggcaagcatggagcatcctcattttatagtagaaaaccaaaaaaaaaaaa

SEQ ID NO: 615810 - DNA, 4426 bp, Homo sapiens
  misc_feature (4365)..(4365): n is a, c, g, or t
  misc_feature (4367)..(4367): n is a, c, g, or t
  misc_feature (4370)..(4371): n is a, c, g, or t
  misc_feature (4373)..(4373): n is a, c, g, or t
  misc_feature (4377)..(4377): n is a, c, g, or t
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgagcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 615811 - DNA, 174 bp, Homo sapiens
tgcagatccactctacaccacgacgctggtgcctccgtgttggccacactctggcgtcactgactggtttgactttcatgcggtgactatgcatttggtctgtactgatcatggagtcaacccatctctctttttttttttttttttttttttttttttttttttttttttttt

SEQ ID NO: 615812 - DNA, 4441 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgacgcttcctcagcatccacaggtgacaccacctctcttcctgtcaccgacgcttcctcagcatccacaggtgacaccacccctcttcctgtcaccgacacttcctcagcatccacaggtgacaccacccctcttcctgtcaccaacgcttcctcagcatccacaggtcacgccacccctcttcatgtcaccaacgcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctccccttcgtcgacgcggccgcgaatttagtagtagtagtagaccgccgctc

SEQ ID NO: 615813 - DNA, 472 bp, Homo sapiens
  misc_feature (228)..(228): n is a, c, g, or t
  misc_feature (350)..(350): n is a, c, g, or t
cccaggctggagtgcagtggtgcaatctcagctcactgcaacctctgcctcccgggttcaagcgattctcctgcctcagcctcctgagtagctgcaattacaggtgtgtgccaccacacccagctaatttttgtattagtagagatggggtttcaccatgttggccaggctgttctcgaactcctgacccgccttggtctcccgaagtgctggggattacaagcgtgngcaaccgcgggccagccttcaactttgcttttttactttaacgacatatcctggggatattagttccaatgttccattaaatgttaaaggcttaactcttcttttattttaaaaaaatggantaacatggagatttcccatcttaggcacaattattttaaaatccatttcccccgccaatgggaaggttggggttgttcttgatcttgtttttgataacaataaggcattgacatagtattac

SEQ ID NO: 615814 - DNA, 3809 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgagcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacaccacccctcttcctgtcaccgacgcttcgtcagtatccacaggtgacaccacccgtcttcctgtcaccagcccttcctcagcatccacaggtcacaccacccctcttcctgtcaccgacacttcctcagcatccacaggtcagacaccacccctcttcctgtcaccaatgcttcctcattatccacacgtcacgccacctctcttcatgtcaccagcccttcgtcgacgcggccgcgaatttagtagtagtagtagaccgccgctc

SEQ ID NO: 615815 - DNA, 250 bp, Homo sapiens
tggaccatactcatgctcttgagacctgtcaacaggttggctcttcagtttgtggccacaccttcctacagaacttcaaaggtgatttctgtggaccctctgcctggtgtgtgaccttggtctcaattcttgaagcttcaccagtgaagtgcatgcagtccgtttaatgccagttgagggaatgcttcagaaatttgatgaccagtgtccccgcagtgcaagtgggatccatcgtagatgtctgaccgtg

SEQ ID NO: 615816 - DNA, 448 bp, Homo sapiens
  misc_feature (237)..(237): n is a, c, g, or t
ctgggcggctcagaaaattaaacccagacttactacccatttccaccccccaccaacccccttctagggcctactttaaaaaatttaatagttttctatggaacggatctaaaattaaaaaatttatttttcctttatttccattataaactttaatttacatgactctaagactataaaaaaatctgagggcagtgacaagttgctagcatttatggtcatctaataaagacctgngagcatatgtgcaccttatgagtgtatcagtaatggcatgtaatttgggccttggttaaagccgtgacctggtaagaaattgaacattcaatttctttttccaaggacgagctataaaaaagctatggagagtatctagtcacccagtgcagtattgggaaccctggctggtgtatggtgaggtgctccggggcttgggaaggacttaatc

SEQ ID NO: 615817 - DNA, 177 bp, Homo sapiens
gtgtacacatagagaatcgtctcaacaaaaaagtaattttagccaggttctgtgagctgtagtcccagctacaaggtgggaggatgcttaggcctgggtgattgaggatgcaatgagctgtgattgtgccaccacactccagcctgggcaatacagcaagactttccgtatggatgc

SEQ ID NO: 615818 - DNA, 663 bp, Homo sapiens
ggcacgaggagataactactatcccgtctcaccgtgaaagctgtcggaatgcaaattctcaccatcattcatacattgaagcccacataaagaaggccacatggttgaccaaattgatgaattttcccggttatgcctatacacctactctatgggaacatcagacgaatggccgggggatggggggacggctgcttcgcatgtgcgtgacgtgcatgcaaggctcttacatggacagtcatgagccgaagggagctgggtttgccggggcagggttgtgaccttgctgagtacaccaggtcgcctgatgcggcccgtgggcggcgggggagggggcctgcgggggggcccggggggggggggaggttctacgggccctgaagctttggtgtaagaggctgggcaggtgctgggccttcctgggggctggtgggggtcttcagacaggtccagtagagcccgggcgaaggggaatgtggtagggtgagcatttgtggaacctggtcgcgatgaagtgccaggcggggaatcggggggcgctgtgcgccgagggtgctgggccgtttggggcggtgccgatgggttggccgggagattgtgtgggtggaggggttgaggggatgcgggcgcggggaggggtgtggtgagggggggcgagggggg

SEQ ID NO: 615819 - DNA, 442 bp, Homo sapiens
  misc_feature (383)..(383): n is a, c, g, or t
tgagcatctgtgcttcaggactctctaggttctaccatcaagacagagaatggtgtgatactcaggttaacaaggtgagtccaggagtgttgccctggaggcataaaacaggggcccagcctttggagataaagcatgctctggtcctaaatggcagcaggagaagaatcttcccaaagtgagagtcaggccacaatacctcccctgggaggacgtctgtgcctgtgtatgttggagagagaaggagctttttcatcccaagtgagtagagaggttacatcctctgactgcttccccctctctctgtctttctctctctcctgctgtgaaggccaagtatgacttcacagaatccctaagctccataaatcagttctagatcncatcccttgcagctgtaatgaaagcaggattttaataaaaactggatacttctactgtt

SEQ ID NO: 615820 - DNA, 155 bp, Homo sapiens
gagcttatgaatcgacggtttctaacctttgaggttaagtgtcctctgtcacacaggctggagtgcagagggcaatctcagctcactgaaactccgcccactacaacctccgactcccaggttcacgcgattcccctgcctcagcctccacagta

SEQ ID NO: 615821 - DNA, 444 bp, Homo sapiens
cccgtgagtacccttctgcacgtaatcgttcatctggttcatggcctaatcggtgtcacaggagtttctagtcaaggcttctgagtggctcagcttcttccagtcctacacagccttatccactagctgcaggtccgcggtcaggaccaggccattgtcggtggtcagctgtagatggctgtctggctggttgagggtatggagaagttcctggaagccttcatggatctgagcctgggcaatccctgtcaggttgaaatccagtgccctccaggatttcatcgtaagtgtcagcgttggtcctcagggagagcagtgcataggctgtagcgatgctcactggggagaagatcatattggtcctgttgcactggtgtgccagctgacggtataggctgaagtcgaacgcatacaggtgtctggtggtcatgttgaaggttgggt

SEQ ID NO: 615822 - DNA, 489 bp, Homo sapiens
gcacgagaacatctgtggtttctactggggacagagtcacgggtactggccaattcttctgtggtttattgccttcctttgtgattgaaggagatgccaatttttagttaaaggtttgtgaaaataaagatgtaatttttttccccatccaagctcaaggaccctctgaattctgtccacagagtgcttgtgtctctctggaccagattaagaaccttggggccaggcacagtggctcacgcctgtaatcccagcactttggggggccgaggcaggcggatcacttaagttcaggagtttgagactatcctagacaacatggcaaaaccctgtctctctacaaataagctgggtgtggtggctcatgcctatagtctcaactactcaggaggctgaggctggaagcttgcttgaacctgagaagtcgaggctgcagtgaaccatgatcatgccactgcatgacagaacaagaccctgtcaaaaaaaaaa

SEQ ID NO: 615823 - DNA, 252 bp, Homo sapiens
cagagatgatgccactgcactccagcctgggctgacagagcaagactccatctcaaaaaaaaaaaaaaggttgttgaattcaggcagggctttcaaaatcccgggccaaggtgatttggaaactctggggcccctgggttagggcctttctaaggcccgtgcaataaccctcttcctcaattaagcatgtgggcaatgtctctaacttctcttaacccagttttaacggggcgggtgtaagacgctttaacc

SEQ ID NO: 615824 - DNA, 100 bp, Homo sapiens
actgtatgtcacggttacctgctgtagaggaagaaggagccgtcggagtcaagctctgtccacggtgagcttgctatagaggaagaaggagccgtcggag

SEQ ID NO: 615825 - DNA, 144 bp, Homo sapiens
cacgaggaagctcttaactgctgccacgatcctagctgatgccacagccaagatggtacaggttgccatgggatcagctgcccaccctgacagtgaggagcatcatcagcggttgctggaggtatctgaggggctgcgcatggc

SEQ ID NO: 615826 - DNA, 350 bp, Homo sapiens
  misc_feature (1)..(1): n is a, c, g, or t
nttggcttctgtgaatacccatataggaatatagggttaaaagttgggcaccaatatcttctctgttctccattaagcctcatgtaaatctcacaagtgtggttacacaaaatgcctttccccaaggccagaagtcaaaaccttgtgggcccatatatatatcaagttataggccattcatatatctcatagattaactcttttttttttttttttaaggtgaagtttcactcgtgtcgccagtgtgcatccatctataaaaaaaaaaaataaataagcacaacactttcactattcacatactaagcttgtgtgtgtccaagtatgtgacctcggcatatctacagccg

SEQ ID NO: 615827 - DNA, 264 bp, Homo sapiens
  misc_feature (61)..(61): n is a, c, g, or t
  misc_feature (67)..(67): n is a, c, g, or t
gcgtcagacggaggcctatgtaactggaatggaatgagtgaagtgccaagtactgggaganaagganagcaggtcagggttgtcagtagagggtgctcctaccaagccttattagactgtcactttgcagttcaattatagcataatcatactatttttcttcagttagcaataggttgtttgaaggcagaatctgtgtgacggtcattttgtatttcgacatccagcactgcaacacgttaaggcttaaatgtgtggtcgacg

SEQ ID NO: 615828 - DNA, 1425 bp, Homo sapiens
  misc_feature (164)..(164): n is a, c, g, or t
  misc_feature (1084)..(1084): n is a, c, g, or t
ccatcttcattcgtctgtcgattattagtgaagaagatttgatggcatggccttgatcaaccttccatgactgacaagatgtcgtccagctaatcacttcattgtagtcctctcacgagcgagattcgcgtaagggcgctcaatccctggtccgctatgtgatntaggaactattccttatactcctccagctcttactcttgattcggccatgctaccagggagtatcgtactgcgagtcaattcctgaattgaagtgcaagccttagcgcgcaaagctagagtgggatcgtaacaattcaagacattcgtaacacctcttcgataataccaaaaactcacactcatactatatgtaccaaaagatgcattttgataagtgcatcaataccctagggaacttattgtctataacttaggatcagtaccttattaaattcctataatttggtaatttccggacgcgaggcacaccttctaagacctcaactttccgttttggctttgcttgcccttttcaacttccatttcaattgaaccccacaatggcacaactccacattctaacgtctaacttatacatccagtaagacactagtggagtccctagttgcggcgcgctttaaagtaggatggcggagggccagacccttatgaaattatccttaggagacctttgtgctgtcgttcctaagactggaccttttagactatgggagtaggtcgcccatgagtagcggctcacttttcacgtgatctcactcacacgcgcggacacatttcctaatacatgctaccctattagttccccccaataagcttaggtttgactttacttgggaggatacttcatttctagggcccttagccttcggagttggcaatctctaggttaacgctcagctagggtcccgtacaggcgccctgagagtcccgtttgaaaatctattttaagttaggggaaggggctcggaacataaaactactgatatggcggtcgtttaacttgtgtggggaagggcacctcagagcgctttgttggccatttgagtgtctcaaaggcgcctcttttaagagacttttntccccgtagatataaaaaggtgtggaggtcccaaactattcttcccgggaagataccgtagacagtcgggtagccccgggaagaggagactccccccaggaaagaaaatcgatgtgggcgcctgaccgcgtggaaaacccccaactagccccgaccgaggtgttgctgacgaccccactcgaagcgcaagagcccaccatgagccggggccgccgaaagtacccccggctgccgcaccacatgctgacaaaacaaggaggagcgaggggcgacccacaaaaaacatccaccacccgaggcgcagccaaagatcgcggagccgcacagaagcgtcgcgcgaa

SEQ ID NO: 615829 - DNA, 861 bp, Homo sapiens
tcagagcctggctgagacgggactcccggaggagctttgcaggaatgttgcaaggcccggagcttttttctcaaaaggaagatgtggtcattgtgctgcaccggatgccaccctgatttcgggattcttaccacacaccatgctgtggttgttccttggtgccgctgatggcaccccaaggggcctctcctgccaaccccctggtgacacgacaccactgttcccccgacccatctctatttgagcccagaccacaggctttgttagaactcactctggactgttacgtggccactggtaggttgggaccacccagggccagaaagatctcaacgcctctcctgaaacatgacatgtgtttgccaccgtgcttttacatgggaccagccccgagcctgggcgtgccccatccatgggagcccccacgcccgatcatagggatagataggaggacatctggactggaggcccctggagcccagatggcaaaagggtgtaccagcttcctttcctgagtgtacatctgtcacagattcctttagaaaaaatggatgcccagaggactcccccaacctggcttggggtccaagaaaccaacccagaccagagtttaggggacttagggcactgggctgttgttcccattgaagaccgactctggcctggcccttacttgcttctctagctctttaggcctctcccgtttgcacctgtcccccccctcccatcagctgtcctgcagccaaccctcccccctccaccgttcccttttcccccccttctgcagcacctcccggcctgttgctatagagcctaccctgtatgtccattaccacagctgaagccaaaaaaaaaaaataa

SEQ ID NO: 615830 - DNA, 1049 bp, Homo sapiens
gcagcagtgcctgtggtgcaccctggagccctgagggcctggttacctcagccgacggggactcacctggagcgcccagctgggcccccatcacccacactccttcctggccctacgaggtgggtcccgcagcccgcgtgacaccccaccggcctgcacatctgtggtgcctgcactctagcctgcaccatgtactggtctcgggagggcttgcagtgccagacctgccagtggtgagaccaccccacagtggacctctgcatgacctactgcaacgtggattgggtgacgtgccaggggcaccgaaacagtggcacagctgccagaggatggtgaggcctggaccttcactgcggcatggacccacagccttccagccctggacgctggagtgccgccaaggctaccttgacggcggcccctgggtgcttgcggtgggaacccatggcgctgacgaaggcaccctggcacctgtgccccaagaggcacacctgatgcatgcattgcgaccagcggggacttcccgagggatgccagggcccaagcagcttggacacgatgcagaccttggagccctcagaggtgcttgctgtaattgcacactggctgacccctgaccaggaagccagccaggcaagcacccacgtgggcaacaggcttgaacgcaccctggggtcagttatacgggacatagcacccaatagcaccacatgccttgttggcagctggggaacgcggagagaccccacggaccagggttgccccctcattcaatcccagtaaagatgccggattgagaggaggaatcagcagacgcgcgacagggaccctgagcggcgcgcaagatagaaggacatttgaaaccacggcacatatcggatgggcgctccagcacgggtcagagatggaacagcaaaacggaaggctgtcacgtgagcattgaccctatggaaggcgggacacacagcgcggcaaaacggctcatagccctactcaatggagtgaaccttggaacccgccgaaatattcacagatgaacataaccttgg

SEQ ID NO: 615831 - DNA, 402 bp, Homo sapiens
cgagccgccgctttggtcacagtgaccgccaccgttgccgggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaagaccccgaggaggacagaacacctcgagacaggatcgcctggggacggcagcagcgggatcccagcctcaggcgtgcgcggacggtgtgcggagtctagctttgtaccaggctgcagtgcagtagtgccatctcacgctcactggcaaccgtcgtgccttcaccggagttacaaggcggattggtacctagcacttcagacccttccgcgaagatcac

SEQ ID NO: 615832 - DNA, 899 bp, Homo sapiens
gctcgagtattgtttttgaagatagagtctcactctgcaggcccgggctagagtgcagtggtgggatctcggtcactgaacctctgcctccggtgggttcaagtgatcctccgcacctcagcgctcctgagtagctgggataacagggcgacccgccagccaggtccagctaattttatatatttttgagtagagacggggtttcaccatgtgggtcagcgcgggtcttgaactcctgacctcaggtgatccgtgggcctcggcctcccagaagtgctgggattataggcgtgagcctcttggcccggcctttcctttgtcctctcctctcctgccgagagtggaccacgcgtgtcctgggagctgcatctgggtgatagggagtccagcatgcattatgggggactgcgaggaatcatcctcccctgtgggcccgtggacgtcggagacctggggccttcgcccacgctcccgtctcggcttgtgcctaacggagccccaaattccaggcctccagtgtgcgcatggtggggttcccagatagcgcgcatgctccattgtggaccttccaatgcagggcccatacggaccataccctgtctgacatgagagagacgcctgggggtaccccaaaaggcccaattggtgacaacatctcccaggcataagggccaatttggcgcttatgggcagtatcccccggtgacctggtcaccatttccccgagacccacactaccccttcctagatgccccttggaaagggcttccgggcacttatgaggtgtgaccccattggggatgtcaacacactgggtagcccttgaccttgatatgaccccagtttagccattctcaaggggagcccacagctggaggggcccttgaaccctgggactg

SEQ ID NO: 615833 - DNA, 241 bp, Homo sapiens
atcaggcgagacgtggcgctttgtgttgaagaggagccggtgtctgtccagctgtttctctacttccagggtcaccgtgtctcttccccaccgactgcctgttattgagacgttgtctttgtctttgtagttttgggtcacctctctcccccaccgtctgcctgttactgagacgttgtctttgtctttgttgttctgggtcacctctctcccccacagtcttcgcctgatgggtaccgag

SEQ ID NO: 615834 - DNA, 540 bp, Homo sapiens
  misc_feature (114)..(114): n is a, c, g, or t
  misc_feature (202)..(202): n is a, c, g, or t
  misc_feature (228)..(228): n is a, c, g, or t
  misc_feature (343)..(343): n is a, c, g, or t
  misc_feature (378)..(378): n is a, c, g, or t
agcagtacttattaatcatctccaagcatatcctcactagattctcattaattacaaagggaaaaatagtaacttcagaatggataaccccagaaggaaccaccataactaacngaccaaagctgatgcccgcaatcaagagacaaatcaatatcatgtatctcatgaaacaatacacgagaaagaacacgctttctttttnggcatttctaccaaaatacacagccngattctaatcataaggaagcatcacatgaacccagttgaaggatacttgacaaaacagctgacctacactcttcaaatatgtcaaggtcataaaagggcaagacagaggaacaangctagattaaagaatatgggccaggtgagatgtantcccagcacttggggaggccaaagcgggcagatggcttgagcccaggagttcaaggccagcctgggcaaggtggtgagacatcatctctacaaaaaatacaaaaactagccagatgtggtgatgcatgcctgtagtcccaggtactcaggaggctgaggtgg

SEQ ID NO: 615835 - DNA, 378 bp, Homo sapiens
ctagaatgcagttgttagcagcagcgaatctgcatgggtctgcagcaacctcaagtctcctcagaagaaagaatttgaccaaggggcataaggcagaaggagagacccgggcaagcttcagagcaagagtggaagtttattaaaaagcttcagagcaggaatgaaagaaaagtacacttggaagagagccaaacaggtgacttgagagatcaagtaaaacctcattaacgtaactgcaacaatgaagacattacctagacgtgctggcttcctctttgccttcctccatgatgtaagtttcctgaggactccccagccatgcttcctgtacagcctgtggaactgtgaaccaattaaaccttttttctttataaatta

SEQ ID NO: 615836 - DNA, 635 bp, Homo sapiens
  misc_feature (351)..(351): n is a, c, g, or t
  misc_feature (384)..(384): n is a, c, g, or t
  misc_feature (468)..(469): n is a, c, g, or t
gcaggaattcggcacgaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcaattttgaagcttgacattttagtttgccattatgttatcctgtaaagcagacatcgttcttggcctgccctgcattgtatactagatttcattggtgtctctcatgcttcttgagttgcttcatggtttatgctcgccatggaaagctatcagtaacagtttcatgcttataccanagaattaaatctgatctttaatatctgatattntcctggtactcgtactgataagggattattggaagtagtcacagaatttggaataaatctagtctctcctagctattgatgctnntatatagccaagactcatgcaaacattttgcaggataatgccgatttgtctatgacagtcatttagctgattagatactggagctatttaagcatgaaagcactgactcaattgctgcttagatgctcggaaatttggataagggttcatttctggctactataag

SEQ ID NO: 615837 - DNA, 533 bp, Homo sapiens
  misc_feature (45)..(45): n is a, c, g, or t
tgataccttatagagaaaagtgtgaattcaggtggagagtaggcncaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgccttttaaacagaacccccagtcacattcgggtcaaggccatccggagcttgttccattccagggttttgttggccctttgtttcccccttaacccacagctgtttgtgtttcacatatgttgtgaatttcccttggttctttttaaaggattgatattaaagttacttgctttggaaaaaaaaaa

SEQ ID NO: 615838 - DNA, 332 bp, Homo sapiens
ggggtagtgggtttgtaatcaacttctgagagtacctcagtatgttttggatccccatcctttatcaggtgtgtgtctaacaaatatcttctctcagcctgtgcttgcctatcattctaacatcttacagtgctctgcagtgcgtcactactcctgacatagtagacactcacacccacctcaatccactgcgctgcaccatcacattagctgctctggcccccaaacaccacagcatactacagaaaatcaggctgtccaagtgccctcatcgttgccgtctcaggcagctcagtgcggcacagtggagcccaataatgcacgtgcacgtc

SEQ ID NO: 615839 - DNA, 277 bp, Homo sapiens
gccattcagacttgaggaagacccggaaacttagggggccacggttagccacggccacggccccaataggcaagcaccaaaagcacccccgcggccgcggggtaattccttgatggtctcaataccacccggaaataaccttgacaaaatgaggtctccttgacctctctttatttacacagcgcttggagggatggggcaggaggagagggctctgccctatacacaaaaggttatgaaagcacagcccccttctatctctcgtgttttaccacgg

SEQ ID NO: 615840 - DNA, 224 bp, Homo sapiens
atgctgttagcaccgcgtatctcaacgattcagacaactccactgacggatacacggagatgatcatgcgatttagggttagccatgcagtagtactgtgaacatctgtctgttctttagagatcccggaacttgcaggatttgatatatgtgagtctgctagagcacttgctagtttgattagacaatcagtaacgggatgaggatacatgtgtgagagccgc

SEQ ID NO: 615841 - DNA, 169 bp, Homo sapiens
aatgggaggaggcgccgctcagcccctcaccttgaatcattaaaaagcggcgcctttgaaacaagcagggcttcagaaggtgcccgctggccacagccaggttttcccaaaaaaaatgttattttgttgggttttgttccccccccatctcgattttggtacccaacta

SEQ ID NO: 615842 - DNA, 958 bp, Homo sapiens
gcaatgcttgtccctaaagtcaggaagtaccttgctagtaagacactacctttgaaagttctttgatactggacaatgcccctggccacctaaaaccccataaattcaacaccaaagcgatgaagtggtctctgtgctcccaaacacaacatctttaattcaggaataagggggtcataaggactttttagatccattacacacagtactctggaaaggactgtcaatactgtgaaagagaaccccaagagagaacattatgaacagtctggaaggaatgattatgccatgccactgaaaatgccatcattgttacagaaaaagctgtgaaagccaacaagcccaaaacaataaattctggctggcgaaacctgtgcagatgttgtgcataacttcataggatttacaaacagagtcaatcaaggaaactcatgaaacgagatgtggatgtggcaaaaaaagtggggtgtgaagggttctcaagagaaattcaggagctaataaaccccacaccataggaatgaacagatgcatctgttgatggacgacgagtgcttccaaatcagtgcacagatgatgaggaacaaaacttagaagcaatgcccaaaggaacaaaggatgctggtaatgacaaatctggacaggcaggggtccacttattccaaggctgcttcggaacttctttttaccaacatggactccattctaatgataatggcaatgaaaattaaggcacacagttaaacgaaagatgggtaccatcttgaacgactttagacgactgacaccgcccagtcccttcacacgcactctgaaattgaacaccgtgctgctctgtgctccctcagcgggcacctgatcagcgaccaacgttcgtccccgtctccggactgcccgccttgaggcacccctcagcggcagctccttggactaaatggtgcaccggaatatacaaaag

SEQ ID NO: 615843 - DNA, 895 bp, Homo sapiens
gccgcacgttgaacaattcttggcgggtagtagggcgcccgccaaccaagaacaacaccggggtccttttaaccgctgcaacatggcagcattgcttgggcgcgagcctggagcaccccccgcccccctccggtgcgggtaggacaatcggcgtctcgtagccaccactgtgctccaagctgcagcgatcgctggggagcaagtgcgactggtcgcaaagtgcaaaagtgcgttgtactgcgagcaagaggcgtcccacaggaacgcacccgtgcccaaaaacggctgagtccccgtcccgcgtggggtgggaaggggggccccccgtgctttggtgggcatccaaagggcgcgactgtcccggcctttcaatatgctgccctcggttgtttctagatagtgtgtcttcctccctgccccggcacgcacgcttgttgtccctcctcgcggcggggaggtccctcggcgcctcctttgcttgagaggccgactcctcgttgctggtcaggaacagtgtacgcttcgtgactgatttgctatctctcgctatctaagggagcccctcgccgcgcctctctcctggggtgcttccagcgcccacgcgagtgcccaccagttttctggccccccctgtttcccgcgcgtggtaagacgcgtggacacacaggttgttgtgcgcacaggctctcgttgacaccaagcacttccctgccggtcagcgtgccgtgtggaccggcacacttggttgactcttgtgtcaccgacgtggagacacaccccggagatccccacccctctggggggaggctcaccaaggggagcgtgcgatctccatggcgcgtcaggggttcaagacaccccccctccggccaaaataggcccccctttcgcaaat

SEQ ID NO: 615844 - DNA, 314 bp, Homo sapiens
  misc_feature (16)..(16): n is a, c, g, or t
  misc_feature (25)..(25): n is a, c, g, or t
aaaccctggctttacnaaaaatacnaaattatccaggcatggtggcgtgcacctgtaatcccagttactcgggaggttgaggcaggagaattgcatgaacctgagaggtggaggttgcagtgagccaagattgtgccactgcactccagcctgggccacagagcaatactgtcttaaaaaaaaaaaatcattgggcaggccaggcagagtggctcacacctgtgatcccaggactttgagaggccaagggtggtggattgcttgagcccatgaggctgagaccagcttgtgtggcacggcaaaaccccatctct

SEQ ID NO: 615845 - DNA, 122 bp, Homo sapiens
  misc_feature (11)..(11): n is a, c, g, or t
  misc_feature (33)..(33): n is a, c, g, or t
  misc_feature (77)..(77): n is a, c, g, or t
gactctgctgntcctgggcttgcatcccagggntcccagagtggcctgcctatcacaaccacatccctttccccccncaaggcaataaatctcatttctttataaaaaaaaaaaaccccaaa

SEQ ID NO: 615846 - DNA, 333 bp, Homo sapiens
  misc_feature (43)..(43): n is a, c, g, or t
  misc_feature (67)..(67): n is a, c, g, or t
  misc_feature (99)..(99): n is a, c, g, or t
  misc_feature (117)..(117): n is a, c, g, or t
  misc_feature (304)..(304): n is a, c, g, or t
aaaaagaaaagaattataaacgggcataaataaaatgtttggntgtaagtagggtgcgatggctcanacctgtaatcccagcaatttgggaggctgaancgggaggatcacttgagncccaggagtttgagaccagcctgggcaacacggtgagacacccacctctacataaaaatgtgaaaattagcccaggtgtggtggcacacactgcggtcccaccttctcaggaggccgaggtgggaggatcgcttgagcctaacagtttgaggttacagagagccatgatcacgccactgcccccaancctgggcaacagtcaagatcctgtctcta

SEQ ID NO: 615847 - DNA, 374 bp, Homo sapiens
atcaagaccatcctggccaacatggtgaaaccccatctctactgaatacacaaaaattggctggacatggtggcgcatgtctgtaatcccagctactgtaatctcagctactcgggaggctgaggcaggagaattgcctcaaccgggagcggaggttgcagtgagccaagatcgcaccactgcactccagcctggcaacagagcgagactctttctcagcaaagcaaccaaaaccagttaggctgggtatggtgctcaccagcacttagggaggctaggcagtggatctctgagtcgggatttagccacctgccacatgtcaacctttcttactaaatacaaatagcagcatgtgcgttcatatccactacttg

SEQ ID NO: 615848 - DNA, 1125 bp, Homo sapiens
gatcgcaaaggtagcatccagcggtagggcgcctgcaataccatttcctggtctgcttctatctatatgtgcattcagccgactataatgtctttagtgcctgatatagaagagtctcgctagaagtaccatactaagtagggcagacgatgtgtaatccaatggttgacactaatacgagtggcagcccgagatagaatcgtggtctagccagaattgtccagcgtaagaaccatgcaatacgcaaccataatacctgaatatcccaagatccatagtataactaccattctgcgtaagtagcagaatccctgagacgcacaaaggaattacgccaagatggtcgccatcaaatgcgggaaacgaaagtgaaagtgaaacataagctagtgagagtcttagggactgtggagcaggtacttgcgaccattcttgataaatgtgtggaagatttagagagttgtaaaaaggtgagcgttatgcccaatatatatgagccatacacacgatcttggagtttgatattctatgctagtcctgtgtaaaacgatagatttgtacgtcaatgcactatttcgaatccgggtgaatttagcccatccgtttcctttaagatagttctactctctttgaatttgcccttgataaaaattgtttatttttggccaagcaattcccaacaattccttcgtttcgggcattccaaagcttgtggtctctaaattgtgggttctttccagatctcatccccaagtaaggtacaagcccctcaaacaccgattgcgaacaaaccctgttcccaggatagaatagcgcgggggccacgaccttgtgaacagcgcacggatggaacgaacgttaaaagctggggtaacctaagattattgaaataagagtgttgtggcaatatggttattgccaaggtgtaaccattatgaaatttcaacgaaattatgcttatggtggattgggatgcggtcaaacttcttttttaaaagagatcccaggttattttgagccaaccgtttgggtaaggcatttatcccggggataaaggagatacacataggtgaggtggaaattagagaaaaagcgccgagaataggccaatattaaatgtgaaac

SEQ ID NO: 615849 - DNA, 433 bp, Homo sapiens
catggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacttcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaattatgaataaacctgccgtagacatccaaa

SEQ ID NO: 615850 - DNA, 268 bp, Homo sapiens
tatgattcatcaaggggactctggatgtcagacttctctatagacgaatgaatgaatgtgaagcgaaattcacaggcttcgtggatgcggactttgtaggagacttggacacaagacgatctttgactggttatgtcttcactttgtttgggtgtgcagttaagttggaaagctcaactacatcatgtagtcaagtacattgccacaacaaaaggcgtaaaggaatctctttggttgaagggattgatcaatgtaccataacaccaca

SEQ ID NO: 615851 - DNA, 1263 bp, Homo sapiens
  misc_feature (827)..(827): n is a, c, g, or t
agcggatcttcccgtcgccgcccttgtcctcgcgtctctcgcgctaccctcccgccgcccgcgggtcctccgtcgtgttctctcgtttgagtccacggtctggtcgttcggtcttcccgcctcttcgcttgtccaacttttgcgaacgtcggcgggaccgcgccgtgcccggccgcggaacgcagggactgtgagctcaggcactacgctgtgaccatgcatgctgactggccgtgcccatctcgagagacgaaactgtgtgaatagtggaggagagtggatccctggtggaaagaacatgctttgctcacgtagtcttcatgcaataggcaccaggctctcccacgacgtgtgatagtggtgcccatcaggttggtttgtgatgaactatattgttgaggccgatctaatcgaagggtggaatggacaaggcaggatagacgcttggactgttgtaggcatcaacaggcttgggactcgaaagaatgtacttgatcgcacatgaaggcccccatcatccatactccaggagtacccgcactggtataatacttgatgatggtgtgtattccagtccgcaaccaaggccgtaggaataagttataagaacaaaacaattgctcaggaaaaaaagatggcacccgcagatagttcacaagccaatgggctgctcccaaactggtgcccacatcactccctggggttggggcattacagacaggtattccttcggagacattggaattgaaggccaccacttataggtctgtatgatacttaagcctaagaagtgcatggctcaagcgcatgtgcggaggtaaacaagncttggaaaggaaagcggttcaaggaaagacttacttgcgggaacaaccacgggattcagggtcggcatgtttgcgggtaccatttggatggtaggtttcacggtcataacagtaagccaaatagcatttggagtgttggacagcaactaatggggtacttcctgggaaaaagtttgcgattaaccaaagaatatgcctttggcaccaatggggcatagagcctaggaaacgcgcttggggaaacacacaattacgacaactccgtaggaggattggcgcaatcgcgtaaatttggtgggcaccacaccgatattgggttcgcgcaattgatcgacaaacagcgcccatttataaatcgacagagggttataaacttttcgaaaaggatggtccgagtgatataatatacccttaagagtggttatagaacatgccg

SEQ ID NO: 615852 - DNA, 294 bp, Homo sapiens
  misc_feature (94)..(94): n is a, c, g, or t
  misc_feature (234)..(234): n is a, c, g, or t
  misc_feature (275)..(275): n is a, c, g, or t
  misc_feature (279)..(279): n is a, c, g, or t
tgagacccatcttcactggcacaccgtcgccaaagagacatgcagcgagaagagcactaacttgcacgactatggcatgctgctgccctgcggnatcggtgttcatttataaaataacgtggaaagaaacaaacccttccgtttatttactcaccctcggcttttgacagctgtgcttaacacaagtagatgcctgaacttgaattaatatacaaatcagtaatgtattctcgntttctctctttacattctggtctctacattacatgattcangggntttgtgtactgtaaa

SEQ ID NO: 615853 - DNA, 343 bp, Homo sapiens
acttctgggcattgatcagaaccaccatcgaaccactgaatgaggcacgttccttttttttgagacaaagtctcgctcttgctgcccaggctggagtgaaatggcgcaatctccgctcactgcaacctctgcctcccaggttcaagtgattctcctgcctcagcctcctgagtagctgggatcacaggcacttgccaccatgcactggggccgggtacagccaggcctgcaggaccccaagacactatagtccacgggcagcagggctggcacagccagacccacaggacccgaagacgctgcagagccggggaacgagggcccagcggctggtgctccgggt

SEQ ID NO: 615854 - DNA, 349 bp, Homo sapiens
tatttccacagggcaaaagaaaaaaaagagaaaagaaaacgaaaagaaaaaaggagggagggagggaggaaaaaggaaaaaaaagaaaaagagaaacaagaataaagtttggccaggtacagtgacacatgcctataatccagcactctgggagtccaagacaggacagtgtgagaccaggagtctgagaccaccctgggcaacatagcgatattctgtctctacaaaaattaaagaaaataagctgagcacgatggtgtgaacctgcagtcgcagctacttgggaggcctaggcgggaggatcactggagctcaggggtttgaggctgcagtgaggtaggactgcgcc

SEQ ID NO: 615855 - DNA, 276 bp, Homo sapiens
cttctacaggcggatataggccacaaactggttcccttcctctatccatcatgcccctaatcatggcctgtagacatcatctccaacgcagctgccccactcgtgtccttgtggggctgggtctgagtccaagatcacctgagcacatggattgatccacatcttaaagtctgggaagacaggcatgacctccaccggatatgactacaaaattgctcgggagtacaactggaacgtgaagaacaaagctagcaagggctatgaggaggtaacatg

SEQ ID NO: 615856 - DNA, 256 bp, Homo sapiens
taggctaactgtcgaccaggctggagtacagtaggcgcgatccctgtacactgcaacttccccctccgagttcaggcactctatctcagcctcccgaatagctagtacagcaggtcgcagccaccacacctttttgtatttaaagtaaagatagggttcaccattttggccaggcaggtctcaaactccttaattcgactgatctgccttgctcagcctcccaaagtgctgggattgcaggcataagccaatgtgc

SEQ ID NO: 615857 - DNA, 327 bp, Homo sapiens
ggctcgccgagacagatacggagttcccagctgcgcagtcgtgcagcgtggacagcgctgaggcggctaccagcgtcatatgctcgtacttgtaattgtcggcttgggaggtcaggagcaccggctggtcctctagtagctcctcggatgggtaggattcggtggtgaatccgacggggatggtggtcacttagaagtagatcagccggtcagtcctggcgcacaccttgtttcgagatcacagatttgtacatggtagagacgtaggcattctggatcaccagcttgctcacagtcttattctttccctccacaaactcggtccag

SEQ ID NO: 615858 - DNA, 333 bp, Homo sapiens
tatgagcccatgattctgtttgtttattgttgctttttaatttcattttacattgtggggtacgtgtgcaggatgtgcaggtttgttacataggtaaacgtgtgccatggtgacttactgcatctatcaaccaatcacctaagtattaatcccagcatgcattagctatttttcctgatgctctcctttcccccaccacacacccccaaacagtccatagggtgtatgttgtgcctctctctgtgtccatgtgttctcattgttcagcttccacttataagtgagaacatgcagtgtttggttttctgttcctgcattagtttgctgaggata

SEQ ID NO: 615859 - DNA, 867 bp, Homo sapiens
ggggtctctcggtcccgccagccgtgaggaggacggtctgcatactcgctgccgccggctccctcccccgcgtccctgcgaccgccgcgggaagatgattttcagttcacccactattaggcaaagacgtaagagagctaccagcgtattgagaggagatacacaggcactacgagaatggagtttcagcacagaaggtcagagccctgggcagtgttgggccaggctttagggcctcaggagtgcaagtagctgatgaacgtatgtcgcattttttatgacatgaaagttcgtaaaatgctccacaccagacgaaatcagaaaagaacgaaggctgtcattttttggtctcagttgcagacaaacaagtgcatcattgtagaagacaggcaaagagatctgggtggcaagatgttggtgtaaccataactgatcctttcaagcattctgtgcggactgcttcctgacaacgattgtccgctatgcttgtatgatgcaagctttgaaacaaaagaatccagaaaacgacgagttgctgcttctcgtgggcaccaaactagcacctctgcaacactacacatgatctatgcaagcttccaaggatgcaattacacaagaaacttcacggcataaaccctgacgtgtcacgcaactggaccacaagatctcatcgggctggattgctgacaggtacgggactctaattgtagctttgagggatcctgtgtacatatcagggccagctggaagcccaggtatgtaccctgcattaataagcatattaggccagtcactggcgaacgagggacctcaagaacatctaacattcgagcataatagtcgtgcaaaaaacaagggcgccgcagt

SEQ ID NO: 615860 - DNA, 1121 bp, Homo sapiens
  misc_feature (125)..(125): n is a, c, g, or t
  misc_feature (133)..(133): n is a, c, g, or t
  misc_feature (135)..(135): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (151)..(154): n is a, c, g, or t
  misc_feature (157)..(159): n is a, c, g, or t
  misc_feature (165)..(165): n is a, c, g, or t
  misc_feature (173)..(173): n is a, c, g, or t
  misc_feature (180)..(180): n is a, c, g, or t
  misc_feature (188)..(188): n is a, c, g, or t
  misc_feature (190)..(190): n is a, c, g, or t
  misc_feature (210)..(211): n is a, c, g, or t
  misc_feature (213)..(213): n is a, c, g, or t
  misc_feature (220)..(220): n is a, c, g, or t
  misc_feature (230)..(230): n is a, c, g, or t
  misc_feature (232)..(232): n is a, c, g, or t
  misc_feature (235)..(235): n is a, c, g, or t
  misc_feature (241)..(241): n is a, c, g, or t
  misc_feature (251)..(252): n is a, c, g, or t
  misc_feature (257)..(257): n is a, c, g, or t
  misc_feature (267)..(267): n is a, c, g, or t
  misc_feature (269)..(269): n is a, c, g, or t
  misc_feature (274)..(274): n is a, c, g, or t
  misc_feature (284)..(285): n is a, c, g, or t
  misc_feature (290)..(290): n is a, c, g, or t
  misc_feature (294)..(295): n is a, c, g, or t
  misc_feature (301)..(302): n is a, c, g, or t
  misc_feature (309)..(309): n is a, c, g, or t
  misc_feature (324)..(324): n is a, c, g, or t
  misc_feature (327)..(327): n is a, c, g, or t
  misc_feature (335)..(335): n is a, c, g, or t
  misc_feature (355)..(355): n is a, c, g, or t
  misc_feature (409)..(409): n is a, c, g, or t
  misc_feature (494)..(494): n is a, c, g, or t
  misc_feature (499)..(499): n is a, c, g, or t
  misc_feature (527)..(527): n is a, c, g, or t
  misc_feature (625)..(625): n is a, c, g, or t
  misc_feature (642)..(642): n is a, c, g, or t
  misc_feature (732)..(732): n is a, c, g, or t
  misc_feature (742)..(742): n is a, c, g, or t
  misc_feature (751)..(751): n is a, c, g, or t
  misc_feature (852)..(852): n is a, c, g, or t
  misc_feature (1002)..(1002): n is a, c, g, or t
  misc_feature (1044)..(1044): n is a, c, g, or t
  misc_feature (1118)..(1118): n is a, c, g, or t
ccgggcgggcagcatgaataaccctataccttccaatttgaaatcagaagcaaaaaaggctgccaaaatattaagagaattcacagaaataacttccagaaatggacctgataagatcattcctnttctcgtntnttttntaangntnaannnnttnnnattttntttttttnttaaatntggtttcntnttttttttttatagtgtttnntnttttggnttttttgttntnctnttttcnattttgtttnnatttnttttttttantnttttnttttattttnnttttntttnncttttnnttttgtnttgtttttttttttnttntttttttnttgttttttgtttttgtttntttatttttttttatatttttttttttttttttttttatttttttttttttttnttgtttttttttttttttttttttgtttttttttttttttttttttttttttttttttttttttttttttgttttttttttattntttantgttgcacctgtagagagctcccgctgnccgtctttcacagtaactggcaagtcaaagggtgactcttatgcaggtcgtgtcttatagaagaggagctgttttgatttgaaagggaaagaaactanataggaaaattttattngtcaaagatatccagagcttatggacatttttatttgggagatacaccgcggcctgctcaagccgaagatctttatgaaattcttgattnctttactganaagtatganaatgaaggacaacgaatcaatgcaagaaaagcagcaagggagcagaggaagtcttctgctaaagaattacctccaaagccattgtcaagaccacagcagtnatctgcaccagttcagctgaactctggctctcaaagtaacagaaatgaatataagctctatcctggactttccagctatcatgagagagttggcaatttgaatcaacccatagaagtgacagcgctgtattcatttgaaggacagcagcntggggatttgaattttcaagctggagacagaatcacagtaanataaaaacagactcacattttgaattggtgggaaggaaacttcgaggtcaactggcattttccagcaactacgntac

SEQ ID NO: 615861 - DNA, 422 bp, Homo sapiens
gtgcgcgtgccattgtgaggcttgagtaggtaaacaaaacagccaggaatcttgaactgggtggagcccactgcagctcaaggaggcctgcctgcttctgtagattccacctctggtggcagggcatagctgaacaaagggcagcagaaacctctgcagattaaatgtccctatctgacagctttgaagagagtagaggttctcccagcacggagtttgagatctgagaatggacagactgctttctcaagtgagtccctcacccccgagtagcctaactgggagatacctcccagtaggggccgactaacacctcatacagccaggtgctcttctgagatgaagcttccagaggaaggatcaggcggcaacatttgctgttctgcaatatttgctgcagcctctgcaggaacccacgcggg

SEQ ID NO: 615862 - DNA, 355 bp, Homo sapiens
tcccggggggaggatgaagaggaagaggaagaggacgaagaagaggagaaccaaagcgctcccccaagaacgacgaaaccacagacagacgccagaaagagaaagaggcctcaaggactaaagacgaaacgggcacgaaaacgcaggaggagcaacagcagtgtaacaacagagaccatcgcagagacgacagaagtactgaatgagcccttcgacaacgcagaagaagagaggccaatgccacagccggagcctacctgtgagacggaagcggaggaagatggcaggaagccagtcccgagaaaagcattccagcagcagcctgtgaagaaaagacaaacagaggaagagcaag

SEQ ID NO: 615863 - DNA, 103 bp, Homo sapiens
agtagtgatgctgaggtgattagaggatcccgaacaacggtgagcccaggaagttgaggctgcagtgagctgtgatgtgccactgcactcatcctggaagaca

SEQ ID NO: 615864 - DNA, 132 bp, Homo sapiens
ccccctggtcctttcccattgccccaaaaagggggggcccaagggccgagcttactttagttgggaggagaagggtgagggtgggggccccaggattccccccccccttcccaaataaaaatggggggccta

SEQ ID NO: 615865 - DNA, 285 bp, Homo sapiens
  misc_feature (245)..(245): n is a, c, g, or t
gaagcctttgaggccgatcaggaaaccggtgtcgtagtagatggtggtggacggtgcaatcagcaggcccgacagcgcgccgatgaaggcggccatcgtgaaggtctgcgcgcccgccgagtcgcccgagatgcccatcagccgcgcgccggtgcggttgaccgacgtggcccgcagcgccttgcctgtgagcgtgcgctcgaagaagacgtacatggccgccagcaaggccatcgaggcgccgnagatgatcagcgtctggcccgtgaggctcagcggccccgc

SEQ ID NO: 615866 - DNA, 124 bp, Homo sapiens
cacgaggagcatcgtggccagcttccttcatttggccaacatccactttgctgccatcgatgcaagcaatgcccaggtcaccaccgagaaccagctcacgtatctgaccaggctcctcagcgtg

SEQ ID NO: 615867 - DNA, 282 bp, Homo sapiens
aaatccggtttttttttttaaattttaaaaagggaaacctttttcaaaagcggggatccaaatggggttttgggggatgaaaaaaaatggggttttggggtaaggggaccccttttgaacccggggggttttactttgggggtaaagggggaaattcccccccggtttggttaggggcccccatttttggttgggtttttgggcaaagggggtcccccgttttcatttaaccaggggtgttttttttttttggaattaaataaaaaccgggtttttccttga

SEQ ID NO: 615868 - DNA, 321 bp, Homo sapiens
  misc_feature (321)..(321): n is a, c, g, or t
taagatccactaagagcatcagtgtgtggtgcgcgatacagcggacaagctctatgcgcgtcagagatatctctcgctcagtctctttgtttgatttttgctgattccttccatgtaagaagcaattctcagaacaggtcatcagttagtgtggctcagttctcttgggcgtcagaagccggtccgcacaggaggcctctttgtctccatgaagctttcactgtcggctgaaagaagaggtcgctgccctgctccatcgcaggtgaagtggtgaggctggaaagggttcttcaaggcaggctctcggatcattgttaatcn

SEQ ID NO: 615869 - DNA, 200 bp, Homo sapiens
tgagactgcgatagtaagtgcgttgggctgaggggacaagtcatgggacaaactgtcagctcctgctctagtggagaaaatcacagctggagctatagaagtgagtgctcctttccactgccaggcagcttagtgtgttaggctgttgctgacgccccagctctagcttgcctgccgcctcccccaaccgcacctcacac

SEQ ID NO: 615870 - DNA, 231 bp, Homo sapiens
aaaaaaagggggccccccgggggggggggggggtttttttttcccccctggttttttcccccccaaaaaaaaaaaaaggggggggggggggttttttccaggggggggggggggctttttccccccccccccgcggggggggagggggggaattttttttttttttttttttttcccccccccctaaaaaccctttttttttaaaaaaggggggggccccttttttttcca

SEQ ID NO: 615871 - DNA, 487 bp, Homo sapiens
  misc_feature (1)..(1): n is a, c, g, or t
  misc_feature (68)..(68): n is a, c, g, or t
  misc_feature (146)..(146): n is a, c, g, or t
  misc_feature (154)..(154): n is a, c, g, or t
  misc_feature (172)..(172): n is a, c, g, or t
  misc_feature (180)..(180): n is a, c, g, or t
  misc_feature (395)..(395): n is a, c, g, or t
  misc_feature (422)..(422): n is a, c, g, or t
ngcttgctgtggtttttgctctgggtcctctgggatcggcgcctggctgtggcgcgtggtctctcacnaggggcgccgggcgggggaacgcggccaccctgagtctggtgagtcgactgcggcggcctgtgtccgaagtgtccagntagcttgnacaagggcagcggctggnctcagctngcgttcccacgtttggaaacggggaagctttcgtcgatttgtgtttacatcatcgactatgccaagggagttctccaagataagcctggttttattttcgtcagtgaaaaggccttacccgtataactgactttatgcttgccctgccccccgtataaaataacttaaaagcaagcgtgcctggttacagcttgtttcccacgtgcggtgctccntcggggagtgatcaacctaaccctaanaggtgggaagatggatgcctgaagtgtagaactgctgctaacttgaaattaacccccaaaatttt

SEQ ID NO: 615872 - DNA, 1213 bp, Homo sapiens
gtgctggccgatggaggaggcggcggcgttggatgctgcctcctggccggcgggcctgggccgggccgagccccgggcgctgcggcgtacgcctggatcctgcgctccgcctaggcctggtctgccttggtgccccgaggaggcttgctgatgccccaggccatggtcccctctcggcaggacgtggaacctgggagccacgccctcgctgcggggcctgtggacgagttggtgccggtgccccgggagtcctcgatgccggggggagtgtgcgtcgaccgcgcgctcctgagctcgccagtctcagaccgcggcccgcgctcgcgccgtttccgcaacacatccgtgcctcggggagggttggaggaacctgggcgatgggaaagagagatatccacgagatctgcgtggtggacgtcagggactccgagctgcccgtagaggtgcgagcctcagcccagctgccatacgctcagatagccgtgagcctcaataggcggtgggacgttgggtcgtgggcaccagtgaaagaccgcccccgatgggggacgtctttaggcatgaacaccctgaccagggctagggaaccagccgtgacaggggaggacacgcgtcaatttaagcgcaaggggcccccaagggaacggtgaacggccggcaacgtggccgaaattcgtggagaccgttggttgcgggaggcgacgctgtgagccatttgggaaagaacagacacgccgggtgaacgcatggccttgaatagggatagacgacggaaacttggagccgggaatgttggacagggacaagggaaggcacttgcccgggcacggcatatgaatataagcggccaccggaatccttgcgaaaaggcaagacttggagaccacccaaaaagtgccaggaaaggggtcacccatgggacacaagggcaaatgccaggaagcccgagccaaggatccgagggagaaggaaaggacgagcccaacaaagggaacttccgagagtagggaatagcaaagagacgttggggtacccccaaaggacgtttgaaaggggatggagaaggaaattgcggtgtgaaaaaaaggaaaacatggggcaaattgcttggatccaaggaaaggctatgaagaccacataagaaaaggggggtagaaaaggaagaggaaagataagcccggaaatcaggaagatgggtgattaaagggtaggg

SEQ ID NO: 615873 - DNA, 110 bp, Homo sapiens
ctcttccaaggcttgaatggcatcattatcattgtacacaaagttatcccaacaatatttaaaactcttcatatgtcactccgctccgggtgatccatctagaagtcgac

SEQ ID NO: 615874 - DNA, 403 bp, Homo sapiens
cagctatggatctccgctctgttgtccttctgaatgaatgcagtaaggttgtcatagataatgtccatgggtgtccttttaaagtattgatcagcatactgcagtcctgtagagacctccgataccaaaatgaagatctcttcaaaagcatagcagaatatgtggctacaacctttgacatctggaagttgaaacaagttatctttttcctcttattatttgaaactcttggttttcgacctcctggtttgatggacaagcttatggagaaagtagtacaggagcctggctctctaaacgtgaagaacatcgtttctatcctgcatgtgtattcttctctcaatcatgttcacaaaatccacaacagagagttcctagaagctctggcgagtgctctgactgg

SEQ ID NO: 615875 - DNA, 109 bp, Homo sapiens
gcagacgggcagtcgccactgtcctggcgctaggagagcgccactgctgcagcaatcacgccagccacgggtggaggctgtgggttctaggcacgagccagaacccaca

SEQ ID NO: 615876 - DNA, 766 bp, Homo sapiens
tgctggaagcctggggacccggccacgtccccctgccgcatctttgacctgggcagcgacaacgaggaggtggtggctggcccaggccccgcccagcgccaaggagggcttgcggcactttctggaccgcgtgctggagggtgcgggcgcagccacagctgtctggagcgcatgctagacgaccaaggtggtcagagctgctggcccatgtggccacaccaagccaccctgagcgcagtgccacaggcgcaagagcaagtacctcatccttcaccactggctgccttcaccgtacatccccacaccagaatcggcatcaagccagatcctgccacaccagatgaccacgggcatgggccctgtgctgggtgagggccggggctccgatgccttcttcggacggcgctggaccacgtcatagacatacacgggacacatcatcggcatgggcctgtcgccctgacaacaggtacctgtaccgttgaacatgcctgcgccttggcccaacggtgccggtggtggcctgaccccatgcaggcgcaacaaatcggcgggaggaagattttgacctcgcttggttgttccgacctccaagaccagtgcgggcaccgtgaagggcgggatactgcggttgcggcacccggggacataagagcccccaatcgacgaagtgggcttcttccatatttcctggagtgtcaggcggtgactttctctggccacgcgggctgacgaaacgggcacgcttaaatctgtgaccggccct

SEQ ID NO: 615877 - DNA, 280 bp, Homo sapiens
gcatcaccttggacaagcacaccagctgggcacaggcggtttccgccacgcaccagtacgcagcggcagcggcatgcaagcccaggcatcagcagagcccccgctgcacgctggtggataccgggcatcagcggagcccccgctgcatgctggcaatcaatcccaggcatcagtggagtccccgctgcatgctggcaatcaatcccaggcatcagcggagtccccgctgcaccctggtgatcctgagcatcagcggagccccactgcactggcaatcccg

SEQ ID NO: 615878 - DNA, 142 bp, Homo sapiens
gcagtatctagactgatttaaacctcatcatatgatagctgtttggtattctgactcatatgtactctttggagcgggaggctttcgggttgcccagaatagttctgcatttgtcttccaccaatgccactggccacccatc

SEQ ID NO: 615879 - DNA, 1258 bp, Homo sapiens
ggcacgaggccaacctccctcctccccatcccagctttatcctctggggcttctcctgtggtgtgcaggtaaatgtttaacaagcagctctcgcaggggattgaggggagctcatgtgaagtgttcgtcaacatctgtggtgtaaatattctcatcatggctgatttcaagctaccaacatgacatggctgaacacgagattgagaagaaatgtgcaccatctgtccaggagcgggcgagctggatccagcacacctggattctcctcccctgacacgtgacaaccctgcagagacttgagatcagccgctcagattaggtgatcagaagcattttgtcacggagacacggagttctgggccggctcttatcttcagggcatctggtagggtggaaagcacttcaagtcatgcgccaagcccacgtcctattccctgggcccattcccttccgttgaagtgctggaggcagagctcgcagctgaagacctacaggcggctctccctcgtgtctgggcatgagcggtctgtggaggcagcagccaggctgtgtccaggtagccctgacggccactgcacaagagcagtgtcgggtagagtccgagcacccatcagctcagccccaggctccatcagaggcggtggaacgggccctgaggatgcctcagtcctgggccttagtgggaggccttccaggtgaagccctggggaccaggtagccctgctcagcaagcagccctggaccctacctcagcagccccggaccccacctcggccgccgcaggaagccaaggggatgagggaccaactcgggaaatggtgggtgaggctggtggctcctggaaacgccggtcaccagggcggcagcaccggtcctcacccctccctgccaggacttcacccagctctcagcccctaagcatgatagtttcttgggtcaaccaaatagtcatctaggggttactgtgaaggtgttctgtaagtatgtcacatctgcagtcagctgactggagtgaaaggccattactctcaatcatgtggcgggggtaggggtgggaagccttgtgcaaccagtgaaatgccttgagagcagagctggggtttccctgaggacagagagattttacctgtggactatagcatcgcctactgcccgagaggcccaggtgccgcctgccctatggatttccaccttgctcagccagcccccaccttgtctgagccaatttttcacaataaatctctccctccctcccttc

SEQ ID NO: 615880 - DNA, 353 bp, Homo sapiens
tcaagtgatcctcataatttccttttccaattttcaagaagaaaataatcgggggcggggccttagatcaagtcttcgggagaaggatgatccctaggcacaaagaggggtaacggttcttattaaaaagattcacaggctggatacaagggctcaggtttataaccccagcatttggggaggcggaggggggcggatcactggagctcaggagttcaagactagccggggcaagggggtaaaaccccatctctacaaaagatacaaaaattagcggggggtgggggtgcatgccggtaatcccagctactggtaggggcggaggcaggaggatcactggagcccaagaagca

SEQ ID NO: 615881 - DNA, 549 bp, Homo sapiens
gaagaactgatacatgttacaacatgaaccttgaaaaccttatgctaagggaaagaagccagacacaaaaggccatatattgtacataccgtatgagtcaatttatatgaaatatcctagaataggcaaatccatagggacagaaagcagattaatgaccaatgtcctcaccacacacacacatacacacacacacacaccaatgtgtgatgtggtaatcgtcagattgtggtaatcgtttcacaatgtatatgtatatcaaataatcatgttgtacaccttgaatatgtacaatttttattctgtcaattatacctcaataaacgctgaagaaaaaacatgtagattagtggttgctagggaatgatggaaacgaaaaataataaatactgccaacagatacggggtttccatttggagtgatgaaatgttctggaattacgatgtgggtgatgattgcacactttgtgaatggactaaaaccacctgaattatacactttaacaggacgaattctagtgtatatgattacatttcaactaacagaga

SEQ ID NO: 615882 - DNA, 133 bp, Homo sapiens
tctactgaaaaatgcaagattagccaggtgtggtggtgcgcacctgtaattgggaggctgaggcattataatagcttgaacctgggaggtggaggctgcagtaaggcgaggtgagatggggccactacactca

SEQ ID NO: 615883 - DNA, 996 bp, Homo sapiens
cgcgagctgccgccctttttatattttttttaatatccgcctttcttaaaagacaagctagtatacgggaaaaagaaaaaaataatactaaaataaaaaccaagacaactttagtaccctcatctttattggggaaggggagggggaactccggggtcgcccacgcctacacccgtggtccttcccgaggttcatgctaaaggctcgatcccttcggtgccccccctttggggggcgatgggaaaggaccagggggccgtggaggtgtcgggaactagcagagggtggtgaggggggcaggtggaggtgggacgcttaccggggacccggggatcgggggaaacccggggtgcccaggacgggaaaggggcagatagcatggcgtgcatgcagaaccagggtgaaagggctggggcccaggcagacggacggtaacacagtgtccaaaacgggggaagggccggggcatgagtgcgcttacgcgaggacatggaccccttggggaccgggatctcccatcgtgaccctccaggccttagctggcctcacatgtcacgggcaggtatccacctaaccaggctgcaggggcaggacgcagggaagccgggcaagggggaacggacagaacagctaaagggggcattgcaaagccggggctggggccccagacggcggacaacaataaatactaggggaaataaagccaatcccgagccaccaagggagtctggggccaacaataccatatccacacgagcaccaaggtaatcaccatgaggagacccagacagcaaaacacacagggaccgggaaccacaggaaaaccaaacatcacacacaataaacccccgggaaaagatggtccccaacaaaccccaaaacacgcaaaacatgcgaaaagggatgggacatgagaaacccaacgaagacaagaaaagaagcagacacagggaagaaacgagcagaaggaaacggaggacacacacaagtacggca

SEQ ID NO: 615884 - DNA, 936 bp, Homo sapiens
  misc_feature (162)..(162): n is a, c, g, or t
  misc_feature (190)..(190): n is a, c, g, or t
  misc_feature (205)..(205): n is a, c, g, or t
  misc_feature (235)..(235): n is a, c, g, or t
gataactaccccaggcgatacctaggtcagtcgacccacgcgtcgctctctctgtgtctttcctctctctctccctctccctctctcttatcattgtgtatcagtttccatgaaagacctgaatacacttactcaaataagcatatgtgttacttcaagtantacgtttgacataagatggttgaccaangtgcttttcttcggnttgagttcaccatctcttcattcaaactgnacttttagccagagatgcaatatatccccactactcaatactacctctgaatgttacaatgaatttacagtctagtacttattacatgctgctatacacaagcaactgcaacgaaaaaaacttactgggtaggtgattctaatcatctgcagttctttttgtacacttacattacagttaacgaagcaatctccttactgtgttctcagcactgactatgtatttcttctatgctcattcttcaatctcacacacaatttttaaaatacttgttctcacgcttctctgctagatttctacattaacttgcccctttctctaaccaagtcgctcctaggttcttaaccgataatttctcctcaatcacactacacatcacacaagattctgactgtaatatctcacatattaccctccaagtctgtacctcaaatgaatttctttaaaggagatggacctaattgatcttgcaaaagactaccttccagacttcaacaaggaatgaactttgttactttgcccgccattccttgtttccctcaacccttctgcaattcgttcaaactgacgctacccctagtcaaactattgtcgtaacacgcactctgctcgcacggacacgttttttcttctttcgcccacacatcatttatcacattcactaagcactttcacgaatgacttggtgggacaagccaccg

SEQ ID NO: 615885 - DNA, 341 bp, Homo sapiens
aaggatccactacacctaatcgccctacgcgagtggtgtagtgcttgtgtgatacccaggatgtagtacaggaacatctggtgcaacgccagaacctggtctgcaacgccaacagcggtggtgttggagctggtcacatacgggtaggtaccgtggtcgatgtccagcaactgaaccctgggcaccttcgaacatgatgtccttgccacgcgcgacgcaggtcgggcaactcggccgtcacatccagcatcagcggcttgaagccgctccgcgtattccttgcactcggccagtgtcttatcaaactcgatggctggctctttgtagtaacccaccagcat

SEQ ID NO: 615886 - DNA, 120 bp, Homo sapiens
catgggccaggtgggggtgcctcagtcctgtgcccttgggcagtgagggggggggggcattcacctttctcctagaatgctgttgtaaataaacaaatggatccctggaaaaaaaaaaaa

SEQ ID NO: 615887 - DNA, 213 bp, Homo sapiens
ctttgttttgggttttcaaagaatagccccttgttccttcttgtgctggccaatgccccctgtttttgtttctttgccttttccgggcccccccttcctctggtttttggttgtttattgatgggtccataatattgggggaggcttgttttgttttttgttgggttgaaagccctttttggaaaatattaaaaggctaccattaaaagacta

SEQ ID NO: 615888 - DNA, 1448 bp, Homo sapiens
  misc_feature (42)..(42): n is a, c, g, or t
  misc_feature (81)..(81): n is a, c, g, or t
  misc_feature (99)..(99): n is a, c, g, or t
  misc_feature (136)..(136): n is a, c, g, or t
  misc_feature (159)..(159): n is a, c, g, or t
  misc_feature (346)..(346): n is a, c, g, or t
  misc_feature (781)..(781): n is a, c, g, or t
  misc_feature (849)..(849): n is a, c, g, or t
  misc_feature (993)..(993): n is a, c, g, or t
  misc_feature (1086)..(1086): n is a, c, g, or t
  misc_feature (1119)..(1119): n is a, c, g, or t
  misc_feature (1232)..(1232): n is a, c, g, or t
  misc_feature (1409)..(1409): n is a, c, g, or t
ttattttacatttatcatatcttctatctttctctgtactgntatattctctcgtcgtctactttatttcttactatcctntcctgtcgtcgccttctnacttataattctaatatgataataagatctatatggngtcaacgatggttatagtaatangaaaagagatactcgagaatgatgaagagagagataaatatattattgaataatataatatatgttcgttcactattatctatacttcttataccttactttatatctgacacaacgtgttggaggttgagcaaaatagaatgggtcgagcgtgtgtgcagagtgcatctcgacgcagcggctatangagaaggtatagtgtgtggttgtactttgctttattgagattagtatgtagtcacagactgccagttacgcgcctatcatgattgaatacaacgtactcatgagtatattagatgtgaaaacgtgagcaggggactagaacttaatgtagtgatcgtatctgagaatgctcgcgctgatagttcagcgcgtcgagtgtgacacacgccgcagtagcgcggtctgtgcgagtatctttgtgaggcagggagacagatgaataagcatgcagtcgtatagagatgagtgaagatacagacagaagctcgtatcagttgtacgaggtcgtcgggcagcgtgctacgctcgcgttactatcgcacgtgcgaactcagatgtctcttgagactgtttagtagcgtgactctcgaccggtgcatgatttgagtagtgtaangacgtaagcgtgttcacatctatagctacagggtcacagtgtcattcgtgttacgatacagctcaagntactacataaatgtgtatactcgtctacgcaccttacacctgcgttcagtgctcacgtgcaccatgctaatcgatctgtatcgtcttgtcgctcaaggtatataatatgtttagttaaattagttctacgtgcagatcactaancgcactctatgctgtctcagtgttatataagtgcctgttcgacgctatgagaagagcgtgtatatgacgatgctgtattagtaataggctgcnagacaaccattggatcatcgctcgttactgtcngtgtagtcttactgactgtactactaggtagtaggcctcgtcatctacgtgtgatactagacacaccacactcgtcagcagatgataatgatatacgatgtagattatgtgtnagttagaaccatgtacgtatatatagcatgtatctacacagaattgagttacgatcgtatcaggcgatatgctggagcaacattagcgacgcttgaatactagaccgcgcggaacgatgcgatcatgagtctgtactgtggcgtagcatggcaagtgctgttatcgtactcgctgantatagtgcttagacttgtatagtagttgcgtattaacct

SEQ ID NO: 615889 - DNA, 693 bp, Homo sapiens
ggagcagctaccgctcagccatcgactacagtgacagcgccatgctccagagtcgtcatggcagctgctcctgtgggctgggctctttcctggaggacgcacgtgcctacactgagggggcagctggcctgcggctccgatcagggaagcgatgctgtgggagaggctctccatgcaccaaggagggccgtgaagggcgggcttggcaagtatgattttgtacatcacgccagggatggttggatgctcatccatggtgctcttgcaaacaccaacggcgaatggactagcgtcaacgggcggtcgccgtgaaggcaacgctgtcaagggcctgatgaagtccgtagcctgtgttggggtgccgagtcaatcatcgtgtacgtatgggaactaggttgttgtgtgaaacgtggtatggtaattacatcttggccaaatctaactagttgggctaaactctcgtgcgtcacgaaacgcacggagatgacgtccgagtctccgaggccaatcacgaaatgtccgacccagcgtctgctagcgacatcggtgctatcgttccaagacgatctctctagcatatgtgctagcaagtcacagtgccacatacgtttcagggagacgggcagtcgaggtcgtaccttgcatggtggtggtgcgatgagctggtgcggtaccgcgcgaggaaagggtccg

SEQ ID NO: 615890 - DNA, 550 bp, Homo sapiens
gtatcgtcaggctctagtccacgtactagataacagccagaccagcatctcaagatggaatgcgttggtttatgtctaacagaggaaaatggaagatgttcagttacgagctaccagtccagaatctaccagtaggagttctagtaaaactggacgagatactccagcaaaatggagaaactgtcgattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaatagcagactggcgggaaggggctcttaatggaaactaccttaaacgaaaacttcaggatgcagcagaacaactaaaacagtatgacataaacgccactcctaaaggctggtcctgccactgggacaggt

SEQ ID NO: 615891 - DNA, 395 bp, Homo sapiens
  misc_feature (354)..(354): n is a, c, g, or t
  misc_feature (379)..(379): n is a, c, g, or t
  misc_feature (385)..(385): n is a, c, g, or t
agagaataacaaaacctttgggctcatgctgtaatcccagcactttgggaggccaaggagagggggttgcttgagctcaggagtttgagaccagcctgggcaacgtggtgaaaccccatctctacaaaaaatacaaaaatgagccaggtgtggtggcacgcacctgtagttctagctactcaggaggctgaggcgggaggatcacttgagcccaggagacaaaggctgcagtgagccgagattgcaccactgcactcaacctgtgtaacagagcgagactcagcctcaaaacaaaagaaacatctttgtgttcagagttaaggttgctattataaagtaaaatgctaggttgtnggttctgggtacattgcaatctatnattgangatccagtgg

SEQ ID NO: 615892 - DNA, 151 bp, Homo sapiens
agaaccacataccttggatcgtccgctcttcctccagggcactggcttccagaacagctgcactgtcctggggtcagctgcctctgccgccaccatgtgtccagtctgacagtgggggcccgttcggtagttctcagctccagtctctggg

SEQ ID NO: 615893 - DNA, 275 bp, Homo sapiens
gagtgcagtgactgcccgtgtcgtggctcctagctgtcctagctcgtattaaggtagagcttgctgtgtatgttgcctacctatgtcctggctttttctcgtatttttagtagagacagggtttctcctatgttctagaccctcggcttggtctctgaactcctgacctcaggtgatctgcccgcctcagcctcccgatgtgctgggattacaggcagtaagccagctctgccggccctttactaaagaaaatacacgaatacaaagaaagaaca

SEQ ID NO: 615894 - DNA, 940 bp, Homo sapiens
  misc_feature (940)..(940): n is a, c, g, or t
attaattagttatttaatcatattttcaaaggaaactttatatcactactttaagtagaaaacttatgtccactgggcacagtggctcacgcctttaatcctagcccttgggaggcccaggcaggagtatgcttggggccgggagttcaagactgacctagccaacatagcgagaccctgtctcaaaaaaaaaaaaaaaagaaaagaaacactctgatggggcttgggggctcccgcctgtaattccagcatcttggggaggcccaggcggcaattaacctgaggtcaggaattcaagaccagcctggccagtttggtgaacccctattctctgtgaaaatacaaaaattatctggggctaggggggcatcgcacctgggggtccccagagtagctggggataacagggggcctctcaacacaccaccagaaatttgggtgtaaaagtacaagatgtggtttccacccattgtagcctccgggacctcaggtgttgattccattcttggctcggatatccccaaaagtgtggaggataaacaggtgggtccaagaatgcggacgaacggcacattcgttttaagtcatcaggatttggccttcaatgctaaggtacattgcagacgcactcgttttgtggcgttattatcgatagtttgcagcacaaagagcgcaaaccaggttatggcaaatggagcaaccgagacggggaacagcctcagggccacaatgacgactgacggtacactcagaaaaaaattatcattccgttccaggaaaggaaaagaagagtagattcacacaggtaaagggggcagaaagggaatcatgggcactgcgctgtggctgcaacaaactaacgaaaaagagtaggtactgtggggaaaagaaggcgggaaaagccaaaagaggttagcaacgtcctcccggtccctccccn

SEQ ID NO: 615895 - DNA, 1536 bp, Homo sapiens
  misc_feature (988)..(988): n is a, c, g, or t
  misc_feature (1021)..(1021): n is a, c, g, or t
  misc_feature (1123)..(1123): n is a, c, g, or t
tcacacagatccacacaccgctgggtgtgttgggtgccccccctcccaatgtaaggagagaaaccccccggggggcgccgcgaagttcctccactcccctccgcggggaactctttatagcgcccctgtagtggccccgccgggggcctgccgggagaatagcccgacagttcgtgctgagacacaccgcgggggcgaaacacagcggcgtaatttgcaccccaacttactatgagccccctcaattttttataagggggacaccaaccaccataatagagaacaccacaagggtgtgtgggtcgacagcacagaaagaaaggccacacaagggccgctggaggacaaccaccgcgggttccccgggggaatatttccccgcgggcggggattatatttctgctccgggaacccaacaccacaggcgtgtctcccccagaatagagatgtggtttttcctcggtttaagagagcaagtggcgccccctgttgtccaaccattttggaggagggaggttgtaatatccccacagtggttttttcccaggagttcttctctttcctccttcaaggcctttcgggggggggccgttttttgtgaagaaaaaagatttgtggggaagaaaattgctctggagaacacgactgtgtgcgtgtggtggcgccccacgccactaccgcctcgtgtttttggaaaactcggtgttgggagaccctctcggcgtttttttgtcttccttttgtcgtaaagagtgatttcctcggtgcccccctctcttgggcttttccccgcgtaactactgctgtgtttttcgcgccgctctgtgtggagagatttctatttcctcttaaatccccgtgtctcttttggtggtacacactctgttgtgagaatggccataaaaataattgggggccacaggggtgtgagagagagacacactctattctcgtgaggagccaccccctcttgggtgtgagagccaanagccctcgggcctctgtataagagagattgtgnagagaaaagagggctttctggccgacaccacgagaacccctggtctgttctcctccacaggtgtctgtcaacacaccggggtgtgttggcttctttcacagntcaatatacccggagaatctcgagaatcacacaaaaagataatttttagaaataatccacatgagatttcctcccctgttatattgagggcgtatggccctgagatcacatgcctttttggtgccctgtcacaccacgggtttctccacacagggcacactcacatccacgggtcacggtggtcaagaagtgtttaaaggaggagccctataattcacgggagaagttgcggtgagaacacctgcacgtgggggaggaaattgagaaataagtcacggcctaatcacgtttcaccagaaatcaccccctctacctttgataattccaccttagctgtagagtccaatctgtttgtccactctgctgaaatgagaaaagaaaaaatttaacgccctgaattttaaaccaaccca

SEQ ID NO: 615896 - DNA, 116 bp, Homo sapiens
cggggacgatagagtgtgtccagtgaaggggagaaggggcatcagctccctggtgggcccagcccactgcagtctcacgcctctatagaggtgatgggctgtcgggctagtcgggg

SEQ ID NO: 615897 - DNA, 196 bp, Homo sapiens
gctaggtgatctagaggatcccttagtgtcactgtcctgagaataggtgatttaatcaggcaacgaaatatactcgttgaaatttagagtatgtcttggtgcttcatgtgataagcgacgaacaaagtgataatcaggttatgtaatctagaaatgtacaaggggcctttataacctgggggcggggcattgttta

SEQ ID NO: 615898 - DNA, 509 bp, Homo sapiens
taatgggcttgggtgagggaggtagggggtagttggggttaaaaattttaagtggggtgatgaggaatagtgtaaggagtatgggggtaattatggggggccatacggaagtattaagtgggggcattagtggtgtgggtcgccttaattccaagccttacgttttcacacttctagtaagcctctaccgtgcacgacaacacataagtgacccaccaatcacagtgcctatcatatagtaaaacccagcccagtgacccctaacgaggggccctcttcaagccctccataagtgaccctcgcggccatagccatgtggtgatttcactttccagttccattaaggctcctcaatacataggccatacataaccaaacacaccataaccatatattcccaatgtgagtgggcgcgagtgttaaccagcgaggaaaagccaacattaccagggggccaccaaaacaaccacgcgtggtccaaaagaggcctttgcgaaatgcgggggaaa

SEQ ID NO: 615899 - DNA, 886 bp, Homo sapiens
agcggagttttggtccagtatgtcccggcctgaggtgtcgtgtcggatccctccttttcccggcgcctcaagcggaagaccctatccctcaagagatcacgtagtccgaaggaccctcagagagtgggtcacccacagatgagtgcaatgctgatcgactggcatgcagcttgatgctgaagaatcaacgtggccaactgggacggaaaaagcaagacttattaatcaagtgtctggaatgtccatacactagcacagtgaagatcctctctgcgaacgacgtaggactgctgttaacgtgaatgaatacatctgaacgctaacatagtcaggaagaccagaggtatctttgcgagccaatagtataccgagaaagtcgtcagtgtcacgcattcctagctgtcctttgcagacaagctgacaccaggaccagcaaaacgaaacgctaacgggactctgacaacccttcgtgttccatggaagttgctgtctgatcattctcttgtctttaacaagctttggactagattccaacacagcttacagtaccgtcttgtgggccttcattgaaatattctatgagacgataatgctcaggatgttaggacacacaacattaatcgacacatacgcgaggaaagactttccactaaaggttggtgctacttaatgctagaggtcctatgacaagaccggtgcctgcactgtttctttgctagacgaacggttcaatggacttaagaagttgcccataattagtatgaattgaaaacttttaaagacttgaattgtccttgcatcgcaataccgctaggggttacagcacatgcactatcattatagggattcgtaagaatttcccggaacaactacaccgtgttggtga

SEQ ID NO: 615900 - DNA, 647 bp, Homo sapiens
  misc_feature (18)..(18): n is a, c, g, or t
  misc_feature (132)..(132): n is a, c, g, or t
  misc_feature (188)..(188): n is a, c, g, or t
  misc_feature (200)..(200): n is a, c, g, or t
  misc_feature (211)..(211): n is a, c, g, or t
  misc_feature (223)..(223): n is a, c, g, or t
  misc_feature (242)..(243): n is a, c, g, or t
  misc_feature (245)..(245): n is a, c, g, or t
  misc_feature (251)..(251): n is a, c, g, or t
  misc_feature (273)..(273): n is a, c, g, or t
  misc_feature (304)..(306): n is a, c, g, or t
  misc_feature (312)..(312): n is a, c, g, or t
  misc_feature (316)..(316): n is a, c, g, or t
  misc_feature (319)..(319): n is a, c, g, or t
  misc_feature (340)..(340): n is a, c, g, or t
  misc_feature (342)..(342): n is a, c, g, or t
  misc_feature (357)..(357): n is a, c, g, or t
  misc_feature (360)..(360): n is a, c, g, or t
  misc_feature (368)..(371): n is a, c, g, or t
  misc_feature (394)..(394): n is a, c, g, or t
  misc_feature (421)..(421): n is a, c, g, or t
  misc_feature (444)..(444): n is a, c, g, or t
  misc_feature (468)..(468): n is a, c, g, or t
  misc_feature (474)..(474): n is a, c, g, or t
  misc_feature (501)..(501): n is a, c, g, or t
  misc_feature (516)..(516): n is a, c, g, or t
  misc_feature (612)..(612): n is a, c, g, or t
  misc_feature (614)..(614): n is a, c, g, or t
taaccaaacaaccaacanttcttcaacacagaaagtaaagcattatccagggcttggactgtttttcaagaaagccccaaatcccctggcaggaggaagtaacagcagtaaagccccatcccaggcccagtngttcccacgaaaaaaaccaggtggagacccagcatgattgcggattgattacaagnacccaggagggntttattttttnttttcaacatcntgttctgcggcttccttgnntntttttncccgtttgctgaagagccgggngttggcacgggccatagggagactagcgaannntttttntttnttnttttcctcagtgatgattcgngntttctccttcttatngtngttccggnnnngcatgttcggtccggtcagctgngtggcctgtttttgttcttcagcaganctgtctccctgcgggggggccgngggcttgctggggaagaggatgantttggngcggtactccttcagccgctgcacgtnggcctgcagggactncgtggacttgtaccgccttctcggatccacagaaatgccgatggtccgggccaccttcttgtgaatgccggccaccctgagctcctccaggctgangncgcggccggcgcgcaccttcgtgtggtaccgaa

SEQ ID NO: 615901 - DNA, 654 bp, Homo sapiens
  misc_feature (8)..(8): n is a, c, g, or t
  misc_feature (10)..(10): n is a, c, g, or t
  misc_feature (14)..(14): n is a, c, g, or t
  misc_feature (20)..(20): n is a, c, g, or t
  misc_feature (40)..(40): n is a, c, g, or t
  misc_feature (76)..(76): n is a, c, g, or t
  misc_feature (79)..(79): n is a, c, g, or t
ggatgggnangggnataaantccgggttttgaaagcccgntatgaaggcctggggcacggggcgagttttcaaggnagnggggggctgtctgccaacccccaaatgccacacgccgcccctctaccgcatgcgaatctttgcgcctaaccatgtggacggcaagtcccgattctggcactatgtatgtcagataaagaagatgaagaagttttgaggggagattgcctactgggggcaggcgttggagaagtcacccctgcgggtgaagaactcagggatctggctgggctatgactcccggagcgggacccacaacatgtaccgggaagaccgggacctgagcaccgcaggcgatgggacccagagctaccgagacatgggtgcccggcaccgggacgggagccactgcaatcggaacatgaaggtggaggagaacgcggacagcaagtgcaggcgggcgggtggcaagcagttacacgacttcgaggccaaggtccggttgccccactgggaactggggcctgcagtacagggcacgctttaagagcaaagagggccaacaccgttcgtgcgggtgaagggcccctcgaacggggagggccccaagaaagctaaggaagggccccggtagaagaaaccgggcgcaggggcaa

SEQ ID NO: 615902 - DNA, 784 bp, Homo sapiens
gtcacattgaagatacagtatttttgtaggtatttataaactgttctaaatgatagactatagaaaacattgtgtcatatgaaggtaagatcagtccattatttggatcatttaaaactgaacattacaccttctgggctttgatttatgaagtggcacagaatctaactttgcactgaatatcttttcattcacatctcctctggccttagtcgaacaatggcaacagtgacagaagattctatcaaacctcagaatatagtagaaataattaagctgttgaatgagtcgttcctaaattatgactactgtgtaagtggaccaagttggtgaagcagaatgtgacaaaggttgattaaggaaggaacaactcaaggacatcgggaatgataactttgttccacttgagaagctgacttgatgttttactgtaactttttaaagtgttgttagtccgtttttgttatgttgcaaaagaaaatagtatttacaggtggcttcttttaaaatatgcacaatataaagcaggaatgtatatgaaactgtcagatttgtatcgtattgcagagtattagctttgaaatttgaagtaaagaaagctgttgtagttttaaaatgccttatgggtactcagtttagaaatgttcttgctaatactttgatgtacttagagctattgggtgtagaactttaaactggagggatttacccggggtgtacattgcaagtggcttttataaggtggtctataatggtgtaaaaaggtattttcacactgggaaag

SEQ ID NO: 615903 - DNA, 199 bp, Homo sapiens
ctcggtcttcgatgacgtctgctgtagaagctttctaatattttttaattcagttattgtatttctaggatttctatttggtttaaaaaattgtttctatttatttattaaatttagtattttgttcctgggctgtttccataatttcacttaattttctatccatattttttgtgattccctgaactttaagagaatt

SEQ ID NO: 615904 - DNA, 325 bp, Homo sapiens
tcggtccctgtgtgatagacaactagggtcagtttgcaggtggtaagccatttgccaagatagttgtaggcaaagaagggcagatttattagagaaatgtgaaattatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 615905 - DNA, 648 bp, Homo sapiens
ggcacggttatggagccctgttaccccctcctcggtccccgagagccaggtccgcttctgcagggttcccaggtcgccccgactccaggggccggagcgtgacaccagactcgctggcgcttcatgagagaacttccaaaaggtggaaacagatctggagagggcacgatacggagttgtgtacaaagccagcaaacaagttgacgggagaggtggtggctgcttaggacaatactgcctgtgacactagagacgtgagggtgtgcccagtacgtgccatccgagagatctcgtctgacttaaggagacttaaccaatcctaagtattgtcaagctgactggagtgtcattcacagcagaagagataagaactctaacctgtgttttcgaactttactgcagccaagactctcgaagaaattcggtggactgccgcatgctactcacgtggccattccgtcttgcccgctcaatcaagagcatagtctggttccagacatgggtccagggacttagactttcgtgccattctcatcgggatccatccgagcgagagcttaaaactcagaaatcatgcttaattaacacatgaggggggccatcaagctagcagactttggactagccagagcttttggagtccctgat

SEQ ID NO: 615906 - DNA, 704 bp, Homo sapiens
tatttaatataccatgcaagtatatttactctaaaattccaaagatcttttgatgttttcatctgtttcagtataatttagagaccgattctttgcttttcaataagaaaataaagttaggataaagagtataaatatatagtagaacaaagaaagtgaaaaccagaaataaaatctctcaaaaaaatagcaatacatgtaaatgtataaagcagcataaaaattgaaaatggttttaatacttattgaaaaagataaacaaagtcagaaggttcagacttttttttaaatccaaaaccataaaaaaaaaaactgtgaaaacatataactaatttatttcttgtatctttttgtcttcactttggttgatcctttagcttttgaggtttggggctcaatctctttaactactctttttataagtacacttctagcatcatttgaaataactttaacctcatcagcattttctattatcacattggttccaatctcatcatctccattttctgagctaaccctagagcataacttcttagtagtactcgattgatcagccatattagacaacgctgtcgaaccacgcttagatgaaggagtagactgttcattggtcgtagcatcttgaacagttcttcgttgctattagttaacatcaattgacccctttccataaaaattgagaaatttttattgatctatga

SEQ ID NO: 615907 - DNA, 475 bp, Homo sapiens
gccttccaaagtgctgggattacaggtgtaagccactgtacccagccagagaaagaggcatttttaacagcctcttaaatttattagaatcgtggatattttccttgatattactgaagcaattctcctgcctcagcctcccgagcagctgggactacaggtatgcactgctaagtctggctaattttggtatttttagtagagacgaggtttcaccatgttggccaggctggttttgaactcctgacctcaagtgatctgcccgcctcaacctcccaaagtgctgggattacaagcgtaagccacatgctcagtcccagaagtctgttttatgttctctcctagtcattaccctcctccattccaacaggtagccactattctgacttcctctggtagtattggtgttcacctacaagcttgagacttggtaataattgccacaaacctccttgaagataaagtcatgttggtg

SEQ ID NO: 615908 - DNA, 151 bp, Homo sapiens
gtattcaatttggcaggtatcgcctgcatgtatgtccccactggtgtccgtgcgacggccaaagcccacagcgacagtagcagtggaaagaactgctggaaggaaagcactgcaggtacatgccacatccagtctgcctggcgttcagggt

SEQ ID NO: 615909 - DNA, 109 bp, Homo sapiens
gggggcgggccgcggcgggaaggggccgaagggtctgtagccgggaatgcgctgcgcgcaggggggatcacagaccatttctttctttcggccaggcgaggccctgacg

SEQ ID NO: 615910 - DNA, 823 bp, Homo sapiens
  misc_feature (37)..(37): n is a, c, g, or t
  misc_feature (271)..(273): n is a, c, g, or t
  misc_feature (284)..(284): n is a, c, g, or t
  misc_feature (354)..(354): n is a, c, g, or t
  misc_feature (378)..(378): n is a, c, g, or t
  misc_feature (390)..(390): n is a, c, g, or t
  misc_feature (401)..(401): n is a, c, g, or t
  misc_feature (412)..(412): n is a, c, g, or t
  misc_feature (417)..(417): n is a, c, g, or t
  misc_feature (427)..(429): n is a, c, g, or t
  misc_feature (434)..(435): n is a, c, g, or t
  misc_feature (438)..(438): n is a, c, g, or t
  misc_feature (440)..(440): n is a, c, g, or t
  misc_feature (448)..(448): n is a, c, g, or t
  misc_feature (453)..(453): n is a, c, g, or t
  misc_feature (459)..(460): n is a, c, g, or t
  misc_feature (489)..(489): n is a, c, g, or t
  misc_feature (514)..(514): n is a, c, g, or t
  misc_feature (520)..(520): n is a, c, g, or t
  misc_feature (527)..(527): n is a, c, g, or t
  misc_feature (529)..(529): n is a, c, g, or t
  misc_feature (544)..(544): n is a, c, g, or t
  misc_feature (549)..(549): n is a, c, g, or t
  misc_feature (554)..(554): n is a, c, g, or t
  misc_feature (559)..(559): n is a, c, g, or t
  misc_feature (561)..(562): n is a, c, g, or t
tcagcaggaacaagaagacttagaactggctattgcnctcagcaaatctgagatatcagaagcatgaagaattctcttgttcttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttccttataaaagccgtaacccagtnnnagacaatttcncctttcatttaggccccggtccgggtttactttacggggagctttggccgtgccgtggtgctatttactngtaaagctagagcacccaagtttntgccttcggganttatagagaantagtttccccntgcantaccctgtcnnntagtnnatncngatgatanccagngaggtnncttaaagttggcagtattctcccctgatnggactggtgagtgagggtacggganagaatntcttatncntctatgatgggcgcnatggnctaangtgcntnnttaaattcctctacttaattggctttcccagcagattagggcacacttttctgcccaggtttttctcctattggaaacggtgcctgtggttgaccatatgcacaaattcgactttccaaataaaatttacaccctgtgtgaaaactttaacaagtcttgggtttcaatttgacacagaccccggtggcgaatacaccgttccaaacttgaacgtccccgcacgggaaatccataccctagtgagttggccttgcgctattg

SEQ ID NO: 615911 - DNA, 184 bp, Homo sapiens
tttatcgtgaaatctatccatgatctgatatgagagtaataatagcaacattaaaaagagtaccttaagattttatacaacagtacaaacgatactcaagtgcaatactacctacgtccaaaatctaaatcaaaatcaaacttacccatcagaagactaagagatgcaatgggagacaactgac

SEQ ID NO: 615912 - DNA, 172 bp, Homo sapiens
ccccacccccatgtccaccatgaccctcttcccacggtgacctgggctccctccccaatcatctttcctgttccagaaaggtggggctgaggtgtctccatttctgcctcaacttcatggtgcactgagctgtaactttttccttccctattaaaattagaacctgagtata

SEQ ID NO: 615913 - DNA, 395 bp, Homo sapiens
acaggttccccgctcagtgcccgagagattgtatggtcagtcccactcctctggaccatccccctgtacctgggagctttcctgtcaacagtgggctgactcctcagaattctactgtggtcttgtggctgcagtcatgaggtgtagtgtgcggataacagaggtagagcttgtctgtgcctcaggacagttattgccataagttcccatgagtaagacggaacaggtgatacattgaacaaaaagcagtccctgctccaagaagtatctatggttctccctgaatatcattctcaaaatggatgggccgccatcggatcctaacaaacttcccagtgtcgaatagaaccaatcattggtgtctcccgctaatagggaagcaccaacatcgttga

SEQ ID NO: 615914 - DNA, 545 bp, Homo sapiens
cctttaaaaacctctttcttggttttttcataaattatttaaaaccccatggatttggggcctttaaagaaagcctagaaattattttttttgggagcccaagcaattgttagcaggccttccaccaccttgtttccaaatttgtcctttttataccaaggtaagagatgcggggcctggcacccgcttccagtaaggattggggcgctgtgcaacgcagtgggcttgggcgctttgcagcagctcttgggcaggcccaaagcgcttcacctgcttgggtgccgtggctcacacctgtaatcccagcactttggaaggccgaggtcggcggatcacttgagctcaggagttcaagaccagcctgtgcaacatggtgaaaccccgtctctactaaaaatacaaaaaaattagccaggtgtggtggcaggcacctgtaatcccagctactcggaaggctaaggcaggagaatcacttaaacccgggaggtggaggtttcattaaacgcagttaaaacctttgcaagccaatagtaagacccaaatag

SEQ ID NO: 615915 - DNA, 775 bp, Homo sapiens
ccctaacagggccctcatccagacctccataatgatctccggctacccatgtgatcacagttccactccataccgctcctcatactaggcctagtaagcaacagcactaaccatataccaatgatggcgcgatgtaacagagaaagcacataccaaggacaccaacaccactgtccaaaaaggccttcgatacgggataatcctatttattacctcagaagttttcgatcttcgcaggattgaatctgagccttttaacacatccagctctagcacctaccccgccaattaggagggcactggccccaagaggcatcagcccgctaaatcgccctagaagtcccactcctaaacacatccgtattactcgcatcaggagtatcaatcacctgagctcaccattagtctaatagaaaacaacgcgaaaacacacaaataattcaggcaatgcttaattaacaagttgtcacctgggtctctatttgtaccccttcctacaagtcctcagcagtacttcgaagatctcccttcagccatttgccgacggaatcctacggctcaagcattgctttgtagccacaggctgtccacggactgcagcgtcattcttggctcaactttgcctcaactgtatctgttccatccggcacctacatactttcacttttacatcccaaagcatcacttttgggtttcgaaaggccgcccgcctgaatactgggatacggacgaatgtgggagaggaatacggaatgtcacacacttaatgctgagg

SEQ ID NO: 615916 - DNA, 235 bp, Homo sapiens
ccctataaaattgtttccttttcttttggccttttacaaatagggtcccataatggggcctctttaacataaaggaaaaaaggcatatgcttatatggatgttttggtagaattggctaaaggttcccccagaaataagttaatgggctgaagtttatagctggggggataactgtcaaatctttttgtaaattcccttttttttagccccccaaataatccaaaccccccctta

SEQ ID NO: 615917 - DNA, 206 bp, Homo sapiens
cctggtcgtcgatagcccgcacctgctgcaaccaacatccgtaccgtgctcggctccatggagctggatgcgatgctcagcacagcgtgacggcatcaacgaaaaactgctgcgcaccgtcacgaagccaccgcaccgtggggcatcaagatcacccggatcgagatcaaggacatcagcccgcctgccgacctgatggccgccat

SEQ ID NO: 615918 - DNA, 242 bp, Homo sapiens
accaccaccgccccggccgccaacagggcgaggtcttcgaccacacccagcagatagccgagggcctcgcgtttttccccgagttgccaagccgcgaatccgtcatagacctccacgaccatcttcaccgccgccgccgccaggatgatctgaccgattaccggcacgaacgataaagccagcgccaacaggctcagaccggcttcgcggtaggcgtccagacgcgcctggcgcacccgggc

SEQ ID NO: 615919 - DNA, 231 bp, Homo sapiens
  misc_feature (58)..(58): n is a, c, g, or t
  misc_feature (87)..(87): n is a, c, g, or t
  misc_feature (93)..(94): n is a, c, g, or t
  misc_feature (141)..(141): n is a, c, g, or t
ccgccgctttccttaaccacaaatcaggccggacaggagagggaggggtggggggacnagtggtgtgggcattcagactgccagcanctttgnnctatctacatgcctgtgggctcccccgatgcggtgcagaacagttcnctgggccactctctggcctggcttggggttttgggcggaaaggccatgggaaacccccggtttgtccccgcccgggccccaaaacccgcc

SEQ ID NO: 615920 - DNA, 488 bp, Homo sapiens
tgcccccccgaggttgaagccccattacgcgccaacttcacatatcgggaaacaattcgggcccggggtccacttgttcccgccgccgtgggaggagttggccctgaacgagttggtaaccttaaggtgcttggcacgtggtttcagccccaaggatgtgttggttcgctggttgcaggggtcacaggaattgccccgcgaaaagtacctgatttgggcttcccggcaggagcccagccagggcccccccccttttgttgtgaccagcatattgggggtggcaaccaaggattggaaaaaggggggacaccttttcttgcagggtgggccacggggccctgccgttggctttcacacaaaagaccttggcccgcttggggggtaaacccccccatgtcaatgggtttgttgtcatggggggggtggggggcccctgttattgagcggcccgccggtccccccccctgaataaactccatgttccccca

SEQ ID NO: 615921 - DNA, 225 bp, Homo sapiens
tctgtatttttagtataggccgggttttgccatgttggccaggtttggtcttgaactcctgacctcaggtgacccacttgcctcaacttcccaaagtgctggcattacaggcacgagccatcatgcccagcccaaaagtggggctttcatttcaacctgctgctctctaagtcaacgttcatgactattcacttggtactctctaccctggcaccaatctttcat

SEQ ID NO: 615922 - DNA, 1096 bp, Homo sapiens
  misc_feature (284)..(284): n is a, c, g, or t
  misc_feature (356)..(356): n is a, c, g, or t
  misc_feature (360)..(360): n is a, c, g, or t
  misc_feature (410)..(410): n is a, c, g, or t
cgaagagttcacaacgtgtagaacgcctggaagccggcgggtgcctgctgtgttggaacagaatgctaaacgcacttccagcacgtcctgtccgtatctcagaggttcggaagacttatcgaccatgtgagcgcagcgtcctgctttgtttggcttgcttgacgtgctgcgcgactgagtgcgacagtcgtctgcagtacacacagcactagaaacacttgatgcagcattgtggacgactggaacgatcttcgcgtgtgcagtcatgcgagacttcatcccgnaaccatctagacccccgacgtcgtggtcgcggaagacacttcccacggtgtgatgctcgtgacaagcctagnaggntggacagtcatcgcgagtgaccgagcgtcgatcattcaaaccctagcagncccgctattccttaaacgcgactggatcgaattgactggggacgtaccgaacacactgcgacgcgagtctaatgcgtgcaccagcgggtcataagtcatcctaccgactgttgcgtgcggtctcaactgttgggggaggccggcaacacgggtatccatgactcaaggctatctggctagtgacgcccttgtcgttgttgcataagcgttactcccgatctcaaatggtaccttgactgctcgcatgtacctaacatgatttacctggcgactctagtgccttccgtcatgtccttctgggtaacgccatcagggtagttagcgacttttcacaggcgtttgctgcccatactccatagcgtgctcggatgggggcgacaagaggactggttctgtgagactctgctccgacgccttgtcatgccatggtgcgctcgaatggcccagggcctctagatgggtaccttgacgccatttggcccaatagcatcgcttcgaccttggcctttgtcctgtcggaaaccaagggtttccggcgcccctttccccgtgacccgttatccaattcccttagaagccctggtactggatcaaatcccttggatcatggggccgaaacgccgggaccttggaatggcggggcttctcttgttccgcaaagggttcccaggacattccacaaatct

SEQ ID NO: 615923 - DNA, 703 bp, Homo sapiens
gggaaacgggacgcgatgttgatctcgggttgctcaaagggaccttcctagctctgtcctgaaccatcggagctcatcctggacagtctcactccgtggcggacgactgtgatgactgctggttggaagccagattgtagccacacatccgcccctgcctagcccagagccctggagcagcaactgtgctgcagatcacagacactgtgaggatatgaatgtacgggtgagcacctcagcccctctttccccaaactcgtgcacaagcgtgtggcagtgtctaccattctccatcatggactatgtggtgttcgtcctgctgctggttctctctcttgccattgggctctaccatgcttgtcgttggctggggccgtgcaatactgtttggtgagctgctagatggcggatcgcaaaatgtgtgctgccattccggtgtgcactgtgccctgactggccatccttaccagatcagccagtgaggccatcctgggtgtgtctgtcagagatctacagattatgggacccaatatttggttcctgtggctgctgctacttatctggcggctgcatgatacctgcaaaatcttcatccccgattaactacgtgctgcaatctcaaccattgcctatgagatacctgtagtttcggattcatgtaaacactgtgccgacctgtgtggaactgtgaacttcattcttt

SEQ ID NO: 615924 - DNA, 151 bp, Homo sapiens
acagttctcagcagggccatggcagagtggtgcggcacagggtggcagcagccacgcaagcaccagcaccagcctgcggcatcacacaccccgtgcacaggcatcgtgcatccatctgccagcacttgcgcgccaagcatcggcagagtgg

SEQ ID NO: 615925 - DNA, 344 bp, Homo sapiens
aataagacaagaagtgtccagattacacctgccccatcacgtactacctcccctgctgacatcaccatcctgactgagacggctccgccagcagtgggcagacacaactttgacaccgccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgt

SEQ ID NO: 615926 - DNA, 83 bp, Homo sapiens
ttgaccccgggcattggcggattgttgcagtaccgctgagatggcaccactgcactccagccaggcgagagtgagactctgtc

SEQ ID NO: 615927 - DNA, 371 bp, Homo sapiens
gggtttcccgtggggggacctttttaaacccccgccccggcccccccgggggggttttggcccatttttaacccggggccctttgggttaaccccccggggggggggcccctttttgggggggggcccgggggccggggtttccaggccccccttttggaaaaaaaaccaagggggggggggcccccccccaaacccccggggggggtttaaggggcccttgggggggggggggggcccccccgggggggggggggggggttttttttttcccccccggggggggggggggaaaccggggggggggggggttttcccccttcccgggggggggaaaaccccccgcccccaaaaaaggggtttttcccttta

SEQ ID NO: 615928 - DNA, 243 bp, Homo sapiens
attcgcgggcgcgtcgacaaacaaattagccggtcgtggtggtgttacatacctttaatcccagctacttgggtggctgaggcgggagaatcgcttgaacccaggaggctgaggttgtagtgagctgcgttcaaaccactggactccagcatgggcgacagagcaagactctgtcctggggaaaaaaaaaatgtgatagacattgccacttctttctaactgtgtacaacttgatcaaataat

SEQ ID NO: 615929 - DNA, 205 bp, Homo sapiens
tgcagccaatagccttgttgttggacacccccttcgaatgatgaaattaatgcagttgctatatggtggaacacatccgcgaaggaatattatgttaatgaggccgcatgattataagtgtcaaactttgttgtgttcatattcatgttagtgggtgtaaaacactgtgtgagccaaatgagttatggttttaagtgggatcaga

SEQ ID NO: 615930 - DNA, 297 bp, Homo sapiens
  misc_feature (268)..(268): n is a, c, g, or t
  misc_feature (293)..(294): n is a, c, g, or t
cctctctgtcttcttcccatcatcctaagcctagtccgtaatcacataagctattccgcccgagcaatctcgaattacaatatatacacgcgagacaaagcaagtgcaaccagtaagtactagctaagtcaagcgcccatgaatcatacgaaggccccgcagcaataggatcctcccgaatcaaccctgaccccgctcctaatcacataacctattcccccgagcaatctcaattacaatatatacaccaacaaacaatgttcaacgncagtaactgactactaatgagatcnnccg

SEQ ID NO: 615931 - DNA, 865 bp, Homo sapiens
  misc_feature (144)..(144): n is a, c, g, or t
gtaccaggaagaacgctacgtaacagcagttggagaagcgctttccgctatgacaaactcctacttgtaagacatctcaacaggagcgcaggaatgctgctttaggcaggttggctaatccacgataagcaaagcagaatcttngcctttctgagatcggcgggcctacctattctggcccatgctgttgactgtgtgggttcctagtgagagagaatatacttggtgggcatcacttgaacaattttcatggctatgttcgacggcagagtctgaatgtcaatacggttgctgcataatcgtctggagtattggtgatttccacgatgaaacgtgagtagatgcccgccgagaggacccttctccgcttgtaaatcctagagtgacatttgaggatcgcccaaaaaagtgatcccgagagcagttggccgagattgggagactctagtgggctagcgtgaagttgcataggtagcacttgcatagtcgcgcaaacgaaaacgcgatcgtacaaatacagtcccctatgtagaaaggagccaggacgcactttgggatcacgtatcggtgggcacaatacccttgtcgaccgacaagcgcatgaacgggtttactacacccgaagagtcccccacagtaggagaatgtgagacagaaagcccgaaggacgccatttcgtgcaaccactgaacatttggtaaagccggaagggcgagatctgggtagactcggaaatggctacatacggtggatatatacttatgggcaaacgtcgagtaaggtttacctaacacctgtcgagttgcaaaatcgcaaagatgtctcccccgaagaggggcacaccattgcctaagtttgaacctaa

SEQ ID NO: 615932 - DNA, 434 bp, Homo sapiens
cctttggcttagtggttttggagtcctggtattattttctttttagaagagattaaatgagatgtgtgtgcaatgcactgcacaccaccttccttagagacagagagggcccggaattcgagtctgtgttttcatagcctcatttaaagaacatgaaaagaaacagatgacattcactgatactcattcatccatttcatctgagacccttcagcttttaggtgtctgtgaaagacaatggagaatctccttagtcagagtcgggagtcctggattccaacactgaccctgagaagcagccagctgtgggacctggcacaggtcacctcccctccatggaaatgaagataaacctcccatcctgtagagttcactgattctctgtccctgtttgctcactgaggcataagttaactgcagtaaactgttcactt

SEQ ID NO: 615933 - DNA, 386 bp, Homo sapiens
  misc_feature (17)..(17): n is a, c, g, or t
atctagaggatccctgncgggtgaggagtgagacacgtcccaaggaaaaaaaaagggtgggggggtagttcttaagcgttgaagatttccttttgggaaagtaataaaggtagaaatattaataattttcctaaaacatctccctaagaagtcactgataactataattagtttaaatttattcttacactacttaagaaaaatttcatttagaaaaggctaccatgagatctttggactatatggagtagactgcatacagatctctttatttctattatgaatattttagcgattataatcagctattccactgagtattagattgggtcactaagtaactcatgtttttctttagtcaatcattcactccttcacccaagcta

SEQ ID NO: 615934 - DNA, 248 bp, Homo sapiens
taccgtgaaaagtggaacataaaagcttccgagtctcttgctcttgctctccctgctcctctctcaccgggcagagaagtttattaccttaaggttgttcttgaacaaaagaggctgcacatattggatggctaagacagaaagatctcaccagtctggccttccgaagctgaaacaggctcacacagttgggaagaagaagaaccaagattttttctcagagtgttttcttttttttttttttgaga

SEQ ID NO: 615935 - DNA, 356 bp, Homo sapiens
gcaacctccgcctgccccacctcgggttcaagtgattctcctgcctcagcctcctgagtacctgggactacaggcatgcaccaccacggccggctaatttttgtatttttagacgagacaaggtttcaccctgttggccaggctggtctcaaactcctaacctcaggtgatccaactgcctcggcctccaaagtgctgggattacaggtattagcaccgtgcccagcagaattttttaactatttggttacgactaatttggatatgtagtccatgcagctttgatttgtgccataagatgggcaactgcttccttttgtgatagtaaaatttcctaacaggtttgacatgcatac

SEQ ID NO: 615936 - DNA, 517 bp, Homo sapiens
  misc_feature (117)..(117): n is a, c, g, or t
  misc_feature (231)..(231): n is a, c, g, or t
tgacctagaggatccccaggcaaagctcctactatattctaatgttctctttaaatttatattccctgtatacagtatataatattcttctcactttcctaagtcatcactcattgnaaaagcatagataccaagctttgatgagcaacaaaattttctgctgctattcaaatgacccattataatgctatggaaatatctttccctttaacaacttaaataacagcctanaattctgcagattccttaatgacttcatttcttccttctcattagttaaggaaatgcatttctaggccagatctacctctgtgctaccattttatggctcagcattcattttcttccctcattctttattacaaagctatccaaaataaaatctgaaaataagggcaaggaagaaagccagtaagaactactcacatcagatttagaggatatattctcctccacatctgaatcatagggatccacaatatcatcaaatggcggtaacgtagatttcttcttctct

SEQ ID NO: 615937 - DNA, 110 bp, Homo sapiens
tcagcccatggtgatctgaaatggctcaagatgagggcctatgtggaaggaacagggagccagtgatgaaagcccagagaatctcccacatcttcagctgaaggaggaag

SEQ ID NO: 615938 - DNA, 124 bp, Homo sapiens
gtgcgacccggagagaataaggttcgccttcaattcagagtcggagttcggctctgaagcctccagcccatattattttggacccccagcaaagaatggggtggcagcagaagtcagcccagcc

SEQ ID NO: 615939 - DNA, 223 bp, Homo sapiens
ccaccagcaaagacatttatccaaacggaaaggacatatggcaagcctgaggaagccaattgtaggagaaaaaaaaaagggaaatcagtatatccaagagaggtcggcactccatatttatgcacccccatatttatggcagcactacttagagtagccaaaataggaaatcaatctcggggtccaacaacagatgaataaagggaaatagggggtatatacg

SEQ ID NO: 615940 - DNA, 199 bp, Homo sapiens
cactactacactgattggtctccaactcctggctcaagcgatcctcctgcctatgcttgccaaattgctagggattacgagggatgagccacaatggctggcctctgctagttccgtattctctagagttgtctttactttgtgctagtgtgtccctcattgtgcagatcctctgtaaaaattaatacctttttttttt

SEQ ID NO: 615941 - DNA, 563 bp, Homo sapiens
gtaggagggtcgcttgaggccaggagttcgatactagcctgggcaatataacaagaccctgtctctacaaaaaaaatttaagaattttagcccaggtgtggtggcttatgcctgtaatcccagcattttgggaggcctgagatcaggagttcaagaccagcctggccgacatggtgagaccccctctctactaaaaatacaaaaaattagccgggcgtggtagtgggtgcctgtagtcccggcataaaaaaagattttagaggttaaaaaaaaaaaaaaaaaaaaaaaaaaaaaatttttggcaggcctagcgcacccacaataaaaggctttctaaaaacacacagtaggggcgccgaggccccccagaatggttaacacaacacagaggcaacaagcgggcggcccaagaaacaccacgggaccagccacaaattcgctcgaaagccacaccaaaaaaaaaaaggcccggggagacaagcaacgcactacgacacaacaccccgtaggagacacatgaggacaagtgagacctacaaacggtcgcagggagcccgatagat

SEQ ID NO: 615942 - DNA, 512 bp, Homo sapiens
  misc_feature (344)..(344): n is a, c, g, or t
  misc_feature (349)..(349): n is a, c, g, or t
ttaagaatgcccaggctggagtgcagtggcacaaactcggctcactgcaacttccgcctcctgggttcaagagattctcctgcctcagcctcccgagtagctgggactacaggcatgtaccaccacacctggctaattttttgtttttttagtagagaaggggtttcaccatagttagccaggatggtctcgatctcctgaccttgtgatccaaccacctcggcctcccaaagtgctgggattacaggcgtgagccactttatacaatactcattcagttcttatcaaagaaataacccagacttaatcttgaatgatacgattatgcccaatattaagtaaanatatnagaaaaatatagagttatcttacgacccagcagtttggctgctaggtatatacccaagcagaatgggaaacgtatgtgtacactaaaacttgtgcaagactgttcattacaataaacaaaaagtggaaagaacccaaatgtccatcaactgataaataaacaa

SEQ ID NO: 615943 - DNA, 1818 bp, Homo sapiens
  misc_feature (831)..(831): n is a, c, g, or t
  misc_feature (999)..(999): n is a, c, g, or t
  misc_feature (1154)..(1154): n is a, c, g, or t
  misc_feature (1170)..(1170): n is a, c, g, or t
  misc_feature (1498)..(1498): n is a, c, g, or t
atccggcttgttagcgcccatactgctctgtggtgaccgtccagctcctggttgtgtcgtcttcctatggatactcccggggggcagtactccgttcttgccgtgtattttgccgtcggcccctcggtgctggctggattaactcgtttttatcatcgagttacctctgtttttcggctcccttgtggcccctactttttgcggcccctcctattggtgaccccgtgttgtgtgctccaccaataaatctgcgcggctgggtgatccccgggttccggtggatttttccccccggggaatttttctcttgctgatgaatctccaacggcgcggctcccggatatgctgaatatattgatgggtgtgatactcccccccacgcggcccgccgatggatgctcctcctatttaaccaggggcggggcccctcttgtttttcagagccctcgccgtcctcttgtgatggtgagcccctctcttctgcgggtccctttatcgcgaccaaatgtgtgtgagaatgtgtttcacaacacgtgtgtgcccgacaagcttcgcccaaatgtcaagccgcgctgctccttcttcttaattattacattgatggcgcctccttctactctgttttcctcgcgctacccgaccaccgcggtgtgtagcccaaatatatttgcccccgcaaattggaagtggggccccccccgatgtttggttttaatacaacccggggatggttgattatggccaaacaccatctaatccccaacaagtggggccacctcacaccaagacgagcaacaaccacgacacctgtgggtgtcccacacaaaaatnggcgcccgcattcttccggaaatgatatcccggcgggggaaatataataactctcctcaatcttttttatgttttaaccgcccttccaagaggagaaggtgtttttttgtggtgttgtctttccgcgccacgggggagatttttttttttttcttagagcagcccccncttgtgtgtgagccccgacgacgttgctcaacagccgccataatagcgcccccggtaatcctccccccccccccacttttttataggggagagggcggcgacaccttggggcgccccgccccaaaaccaacagggcaatttctaacacctcccgncgtatatatgttcccncccttatagagaatgtgcccacacaacgtccctattataacacacacattccgctattgtatactttctggcacattcacagggagtgttatatcacagttcaacaccttgagagctttcacaccacatatagtttctatatatatagagaatacacacacctctgtgatatacccacatatataaatattctaagccacatgcggtttatatcacacaaatatttttacatgggggtctcttttatagtttgacacacttcctccacgaaagcgcgtccgagcagtatacattacagcagatgtatcctcctgtctcaccacatgtnttccgtacgagcaattatttcacggggatgcacacaatatttctatcgtagcaccacaagagcttccactcaggaatatcaaccgtgcgattagatggcgtccaacatttgcgcctcattaatactgagttcagtacgcgcgcaccgacataatcaatattccccatctatcacaatacccaagcaatactcagcaatctctagtgtattcgataaacctcccgcgcatcgattactggcattttgtagaactggtttgacatatttctgtaggtccccaatttattcgatagaagggttcttaaaaaagaaataaaaaa

SEQ ID NO: 615944 - DNA, 428 bp, Homo sapiens
ttaagaatgcccaggctggagtgcagtggcacaaactcggctcactgcaacttccgcctcctgggttcaagagattctcctgcctcagcctcccgagtagctgggactacaggcatgtaccaccacacctggctaattttttgtttttttagtagagaaggggtttcaccatagttagccaggatggtctcgatctcctgaccttgtgatccaaccacctcggcctcccaaagtgctgggattacaggcgtgagccactttatacaatactcattcagttcttatcaaagaaataacccagacttaatcttgaatgatacgattatgcccaatattaagtctgggttatttctttgataagaactgaatgtgccgggcgcactggctcacgcctgtatcccgcactttggagccgagtgggtgtcaca

SEQ ID NO: 615945 - DNA, 205 bp, Homo sapiens
tgacatgcgggaccacttgagccgggcgtacagcatgatagacgagctctgccaggacaggatcttcacccgcgagctctaggatacctaccactacctgcccttgagcctgcccaaccggaggcctcagttcttctttccgaagtaccgcatcgctcgcagcttgatgcccttctctccgaacgagcgcatgaagttgcacgcc

SEQ ID NO: 615946 - DNA, 342 bp, Homo sapiens
gcaaggggcatacctaatgcttaccgaacgaaaaattctaggctatataccactacgcaaaggcccaacgtgtaggcccctacgggctaatacaacctgcgctgacgccataaaactcttcaccaaggagcccctaaaacccgcacatctaccatcaccctctacatcagcgcccgacttagctctcaccatcgctcttctactatgaacccccctccccatgcccaataaatactaccgtatggccaccataattaccccccatatccttacactatcctcatcaccccaataaacaatattaaacaccaaataccactagctccctcacaaagcccataa

SEQ ID NO: 615947 - DNA, 1088 bp, Homo sapiens
gcgccgcatgtgccgctagcggtgccccgcctgctgcggtggtaccagccaggatggcggagtgtgaacgttgaccgtgggagcagggtatatggactagcttgtcagtgttgctgccctgatgcacagctcaggctggggctatatactctgttcgagtgcgtgcgcctggcaggtcacgatctagctggacagttggactacgtccaatgaccgcgtgcagtcgaacgtgctgacgatgaggctgtcttggccgcgcgagatccggcagcgtttcacgctaggatactcgcttgcatgccatgagaccctacatcgaaagcgtagtgggatgaattgcctactcctcatgctacgtgggaagcgggttgtcgaccacgcggggacgccaatgggacaccaagtgtgacaccctgtgcaagcgacgcgtggtgtcaagggactacagcaagcgcgctgatgcgtagactgtggacagattacactgagcgaggcccattactacgcaccattgagctatgatttcctcaacgaacatcgagcctttggcacaacggcgatataagttagcgaagcgcacgcgctcatcgagcgtgcgttcgatagcataggcgcaccaacatcggggacagtcaccacagcggctagagatgagcgcgacattggttcatatgacggtctgtctaaagctcgcagttggcgctttaatagatggaacattgcggcacgaatattgagcagcgaccgcgaagacctaccaacccaaaaggtctggggacacatcgtcgcacaaacgtactccagagacatatcccacttggcccattggactacccacccaaccattgggaaggggagcgcacatagacgtgaggagccaaaagcggaacgcaagcgaaggacgttatcactcaaatggttagcacaatcagcaacttatcagcacgttggagctgctacacaaactacgtacaccggcgagccaaacgtcacggaaaccgttctcttcaacatcgccagggagtttcactaccacaatggggtttggatacaacaaacaggaccttcgccagcaccctcacgatgac

SEQ ID NO: 615948 - DNA, 1166 bp, Homo sapiens
gtgggcgccctatgtttgttcacgggctctcctcagccctctgtgggaattgttccttcttgttcctggtgcctcctcagactatttctcttgtgatgggatatcctggggtggagttttggctggtccacaggctgttccacctcctgggggcccttttctactcggagagtcctctccgtggggggaaatttttctgcggggcgaccccttgtgggtcctcatgtccctcgttcctcctcttggggaagtctccacctgtcgctcagctgcccctaaattgttttcccacatcacccggtgtgttttcttggagaccacgccgcctttgggtctttgagcttcttcgtttagtcttgccaccacggcgttgggtaatcccgcgtcgcacatggcttccaaaggcctctcttcaatgctgaaatttgagtgatccacctcaatgcgcccaaattgtttcaccctgggttacacaaccccatgtgcccacctcgccgttggggtgcccaaacacacttcctcgtgtccctcccaaggtcacatattgttttggcacattgtgttaaaagtgctgttaatttttctttggaaatggagaaaggcaccacctttaggctgtcccccgtgaatttcgcggtgccaactctgaatatggccccccccacaagtcccctgtggcttaatgtttcggttgttcttttgtgaattgccccaattaatgttaaagaggacccctgaatggctagggctccacccaattttgtaattcccacatcgtttgtgtgaagacacgagtttggttttccccctgagaacttggttaagacttgtgctacctgtggaccctgagtcccgcactatggcagtccccctttggtgacactttcctggccactttttgtttcccttgttgtggatggtgggttgtgcccaccttcctggaggtgagagaccacgctccctggggtgtagaatttcccggaggcgtgccgctggggtcacgagtataaacttgaagcacgagttctcgtggcactgtccttttcctctgcacacccattggctcgctttcttcttttttgtgtcttctctttgataaggatcccgtttcctaagggtgccaaaataaaaatacaatttgggccaacaaaagaagaaataaaaaa

SEQ ID NO: 615949 - DNA, 689 bp, Homo sapiens
  misc_feature (237)..(237): n is a, c, g, or t
  misc_feature (689)..(689): n is a, c, g, or t
ggctcatgaaataggtttggaagtaaagtaacaacagaccctcttgctaaagacaaaatgatgaatggaggtcatatacacctactctgagcaatcgtgtggaaacatagacgcgctgattcttacaatgccgggggcctggggaccaggcttcgaggatttgtccgtcttgctacattgtggaagccctgacatggcaaggacggtggctggctcaatgtgaaggctccaccttgnttcttatgagactagtagcagcgaactgcgacgatcacttagagaaacaggccgttaggaatccattctcactgtgttcgctctatacaaaacagtggtaggttaatgtgttcagaacgtcgctgtccttactactcttgcggaagtatggaagtcacaactacacagagatttctcagcctacaaattgtgtctatacatttctaagccttgtttgcagaataaacagggcatttaggcaaagccaacaaaagaacaagacaacagcacaacaacaaaaaaacaagtttgtttggcgcccgccctggggcccctagagaaaagttttgttgcaaaacacttgtgcgttggggcgccgggggcccaattgatgtttcgtgaaaccttggtcatatagcgtgtttccccgaaggaagaaccgggggccagcaaagatggcgggaatttccccn

SEQ ID NO: 615950 - DNA, 928 bp, Homo sapiens
  misc_feature (18)..(18): n is a, c, g, or t
  misc_feature (85)..(85): n is a, c, g, or t
  misc_feature (92)..(92): n is a, c, g, or t
  misc_feature (222)..(222): n is a, c, g, or t
  misc_feature (233)..(233): n is a, c, g, or t
  misc_feature (239)..(239): n is a, c, g, or t
  misc_feature (350)..(350): n is a, c, g, or t
  misc_feature (453)..(453): n is a, c, g, or t
  misc_feature (616)..(616): n is a, c, g, or t
  misc_feature (927)..(927): n is a, c, g, or t
gacctcggtatttttttntgcgtgaccaggccttatctccctttctctcctcatttacatcgtctttaaaccctgcttggcaatnccttacncacctccgttattcccaggtaagacagggcgacctggaattccaactacttccttaagatcatccaactattggattattatcctaaatttttcatttttggatcagacaatttgggctccaagcagatncagcagatccncatttnccttcgcggtaattctttttttctgatgggcaagaacaccattattcgcaaggccatccgagggcacctggaaaacaacccagctcttgagaaacttctgcctcatatccnggggaattttggcttttttttcaccaaggaggacctcacttaaatcagggacatttttcttgccaataattttccatcttcttccctttctttttccatttcnccattttaattcactttgccagcccagaacactggtctcgggcccgagaagacctcctttttccaggctttaggtatcaccactaaaatctccatgggcaccatttaaatcctgatttatgtacagctgatcaagactggagacaaagtgggagccagcgaancaacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagttctggccttgtctgtggagacggattacacttcccacttgctgaaaagtcaaggccttcttggctgatcatctgcctttgtng

SEQ ID NO: 615951 - DNA, 571 bp, Homo sapiens
acgcgaagggtgcttacatatctgacacacagtagctagacccaaactgggtatagatacccaactttggctagccttaaaccctaaaagttaattaacaaaattggttgccgaaacccttcgggcccaaggtttaaactttaagagccctgggggggggtttttttcccttttaagagggcctttttttttattttaaaaaccccgaaaaacccccacccctttttggtggaattttttttccccctttttttaaaacccccttttggggggttaaaaaagggggcggccccccccaaaaaaatttttggaggggggcccccccagggggggaagaaaaaccttttttttttctcccaaaaaaaaaaaagggctttttaaaataaaagggggggggggggtggttttgtaaaaaaacaaaaaaggggtgttttttttaaaaggggggggggggtcccaccccccccccccccctcccccttttttttttgaagagaaataaaaaaaccccccccccttttttttttaaaggagagacccccccggaggggggggggcgggcggcccccgg

SEQ ID NO: 615952 - DNA, 1719 bp, Homo sapiens
  misc_feature (684)..(684): n is a, c, g, or t
caaggcgccggtgcagccccagcagtctccatgcggcggcccccggcggcacggacgagcaagccgagcggcaaggatgacgagcgggatgccggggatcaaggactgagagtaacaggagctgtcgtgaagcaggcataacaccagtctctcaagatgtaacttggcatcatgctcgctggaacgtacttagtgggcagcaacggcatacatccactgctcatctgacacagtcgcttgagaggtacattgctgcaaggccatgatttccgcttcctttcctaatcagacccttccgaatgcatcgtttcgagcttgtccctaagaccatcttgaagagaattcacctcgtcgcttcactacacattaattgggcacacatctcgtacatggtacacatctacttgaggagaacaatgtggccccccctgtgggtgaatgtagacttaaaggcggttgtttctcgtcgtggacgttgcatccattgcaattcttcgccggtatttctaggggcccgaagttggacccccagttgtaagttgcgcgggacgtcggttgaaggtagaccataccacatgatcactacggcgttctcaggctggggggccatccccactaggggcaatgggcacatttcggggcgaatcgaatgcgggtggtacagttgacgggtaagttggttcnacgcgacaagttcctcgcgtccaatggggaaggcacagggttgcgtcctcacacgggcaccgttgcgctaggggtcaggacttgggcattggagccggcaagcgaatgcacacgagctcccaacgtcgggtgtaggccctttgctgattccttcgaactcctgggttggaaaggcccaccccattcccgttgccgctcgttattcaaacatcgggggtgccacaaccaaataggccaggctagctcattggaagggccctcttgtgcgggaaacgcctgggcctgataatcgggcacaacatctcggcagggccaatgtgttgggcaaccagttggccctgtggacaggaaaatgggagccactttcgtgcatttggacacggccatttggccttgtacatttgtcgagaacaagggttccgtggcccgtgtttaattctttccatcccaaggtatggggtggtcggcaacgtttcacctggttgccccttggcaagggccgttggacaagaaaaccttcggagccctcgtaccctgggccggttggttggccccactggggcgctgttcgtttcgcggacaaacagggtctagaggccgagccatctcccccttgcacatgtcgtcccgggaaagcgttgggccaatgtgtaaatggccccccagttggaccggtgggtcagatcgggtgttcgcacacgacgcattctttcagcccttacctggcaacaggggactgcttggtataccttatacagtgaaacccagagactggtgctgttgagaggacataaggccccgagcattgcagggtgtgttcccgtcgtacgctgtacgacgatagcgctgccaggacgtcatacatcggcacccttacaacaagacttgctcttcccaggcagcaggcacaacagtgacgacactgtagtcgatgatccggccgtgcggcgccaactatgacacacgacgcgctgtaatcataacgacccagcacgacacacatcgtcagtaagcaaacaacgatacccacacgaa

SEQ ID NO: 615953 - DNA, 289 bp, Homo sapiens
  misc_feature (16)..(16): n is a, c, g, or t
  misc_feature (176)..(176): n is a, c, g, or t
  misc_feature (245)..(245): n is a, c, g, or t
tgctacaggacccggnattgtgtggtgttatgcaaacaattatttatagaaatttaaaattagaacccttacataaaatgaattacaacaaaatctactatgcacaaatatatacaagatcactgaacattacctgattggtagctggaggtttagacagtgttctgacctcatcnacattacctagctgttgttgtgcgagatttcttaatgcaacaagatttgggtgcacgggcgtgttgggncaaaatctctcttaccataacaccacacaattccgggtaccgag

SEQ ID NO: 615954 - DNA, 109 bp, Homo sapiens
atattgttgcctgatttcagagggatattccactaataaatgtatgatgtataccaaaaaaaaataatgatgcactacttggtcaagcagaactagcaactttcatttt

SEQ ID NO: 615955 - DNA, 966 bp, Homo sapiens
  misc_feature (381)..(381): n is a, c, g, or t
  misc_feature (457)..(457): n is a, c, g, or t
  misc_feature (567)..(567): n is a, c, g, or t
  misc_feature (573)..(573): n is a, c, g, or t
ggcactgtgcctatgttgtgaactactacgtgcgagccatctctgtgtgtctgttaagctagtcacgcgtgctcaaactacagggcacaggcatgcgagcgcagattgctcacacatggtcgctcacactatgtcgcgttgatatagaccttctgttgatctagtcctgcttcgatcggtaccttggccgttgactcggcctgcgtagagcacgagttggcacatgaccactgagactgcgtgtgagtaaggtgccatgaaggccgcgtgtggctctaagaccgaacctctcctggtgcagttgtcttacttaggtacgaagttcgggtgagtcctccattatatccgatcgtggtgcccgttccggagcgtatgccatcnttgcgacgcatcctttgtctcgcacaacgtatccttgcgcaccgagcggaacgatttcgcgtggcattccccacanatacgagagttctatgctggccacgctggatacggatctgcagatagcactgacctcgcaccgcgtacatgttggaacgagtacggaagacttggctccttgaactttcntgcgcnaaatgttacgcgcgctactcgtattgcaaccaaaggccgggccttgtcagcgagtgaacacgagttctgttgctccgtcttccccccgtattgggacccatcgaggtcgggaaagtaccttgtctcaattcaaaggggtcgatcgagttggtcctagttcctcgattcgacagggagcgtctactacagccgagtttgggtccgccaagacttacctcgttgagctcggagggaaacgctatctcgaagattagtgcgactcgtagcgcctttgtatatgcccacgagccaccagatttcttcgaggtttgctctctcgagagcgccttcgaagggcgaaattcgggaggcacgcaagaatagatcatcctctagcgcaagattcggagtcag

SEQ ID NO: 615956 - DNA, 338 bp, Homo sapiens
caggacaaatttctttcctcttgccagttgtagaagaaacccatgaggaggccgggcacggtggctcacgccctataatcccagcactttgggaagccaaggcgggtgaatcacctgaggtcaggagttcgagaccagcctggccaacatggtaaaaccccatctctactgaaaatacaaaaattagccagacatggtggcaggcacctgtaatcccagctcctcgggaggccgaggcagaagaatcacctgaacctgggaggtggaagttgcagtgagccaagactgcaccactgcagggtgacagagtaagactcttgtctcggaaaaaaaaaaaa

SEQ ID NO: 615957 - DNA, 1157 bp, Homo sapiens
  misc_feature (32)..(32): n is a, c, g, or t
  misc_feature (48)..(48): n is a, c, g, or t
  misc_feature (160)..(160): n is a, c, g, or t
  misc_feature (162)..(162): n is a, c, g, or t
  misc_feature (172)..(172): n is a, c, g, or t
  misc_feature (291)..(291): n is a, c, g, or t
  misc_feature (308)..(308): n is a, c, g, or t
  misc_feature (310)..(310): n is a, c, g, or t
  misc_feature (326)..(326): n is a, c, g, or t
  misc_feature (329)..(329): n is a, c, g, or t
  misc_feature (336)..(338): n is a, c, g, or t
  misc_feature (358)..(358): n is a, c, g, or t
  misc_feature (360)..(360): n is a, c, g, or t
  misc_feature (375)..(375): n is a, c, g, or t
  misc_feature (377)..(377): n is a, c, g, or t
  misc_feature (390)..(390): n is a, c, g, or t
  misc_feature (392)..(393): n is a, c, g, or t
  misc_feature (1157)..(1157): n is a, c, g, or t
tgggaagccccggcacacgggccagatcgggngggcccggagcagggngccttcgtccacgaatccctccaggggcacagttcaccacagcgcacccccttctggcacggggcaaagggtgtggtcattcagcaagccgggtcggtggagggcaggagangnaggtggtgcncaggtggagtgaaatcacagaagagaggccgagaatcttccctccgaggggggcagctgtgggtgaaccacccaagagggaggccgagaacctcgtggggaaaagtgagtggggttcantacccttaatagtcttnantcccaagaggacgtgncantcgcggnnntagcatacctcttcttccanantcgcgtggcccgagngnccaagaaatttcncnnagggggctcttatacacatttacagactctctgtgtgttctccacatgtggacaccctctcttatcgcggactacccaaatttgggcgcgagtcacgtttaccactcagaaacgaccagtatcagccccgtgcggggaacactcgtggcccgtgggacgcgagggcccccagtgtactccaatctcccaccaaagcgtgaacgatcccagtgcggggaccacgtgaagcgacgtgataccaccactggggggggggtggtccatataacccacacggagcgcccccatcatcacgtgggagaggagaggggcacatcaacagaaaatcccacctattgggcccgcaacgcaccctggtgggcccaagaccccgttgcgccccaccccaacacggggcaagataacacctacacgcctcggacactggactcgaacacatccaggggggtgaccaaccctcggggtgtcggcccaacaagcggcacacccacacaccaggggcccttcaacacccatcggcccctgggcagcagctcccccagcaaacattaccacggctcccctaccattgagagaacaacacgcggtccccgagtctttcccccaccaaactctggtgagagaccgcctcaaatctcttgcaccagaaaacaccttccccgcgggcagacaacagcgcgccacaacgcggcgagcgacaaggaacaggacaccactgtccgcggaaacgtgctggcaaacacacccctattgggtcgtcggan

SEQ ID NO: 615958 - DNA, 221 bp, Homo sapiens
gtacaacaaccccgcgtgacacgtttgactgtgtaacaaacattcacatgtaccaccaaacccaaatttcctcctgcaatgggatgtggtctgtcttcaggggttgaacaatccctagacttccgttcaataactccacataatgtcagttcacatggctgggagactcagaagcgtcaatatggcgagggacagtcactctcattagtacttcgtcgatc

SEQ ID NO: 615959 - DNA, 114 bp, Homo sapiens
tgattatagaggatcccccgaaggcagatgcctgttctgcaaatcctggctctgcattttacaagctgcacaaccttaagtaaattagttggttctatgtgcctcagtcccttc

SEQ ID NO: 615960 - DNA, 153 bp, Homo sapiens
gggaaaaaaccccccttttttttcccccttttttgggggggggaaaaaatcccccggggggaaaaaaaggtttttttttttccgggggaaaaaaaaaaggttttttttttttttttttttccccttggggggaaaaaaaatttttttggggga

SEQ ID NO: 615961 - DNA, 1185 bp, Homo sapiens
  misc_feature (236)..(236): n is a, c, g, or t
  misc_feature (246)..(246): n is a, c, g, or t
  misc_feature (258)..(258): n is a, c, g, or t
  misc_feature (328)..(328): n is a, c, g, or t
  misc_feature (337)..(337): n is a, c, g, or t
  misc_feature (368)..(368): n is a, c, g, or t
  misc_feature (380)..(381): n is a, c, g, or t
  misc_feature (453)..(453): n is a, c, g, or t
  misc_feature (455)..(455): n is a, c, g, or t
  misc_feature (478)..(478): n is a, c, g, or t
  misc_feature (500)..(500): n is a, c, g, or t
  misc_feature (549)..(549): n is a, c, g, or t
  misc_feature (593)..(593): n is a, c, g, or t
  misc_feature (601)..(601): n is a, c, g, or t
  misc_feature (610)..(611): n is a, c, g, or t
  misc_feature (618)..(618): n is a, c, g, or t
  misc_feature (624)..(624): n is a, c, g, or t
  misc_feature (635)..(635): n is a, c, g, or t
  misc_feature (644)..(644): n is a, c, g, or t
ggaagatgaggaagataacaatttgggaaggtacgatgaaaccaaatattgatagggtaaaagtggcgagattcgttcacaggtcaagtctcccagataggtcttgatccatgggggcgcaaggagtttcaggtcattgatggaaacaggtctagcagcccatgtgtgcgttgcattccgtgagtccaagcccagagtcacccaggtcatgagtataaccatgttgtggtggcgtngtctagatgnggtgagacccantgatatgtcatacttgctcgccgtgatcgcgaagcggcaatgcacaacgtaacacctatggcagtgtgtngacacgctntggcacctctgcgcgacatactagtggcganagacgccttagnnacctcaagactgtggggccaacccctgcagcgtccgcgtcgtggagaggaacctgtactggtgatgtagtgngngtgccgttctcaaggaggagtgntgtcccctggcgcatactgagnatctaggggaatgacctgtgtgtgaaaggtagcgatgctatgatggaancgaagcgagacccgctgtgtacctatgatccgagtcagctcagnacagtgancgcccgagnntcagttntgaagnttactctcaanctggggtgntgaaatagttggactgcgtggaacgaacaactggtgggaagcttaaagcgacacgaaggtagctggtcgcgttgacacggggcgcgtttactgcacggcgtgatgattgactcagaggacaggcccagagtcagtggaagtatcgctccaatcctgttgcgttttagggacccatgccgttccgtggctagctggccaaggaatgtttcattaccggggcatcgagattcggcaagtgtttgctatcagccagctccttatttcggatgaagtctgtagagatggaaatccggtctcggttccatctcttgggcggggtggaagaaccaattacatcggttggtacaaacttccaaggctatgagttcctctataatttggggtgaccaggtattccctggaaaatgagggttgtgggacactggtgttctgatgacacacgctgaataatcgtctgactggggaagactaatccggcgaaaggacaacaactgtaatgaatatctcctataaatagcaggcccaataacgtaaaccactg

SEQ ID NO: 615962 - DNA, 484 bp, Homo sapiens
  misc_feature (35)..(35): n is a, c, g, or t
  misc_feature (68)..(68): n is a, c, g, or t
  misc_feature (73)..(73): n is a, c, g, or t
  misc_feature (80)..(80): n is a, c, g, or t
  misc_feature (90)..(90): n is a, c, g, or t
  misc_feature (97)..(97): n is a, c, g, or t
  misc_feature (99)..(100): n is a, c, g, or t
  misc_feature (110)..(110): n is a, c, g, or t
  misc_feature (113)..(113): n is a, c, g, or t
  misc_feature (115)..(115): n is a, c, g, or t
  misc_feature (120)..(120): n is a, c, g, or t
  misc_feature (122)..(122): n is a, c, g, or t
  misc_feature (126)..(126): n is a, c, g, or t
  misc_feature (130)..(130): n is a, c, g, or t
  misc_feature (134)..(134): n is a, c, g, or t
  misc_feature (139)..(139): n is a, c, g, or t
  misc_feature (157)..(157): n is a, c, g, or t
  misc_feature (182)..(182): n is a, c, g, or t
  misc_feature (192)..(192): n is a, c, g, or t
  misc_feature (195)..(195): n is a, c, g, or t
  misc_feature (197)..(197): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (217)..(217): n is a, c, g, or t
  misc_feature (219)..(219): n is a, c, g, or t
  misc_feature (237)..(237): n is a, c, g, or t
  misc_feature (244)..(244): n is a, c, g, or t
  misc_feature (275)..(275): n is a, c, g, or t
  misc_feature (284)..(284): n is a, c, g, or t
  misc_feature (352)..(352): n is a, c, g, or t
  misc_feature (366)..(366): n is a, c, g, or t
  misc_feature (375)..(375): n is a, c, g, or t
  misc_feature (389)..(389): n is a, c, g, or t
  misc_feature (483)..(483): n is a, c, g, or t
tgaggtgcctgccggcaaacttagccttgctgccnagctcctcttcaattctgaggagctggttgtanttggncaagcgntaagatcggnaaggggnannagttttgatntgncnagtgnanagcnccanaacnaggtnagcgatgagggtatattnagtttcccccgaacgatgagaaaanatgacgcccngancnattggantggganagnttgnangactgaggagactcggtnacggagncaatctggttgaatttgagaaggaggaagtngaaggaatnatagttaaaggaattggagataatatttgggttggtaaatgtaagaaaataaaaaaataaatggattnatgaaatggatgtnaaattatgnaaagataaaaagtnataatggtaaaagggatattagatagaaaaaaatgggtagtaattgatgaaggaattgtaaaggtaagaaagaaggtaaggagagaggtaaatna

SEQ ID NO: 615963 - DNA, 151 bp, Homo sapiens
ccaaggaatcgttactccgtttaatgatcgggatgtttatctagggagtggccgtccttttacggctgtgagaatgcggacttcctgtcgcatacacatcttagtcggcatgcacgatatctccctttcgagacatgtcgtccccagggac

SEQ ID NO: 615964 - DNA, 495 bp, Homo sapiens
agagcagatcaagtatgcgatgattatgaacacccaccctctgtggcagatgtcgcactgttctatggagcacaacagtcttcccagatcagtggagcacctaggtacagacgctgagctgaagcagcagatgcttgtcttcagtatgtccaggtgctgaaaaagagagctattcctgcctcattataaagactgacacggttgtaacgtccgcggagtgatcctatatatgggaacatcgatctggatgtgcagaatgtcaagctcgccttgtttagagctctgaagtctcgctggagccttggagtgccattttcatgggctgaagtaacgagctgattaattataaaaccaaaccacaggtatactctaggtatatctgattctgaagtgcgccacacaaggtgagtcggggtattggtcagtagacagggctgaaaggaaaccttgctttccaaatgggcagacttcttgcactctgagtccactgctgta

SEQ ID NO: 615965 - DNA, 1089 bp, Homo sapiens
tgttacttcaggcacgagggcctgggctaccttggaaatgcttctgagcgctgggttctagctgcaaatgaacgagaagaagcccacctggatgtgccccgtgtgcgacaatgccagccccctacgaccagctcatcatctgacgtggctcctctcgaagatcctgagctgagtgtgagtgacgcctgacgagatcgagtacctggtggactggctcgtggtgccctgatccgctgcctgaaaaggagctgcagctgcatgccctgcagggcggccatcctcgtgctgggcccctcggactgccaatgggctcctgcccgcccccagcgtcaacgtggagcggtgccctgggcagcacgggtgtgtggggccctggtgggcagcatggaggactgggaagccgggcgccgatgtggtggacctcacgctggacagctcatcgtcctcggaggattgaggaggaggaggaagaggcaggaggaagacgaggactgaagagtgtgccccgggcccaaagcgcctgtctgacccattccagactgggcctgggtgcctggccttggtgagcccggcctgacactcgacttatcctggtggctacaccaacgcaagaaggggccacggggcccaggccatcgagggcgcaagagggagggaagtgagcctttcctatataacgttagaaagtgggtccgaccggaatgggacattccacccctttaaggcctggatccctggagaggctggaacctcttggactctcctaatcggggggactacaccaaaacaaaggtacacacttgccacaagacacgggataccaaaggcacacatattgaaccacaaagctcagacgtcttaacacacagggccggcgaacccaacaaaaggccggcatcccccgggggaggaaagaccccgaagccggcggcaggggcaaacggggacgcctgatcgtgacccaggcaaggaccccccgcgggagccagcccccacagcgaatgacacgaggtgcgacgagctcacacttggcgacagcaacgcactcaaacgcagtgactcggagagacacccgaggccgcgccaaac

SEQ ID NO: 615966 - DNA, 575 bp, Homo sapiens
  misc_feature (396)..(396): n is a, c, g, or t
  misc_feature (448)..(448): n is a, c, g, or t
  misc_feature (466)..(466): n is a, c, g, or t
  misc_feature (497)..(497): n is a, c, g, or t
  misc_feature (500)..(500): n is a, c, g, or t
  misc_feature (506)..(506): n is a, c, g, or t
  misc_feature (537)..(537): n is a, c, g, or t
  misc_feature (544)..(544): n is a, c, g, or t
ccaaccaatggctatccacgatcatatatggcatttgctccgcacgggcgagcgtcagcccgacttcatcagccagttgagggtccagcatacaagtggacaccgccatcaccttatcgcagtactgaccctgaatcaggaagtgccctcgacggctccatcgttctggatttgcgttacctctgacccactcatttcgcctaatggaaaacccatcatgacgatgacatgctcaaacaccgcgttcggccttattgccctgctgctgatattcggcaaccaagcaaaggctgacggcatggtcccggacacatccgtggtgatcgtccacgaggccgatggtgaagcttccgtttcggtgaccaactccgacagccagctctcgttgttgcatgngaccttgcaggatattccggaagacaccgaacccctgctggtggtgacgccnccgctgtcccgagtcgangcgtccaatcccagttggtgcgctttattcngcnaaaccnaaaaccgttgctcacccagcggctcaacgcnccgtgtncgaaggcatgccccaggaccgcgcagagttt

SEQ ID NO: 615967 - DNA, 220 bp, Homo sapiens
tcaatagtgcgatagtatttattctggaaacggtcatactagtcattcagcatattagcggtgagctgtactcctaagcgctaacatacatgcaggccactactcatgcacctgattggaagcgccagcctaacaatatcaaccattaaccttccctctacacttatcatcttcacaattctaattctactgactatcctagaaatgtgcttttgtgggt

SEQ ID NO: 615968 - DNA, 240 bp, Homo sapiens
cttggacatttccttagcctgaaacgttctgaagtatttgggcgattgggcgggttgagacacacaaagcttcactgccgcccagtatgggcctgcacacacctgctttcttcctcttcttgtaactggatcgggtttttcatcttcttggcggctcctacataatctcccggagccgcaagaggaatctcctgttcgtcctggttcttgggcttgcagttcactttccccgcttaaact

SEQ ID NO: 615969 - DNA, 1659 bp, Homo sapiens
gtcttgggcctgccaggacactccatacaactccctaggacggcacggtgagcaatcgtcagagctcgcgaagcaatcagtggctgtttccgttctcgttgaagagcttagctatgatcatcatcggaagaacaatcaccgcgagcagcagcctctgagcgcttactgcaggcacagcagcggatggtattgtcggtgcgagctgctagtgattgggtctcatagtaccgacggtactcgtcacaatatgggacttggaggtgcgactacaacgctgtgcgcacacgacaagtcaccgccttgtcatgtgtaccaacacagcgtcagtagaaatgcgctgtggtgcatgctgagattgctattgaagtcgcgtacacatacaaacgctattgtgtgactagcggcaacgcaacacgtaactgcacaagatcgtgtgacactcttcttcatctgcatcgtgcccacgcccgttaccacacgtctggagagacgaacccctcgatgcgagcaacaggacggtgacgccagaccgtcaccaagggagggcgacgcggaagcacacaggcagcgggaaccaccagcgaacgtggcctgcacaccgaagagaacaacggaggtacacagacggaaccgacagtggcaccctgccaacactgaggatagggcccacagacacaaatgcggatgtggattagcccacaggcgaacacagggttcagcaagaccacaaaattaatcgcagagacgcatcacgtgggaaggacagcctagatactaggacgagagcaacgacagcgaactcaccattgtggacgcaaccagccacacatatgacccactagaaggagggaaaccacgggcactgacacacacacagagagactacggggggcaccagacacgcccaggcgccagagcaggcgaacaatcacgcagataagggggacaccagggacacagtcacgaaccacccccagggaggcaagcaccacgaaccaaaacgaaggatgaaactaccagaaagcacacgcctcacctactgaggctactaataaccgtagggggagaacatatggacaaaggcacacaacagacaagcacggcgacgcacagagacgggcaacacatgacacacaaggcaaccaccagaccagccgtacaaaaacaacatgaacccaagcaaatgatcgacatgggccacaaccaccggaaacacggagacccacaggcacaggcaaagatccagcgacagcgaacaaggagcgacagcacagaatggaaggacgacaaaacacatgagacagataacgtcgaaaacacgactcagtaacaggaacaccaagcatagaacggacaggctcagctatcgacactcgagtacaaacaaccgttcgggcgaacacaaaaagcgtgtcacaacccagaaagaagacgacaccagcgggatagacgctataacacacacagacagacaggacacgaaacactcaaactggaaagagcgggacgacacccaccaatatacgtaaccatgacgaacaacgtggaacgaccggaactgacaacaccacaccagacacaatagatccaggcatagaatcagccctagaagtggtcgccaatgcgtgcagcagtagtggacaatagtccacccatggg

SEQ ID NO: 615970 - DNA, 714 bp, Homo sapiens
cttactcttctttctgatatagagaaatgttcatgattctgtccaatactctggcacacagagtcagtctgctcacatactgctgcctaacttaagattcttcaaaaaaaacagactgataggatatatatatacatacatatatatatatacaattattttttaatagagataccgatatatagatacacacacacatatactctctactcctgtcttgcagttctgctgtcctatgggcctaggggccacatttaaagcttgtgactgagggtttacccacactaggccagcaactttatcagccaccaacagggcaacataattcaggtaggcgaaagggcatagatcagcctgatatttgagaacataccgttctttgtgacctcatttgatatcctttttttacaaaaccacttgctatcaaaggtctcaatcggtggaactgaacgcatctctgtcaactctagtccacaactgctaagtcactaaaaacctggctcatttgttccgtatgttcccatccaggtcaggagacatagggaatggtacatatagtatctccataccccatgttaccaattcttgttaccacatagtacttgttgacatgccacatattaataatactaagacagggtttaacatcgactactccactagatcaggaataccttgccgacagacgggactatcacacatagtagtcactcg

SEQ ID NO: 615971 - DNA, 271 bp, Homo sapiens
  misc_feature (6)..(6): n is a, c, g, or t
gtcgancgctcatggaatcactgcattcaatcaggatgcattttaataagctgcatggaatccattcagtcatcacgctgcatggactccactgcatacagtcgggatccatttatcacgctgcatggaatacactgggttcaatcgggatgcattttaccatgagcggtcgacggacgcgtccgtcgaccgagggcccaggaggagcgggatagagctggctgacgagatcgccaacagcagcggcaaaggagccctggctgttagagga

SEQ ID NO: 615972 - DNA, 155 bp, Homo sapiens
ttttttttttttaaaaaaaaggttccagtgggtgtttttgtgtgtgacttaattaaaaaacaacgtggctgctttcctggccaatttgcaggctttcttttttttcaggcccccccttttcttgtcccctcaataaagtcccctgtgttccccca

SEQ ID NO: 615973 - DNA, 116 bp, Homo sapiens
gttcacggttggtgctaagacattcaaaatgaggaaacaccggcatttgcccttagtggccctctttagcctcctcctctcaggcattgccatgactcatgcccaacaacaatcag

SEQ ID NO: 615974 - DNA, 196 bp, Homo sapiens
  misc_feature (41)..(41): n is a, c, g, or t
  misc_feature (186)..(186): n is a, c, g, or t
  misc_feature (191)..(191): n is a, c, g, or t
tcggcacagggactggagaagggaggcggcgggcgacgcancgtcgagcgggggagcggcgtgcctgtggagatccgcggaggccgacagattcgttggctgccgtccccgctgctgtgcattgggttaaaaacgacaaccaacatcagccatgaaagatccaagtcgcagcagtactagcccaancatcntcaat

SEQ ID NO: 615975 - DNA, 399 bp, Homo sapiens
tccaaaaggaagcactgatgcattctacaacatggttgagcctagaaaacatgctaagtgaaagaagccagacacaaaagaccaatgtatgactccactgatgtgaaatctccagaatggaccaatccctacagaggggagcagatcagtggctgcccagagcttggaggaggggaatagggagtcactgcttcctgggcaccaggtttcggtttggggtgatgaaatgttctataaccagacagtggtgatggttgcataacattgtaaatatgcttaatgccactggattgcacaatttaaaatggttatgatggtaaattttatgttatgtgtgttttaccacgtacacacataaaacttattttgtgccattaaaaagaaaaagctctatgaagc

SEQ ID NO: 615976 - DNA, 102 bp, Homo sapiens
gccagcaccaaccagacatctatgtacctctgtgccagcagtgctctggcgtggcgggaggacggggagctgttttttggagaaggctctaggctgaccgta

SEQ ID NO: 615977 - DNA, 130 bp, Homo sapiens
tagagcctacgatctctctctgatcttctctgaacacagagtgcagctggcaggagagatcaagcagagtggaccacccctcagctgagaaggcgctgagcaggcaagggcccgaactgctccgagaaag

SEQ ID NO: 615978 - DNA, 219 bp, Homo sapiens
tgggttaataagcaaaatggaagaagactatcaaaagggtgtgtgcggaggtggggggatgtgtgtgtgaaatagatgttaaataggagtgacatattatgaatcacatctgaacgagttcacatgaaagggtacaattatggttacgacatactatcacaggccaatggatgaacaacctgttcaatttacctatgtcccatgaaactgcacgccaca

SEQ ID NO: 615979 - DNA, 871 bp, Homo sapiens
  misc_feature (379)..(379): n is a, c, g, or t
gagcaaagggaatacaatggagcaagatattctttttaacaaatggttctagaacaaagaaataattgatgagctgtacttcattaaaattgaaaccttctgctctgcaaaagactctgccaagagaatgagaagacaagacacagactggaaggaagtatttgcaaaagacatatctgataaaggactgttatccaaaatatacaaaaaattatttcaactttataataagtaaaccaacaacccaattgaaaaataaacaaaagatctgaataaatactaagatacacagatgggaaataagcataagaaaggatgcaaaacactttaagtcatgaaggaaatgtaaattaaaataagataccagtacatacatatntagagtggtcaaaatccagaacactaacaccaccaaatgctggtggggtgtggagcaaaagggactctcattcattgctgatggggaatgcaaaatggtgcagtgactttagaattccgcttgaccgtttcttaaagaaaatgaaacatacccttactaacatgatccagcagtcataacctacttgggtatttacccaaagaaagttgaaaacgtttattcaccaacaatctgtctggatgttcatagcaggttattaattaatggccaactgggggcacaagaaatcttcgtagctgaatgttacaccgacctggatccaatggtgaaatagccgggtcaaggaaaggcgttagccaaaaaatggggctcaagtttttagttaagaccgtgaagcctcggggtccttcaacttgagaccgggcgaaaagtccgcgggggaagaagccctgtcgtgggactacaagtacagcccacattaactcatggtcc

SEQ ID NO: 615980 - DNA, 287 bp, Homo sapiens
  misc_feature (154)..(154): n is a, c, g, or t
  misc_feature (210)..(210): n is a, c, g, or t
  misc_feature (263)..(263): n is a, c, g, or t
ctgaggtgattagaggatcccgtagcagcgcagcacatatgaggagcatgacgttgacgtggaggggagaaagtgggtcgtggggggaagagcggaggggtaagcgtgaggaggcggtggggaaggtggaagtgtatcgcgtggagagtcaggngagggcaatgggaggctggaagtggaggccggtggtggggggtgtgagaggggttntgtggtgtcggtcttccgcagttcgggcggggttcgaactcggatggggcccntctcactcccgaccggataatctt

SEQ ID NO: 615981 - DNA, 160 bp, Homo sapiens
  misc_feature (2)..(2): n is a, c, g, or t
  misc_feature (129)..(129): n is a, c, g, or t
tnataagcgcagggtgcacacgtgctgggcacactggcctctgacacctgagagctgacagcctgcacagagactcagagtgcagagaatctatactgtgtccttagttcacacagtcagggctccctngaatctgcctctctctgtcattatgcttggc

SEQ ID NO: 615982 - DNA, 281 bp, Homo sapiens
gctctagagtatccacccgcggcgagttcatgcaccttgttgtgaatctttctgttgctggcatgaaccatgtatgaaataagaacagtcaggccaggtgcggtggctcatgcctgagatcctagcattttgtgaggcagaggtggttgagtcacttgagggcaggagttcgcaaccagcctgtgcaacatggcgaaaccccatatctacaaaaaatgcaaaaattagccggatgtggtggtgcatgcctgtggtcccagctactcgggaggctgaggtgg

SEQ ID NO: 615983 - DNA, 402 bp, Homo sapiens
  misc_feature (322)..(322): n is a, c, g, or t
atacatccatgtgctaggagggtgatgcatcctgacttcacagggagaaggcactggaagctttgtgttgggaccctcccagaccttgtcctacacatgttttctttggccggacctgatttttatgttttttgccacaataaaattgtaaacctaagtataggggttttctgagctctgtgaatcattctagtgaattactgaactcaggaggtagtaagaaacctcaaatttgtatccattttgtcagaagtatgggtgacctggggaacccccaaacttctgcttggtgtataaagtgaggggcagttttgtaggcagnccggggcccttgttaaagtttgggcctaatttggggatagttagtgttcagaagttcattgttaccagcaaaaaaaaatt

SEQ ID NO: 615984 - DNA, 230 bp, Homo sapiens
  misc_feature (211)..(211): n is a, c, g, or t
acatgaccccttggactgaaggcgctcagtagtaaaggagtgtcatgcaggtcaacacatgtcgcacatggaccacaaagcctgccaccagcaggatgcacggggacttctgggagggggtggacaggatacttatctgtgactggaatgcaggcgagaggcggagaagagagtgaaggataactcatagagggggcagcatttgtttcgngttgaaagaggcagaaaat

SEQ ID NO: 615985 - DNA, 106 bp, Homo sapiens
  misc_feature (77)..(78): n is a, c, g, or t
gcttaattataacattcacagccacagaactaatcatattttatatcttcttcggaaacacacttattccccacctnngttttctatacacccgttggggacaacc

SEQ ID NO: 615986 - DNA, 815 bp, Homo sapiens
tcacccgcgtttattcgatttctgcgcttatcttcgagatgaggcaagacctagcagaggcccaagcccgtccctccctgaccaggagcagcctcatggcgcgaccgagaccgactgtgcggggcatcccctcctgctggtgcccggcgaccccctactctgatgagtggttctgcatgcagggctacgcgagagccagagaggtgtgggcgatgccgtgcgcgccgacaggcatccgatgaccctggatcctacacccagacccggggcccaggactccagccaccgagagatcccacgcgacgggagtggaggcagcagaggccgccctggacgggagcgcggacccgtggccccatcctggtaggacaccggagggcccctggagctcgtgagagggcgcatgccatgcggggacgactggccggggcagggcgatggacccgggaaggacgtgacgctacagtggatgggggacccacaggagcacatcggatcacaatcgggaaaacatatgcgggcatgtcccccaggcgcaggcatcttggcatggtactcgcaccgacattctgccattcccgggaggccagatacactgcaccccacgggcatgggtgcaggggcaagccccctgcgcccagggccccggggctcgaaggctgtgcgaccaacgccgggaccacggcgcgaccaggcaccgacgtcagcgtgggggtggcgggacggctctgggcaccgcggtggtgccggcgaagtcgacgacacaaggcgccagatcgcgccgcacgcggaaaccgcaccagacgcacgcaacc

SEQ ID NO: 615987 - DNA, 90 bp, Homo sapiens
acggccgtgtattactgtgcgaaaggttcccctcatatagcagcagctggtatcgggccgttcgacccctggggccagggaaccctggtc

SEQ ID NO: 615988 - DNA, 749 bp, Homo sapiens
ggactggttccggcggagcatgtgtgaggaatggagccggtagtggtgctgcagtgtgagtgccgcggcctcctccgtagaaccgtggagcaccttcgtgtttgagtaaccgtggtcggaggtggtggagcggtgtgctcagcattcctgctcctgctcgaatggcgttgctgcagtggtggcctgtcgtgtgccgcgttatggagggagtgtgtgcggcagagtattgcggacaccatcgggagcgtaacctggatctccggaggcctggcggaggccggccatctggaggggcattggttggattcggcagtggtagcaagaggacgcttcgagaatcgttcgcatcttacacacatacaggttgctttacactggctgattcagaaactttcattagtctggaagagtgtcgtgggcattacgagagcagggtaaatacgacactaggatggaaacggcacttgccccttggagaagctattgcccaaagacaatgacaagtgcttgggattgtgagcccgaggaatggtatgtggactccgaatgggaatcaaggtaggcaagtcgatcgtcagggaaatacgagatcggatgaagtcgtggctcacgggtacctcaatcacaccttcagagattgagaggacgtacgactctaacaaatccctttcataatattgaagggatccacgtcgaatctgaagataaccgcaagtgacagtcacatcaatgaagtaggtcacggagag

SEQ ID NO: 615989 - DNA, 426 bp, Homo sapiens
gctcatacctgtaatcccagcactttcggaggctgaggcgggcggatcacctgaggctcaggagttcaagaacagcctggccaacatggcaaaaccccatctcttctaaaaatacaaaaattagctgggcatggtgcgggcgcctataatcccagctactcgggagacctgagaatcgcttgaatccaggaggcagaggttgcagtgaaccaagattgtgccaactgcactccagcctggagacagagcaagactctgtctctaaaaaaaaaaagaaaaggaaagaaaagaaaaagaagtaagtgtcttgctgttgcccaggctggtctcaaacttctaggatcaactgatccaccagcctcagcgtccaaaagttctgggactacaagagtgagcgccacagtgcccggcccctgtctctttaaa

SEQ ID NO: 615990 - DNA, 332 bp, Homo sapiens
tgttgagacagagttttttgctcttgttgcccaggctggagtgcaatggcgtgatctcggctcaccgcaacctccgcctcccaggttcaagcgattctcgtgcctcagcctctggagtagctgggattacaggcatgcgccaccacacccggctaatttttgtgtttttagtagatatggggtttatgttggccaggctgatctcaaactcctgacctcgggtgatctacccacctcagcctcccaaagtgctgggattataggcatgagccatcacccctggtcgcaaatatgtttttaatcatccagcaatatctacaatcaataacata

SEQ ID NO: 615991 - DNA, 88 bp, Homo sapiens
gctccattcgggcaccctcggatctccgccctgctacgactccccgaggcgtttcgccgccagcacgcgcccttctgtcgtcttctcg

SEQ ID NO: 615992 - DNA, 175 bp, Homo sapiens
gttgatattgcagaattcggcttagagcggtcgcatcagtttaatgaagtgcacagaatagcaatcaatcagatcatgtcaataaaaataaacacacttatttttacatcaagtgtgctattattatcctccacatggtatacgtgttaagataagagcaccattaactatacta

SEQ ID NO: 615993 - DNA, 747 bp, Homo sapiens
gggtttcacaccaagatctcgctgctcgcccttcttagtggcgtacagctctcttccgtcttggggaaatctcttttctttcggatgacatcgtagacagccgcccaatgttctccggaacaacgacgtggtagccgggtatattgtccccaagagtgtgtcctcgaattaatcgtggctctagtatcgacccttccctcttcaggagtaatattctgtcccccccggccccaccgtgcgaaatttaatcctggggccccacaagaacatggcgtgacaccacagttgctcctctccgtcttaccgacgcatttaactcgcttagtcatgtcttcttgggcgcccaaacgcacccactttgcggcggacacttcgccctttcgactcaccccccttgataggaagggaggttgttctaatcccggcagcacacccgtggagagaacatatcatgggttccgcgcacactaatcttttcgttaataatatctggaggctggtattcgcgaatgatgatgaatgtttgaggatatagaagactctgtcggcccacacatctatgtaccgcaagcaaatattttctccgtattctcctctatgtctttcatcttattatatttatacaaaaaacattttaaccgtgcatcttctttctttaagagcaaatacgtggcgccccacactaattgttttgtcccccacggatcttaataatagagaccctttccccccatcaataaccaaaaa

SEQ ID NO: 615994 - DNA, 929 bp, Homo sapiens
  misc_feature (724)..(725): n is a, c, g, or t
  misc_feature (769)..(769): n is a, c, g, or t
tggatggaggcgggtgggtgagaataagtttctggattttagtctatatattgaataaagcctacaggtcaaagaatagtagggacttctgaagattcaggagtggctttagagaggtagcagggacatcatgatgtttttcagctctttaaaaagataggagtgggccggatgctgtggctcacgcctgtaatcccagcactttgggaggccgaggtgggtggatcacttgaggtcaggagatcgagaccagcctggctaacacagtgaaaccctgtctctactaaaaatacaaaaattagccgggcatggtggcagatgtctgtaatcccagctactcgggaggatgaggcaggagaatttcttgaacccggaaggtggaggttgcagggagccaagatcatgccactgcacttcagcctgggcaacagagtgagactccatcacaaaagaataaaaaaaaggcatggaccttaattcatcctaattcagtttttgtaatcatgtgcagaaacaagtaacatatatataaaaaggcaggagagaatgtaaacttggactttatttattcacagtcaccaagcagtttggttgataatgtctctgaaagcatggacaagtgaaatatgtaagagcagagctcttgggggccaggtgcagtggctcatgcctgtaatcccagccttcgggaggctaaggcaggtggattgcttgagcctaggannttgagaccagttgacaacatgattagacctcatctctacaaaanatacaagaattagctgggtgtggtggcacatgcctgttaatctcactggtcaggaggatcgagaccggagaatggattcgagctggagttgaggtgcaataagctggattaccccatgtatcccagctggttgacaattgagtccggctcaaaaaacaaa

SEQ ID NO: 615995 - DNA, 174 bp, Homo sapiens
cgctacacaatacacatggtttttgggagtgactcaagaagtgaataatgcacaagaatggatcacaagatggaatttatcaaaccctatccttgcttgttaaattttttttttttttttttttaagaatatctgtaatggtactgactttgcttgcttagaagttagcctcct

SEQ ID NO: 615996 - DNA, 407 bp, Homo sapiens
acgagcaattctgaatacaccttcccagtgtctgcagtccagccccttctgtccatcccacagttcctgcctcgggtcagtgttctgggtggtttctctggaatcatccaaccctctcctacctcactgccctcagcccatcctctgagctgcctcagggaaatctccttaaaacttcagattgggtcaccttcctgcttaacaagcttcagtctccatccccatgcccaggtggtcagggtcagaggaaagcagctggacgtttcaactgctcagaccgagggtcagccctggctctctgcttacccactgaacgcctttagacaagtcacccaacttgccaaaccttcatttcttcagctgtgaaatggagataacttgccttactgagggatgagtgagtaaaa

SEQ ID NO: 615997 - DNA, 520 bp, Homo sapiens
aatattagcatggttcactaatacctatatgaggcgatgccctgcgtcgagtgatattgcacagtgtcatcaaaatcatacattcgaactaaatcctctgtaaatataatcatgttctcataatagcattcaccgtacatcttataaatagatgcataggctgtgtagtcacctgcaataaagtctaaaagcattgcccatgtcgtagtggaaatgaatgcgagagtcggccgtcctttgtcgtaattatctctagaagtcacatggagactcgcatgacataaggttactctcaaactactcgtacatggcagaggaaagcttttatctatgcctatctcatgctagtctactaagtcttcagtacttacctcgtacaaatcttaagctgattaaaatcacgttaaaaagttaatgctgaggcatatcttagtaatctatttgactatatatgttaaggtacctgtattaatctctatctttcagagagaaagagacttatctgcggatcgtcaatgct

SEQ ID NO: 615998 - DNA, 951 bp, Homo sapiens
gctcctactcctcattggacccattctaatcggcaatggcattgctaatgcttactcgaacgaaaaattctagagcatatatacaaactacgcaaaggccccaagcgttgtaggcccctacgggtctactacaacctcttcgctgacgccataaaactcttcaccaagagaggcgccctaaaagcccgctcaggatctaccatcactcgctctacatcaaactgaccccgaccataacgcatctcgacacgaatctcgctctttcttactcatgaacacgccccgcttcctcactaaatcaccaaatctcccactggagtttagacatacgacctcttagggtcatcacatgatgatataacttacgcacaatacgtatgagaccataagcctgcataaatcccatggcatgctggattacggaggaggatccaaactctaacaaagatcctaatcgagccgccgtagacgatcagattctaccacaacaaatcggaatagtgatacgacaccctacgacacagtctagtgtctacatagtcatcactcatggataaccaggatctcttttcacctctccaaccttatcacaaacacaagaacacctctgattactcctgccatcatgaccctgagcgcataatatgatttatctccacgactagcagagaccaacggaaccccccttcgactcttggccgaaggggagtccgaaagctagtctcaggcttcaaccatcgaatacgccgcaaggcccctttcgcctattcttcaatagcccgaatacgcgaacattattgataattaaaacaaccctcaagcgaagacaatcttccgaggaacacatattgaagcaatctcccctggagtctaaacaaatatttggccccagaacctgtttgactccctgtctgtgaatccgaaagtaacccggtccgtaagcaatctaag

SEQ ID NO: 615999 - DNA, 174 bp, Homo sapiens
gggagcgaaatcaccagcgatatccgcatggcaactatttgtactatagccatcctgggaatatcctactgcttggcttcataatagcagcatgcagagtcaccacagcctctagccatgctggaaccatgtggacacagtgcacagggggctatggttgaatcccaacgtgtg

SEQ ID NO: 616000 - DNA, 177 bp, Homo sapiens
aatgtgagcacttggcctctttaaagctttaggtacctcagttccaatcagtgaagaagtcatttctttcttcattaaccaacacataaagtaacaaataagatttatggatctggcgttgctgtgagctgtggtgtaggccagaggctacagctccaattcgacccctagcctggg

SEQ ID NO: 616001 - DNA, 283 bp, Homo sapiens
cgagcgcggctgtgttcgaatatgatcctaaagtacagcaatcgcgatgacagatactctccttgacacaattttatagcgctcaaataactacatgaaataagactctaggtcttcagaaatttttcacttaatgtctcactacaggaggatagatcacattttgcagaatgtgtgcatgaaagaataacacagggctttagtatctccacacagtctgcccatgccattagaaaccaacatgatgcactattatcttgttgcttactttccctatctcatc

SEQ ID NO: 616002 - DNA, 1320 bp, Homo sapiens
ggcctctgagaagacagaagtgtctgacattttgaaaatgtctttgcatggaagctcagattgcataccaaatgctcagcaaccataatgcatagtaggatcccccaaaagacaggctcttgccactaagcatgctcactggtgcaagcaggatcattaccctccacccacatggtggtggcaggcatggcgcaacttccactccccagcaaacacgaaccctgtaccacatctcctgctccaactccatccacatgataaggctctctccctacaccgacaagggccacacaatctcgccatcccaaccagcccagctgccctgccgaccccggcccacgctccacctgccgccttactctcagcaactgctaccggcccaaaaagaacaagcctgaaccagcagctccatcacacgacaactctatcactcccacccccctatatccctccagcccacctgccctacctccccatctgactccaaccatcccacgccaatccccaacaatgcactgaactagacctgacgaacacccaccaccaatgcacacaatatcactttcgaaccccttacaccaacaccacccacacacctaccgcatccacacccacgcccctcgcccccctgcccacccgcagccgcaagcacacccaggcccccaccgctgcagccacgaaccccccgccaaccaatctggcgaaccaccggccaacacccacaccgccccccccgccccgtgcctcacaccctccttcccacaaccaccccacacaaccccccccactcatccatcccaccctcacacgccactcataatgcccaacctacacacacccctgacaccccactctacctccctacactccctacacgacaccccccacaacaacactatacaactgccccatccacattccccacactccacccacccccccttagaccacattccatgtatactattcaaacaccaccacaccacactctccctttcccaacaccactgtgcaccactaaaacacacacacacataacacccaaaaccaacattatacaaccaactcacctcaccatcatcaacccacctacataccctcccacaccacatccacaccctctttctccccttactaatccccatactctcatgctcccactctccccccaagcctcccactttctcccccacccccccccccccccacacaccactccccaacctacctccacacctcactacatcactctttccaccacccccaccccaccccaccctcaccccccacttcacctccactctccaaactaccccacat

SEQ ID NO: 616003 - DNA, 709 bp, Homo sapiens
  misc_feature (72)..(72): n is a, c, g, or t
  misc_feature (155)..(155): n is a, c, g, or t
  misc_feature (357)..(358): n is a, c, g, or t
  misc_feature (378)..(378): n is a, c, g, or t
  misc_feature (401)..(401): n is a, c, g, or t
agattcggccattatgtgccgggggcgaagcatttatacggtttttgttctgacaaacctaaccgagccctngggtgatagcgtggtgtgtctccaagaaatagaatcgttagtctcacactcttgaaatttcgcgccacccagaacccttcttnaaatcccctttgtaaactttaacctggttggttccaaaagagggaaccagcttcttttggaccactacggaaacaacacctttgtagcagaggagctaaaaacatttaacacctcactagtaggctctaaagagcacgccacccatattaagaaaggcgttcaaggctcaaccacccacttacctaaaaaatcccaaacatnnataactgaactcctcacacnccaattggacccaatctatcacnccttatagaagaactaattgttagtataacgtaacaatgaaaacacttctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttacccccgctgtttaccaatgtttaacgggcgcggtaccctaaccgggcaaagtagcataatcatttggtccttacttagggacctgtatgaatggctct

SEQ ID NO: 616004 - DNA, 1370 bp, Homo sapiens
agccgataggtaattacataaaacgttctgtaagacgctcaaaggatgacatagctcaattgccgtgtagctggtcaagtgaagcccatgatgaagaacctattatcactctccctcgacagagatcgaagtccttacataccgtcggaataattctatagaacgcgcattgcagtcatcatatgtatctacacgtatactcaggcaatacgcgaataggactaccattgtgatggcttggaccctttgtagtgcttatcaagaacctctacatcacttgactatacacgctttcatttgcatagacatgcgatacgcaaacacaaacacaagattctttctataacaattgtccagagacccggtggttattgcttagagccactcagtgcctaagtaatgtctagcgctaagggcatgagtaaagagcgcgcatcgagtgaacgtgctcaagtctaggattccatgcgttcgagcacgaaagcacatgcaatgcgtcccacacattgtgccaggagtcatacatactcacaagtcacgggatcatactaaatactcacacacgctttaaacagactcgattcaatttggcaccgggcacccaaggccattctgagactctaaggggttcattggatggcccaattgctggttaactccccacgttcttttacactgtctgccctagtccctagcgacgccatatttcagggcctacggttcccgaatttttcccaattgtctcctgatgcgcagacttcaaatcctaaccgtggtaggattatgcagatgggaatccgcggggcaaaacccaatccttgtgaacccatgggagccatgggcacttctctcgaatgttgacggcgtgatttttgctaggtcagctgcgatgtcaactttcgttccgaaccataggtcgcgcctaaaacacgacgacaacatgggaccacgcggtggcccataagcgcattccataagaacaggctccgtttcaagacattcgggacgtaaaagccctcgcccaacaaactgtcatcgcgacaaaaaacgtggacccggtgtgcccagactgagatcactgtcgttactaagcaccggcacagcatttgtcgcagcagcaaaacgtccctgttttaccgcaattagggtcaaccaatgtacagttaaaaagcgttaacacgtagacctcaacacagccgggcatttggtggaccgctttgagcacacccctcccaggacattgtccgtgtgttggccccacagaccaaataacccctcttaacacaggcgggcacagcgacttcacctagcgtacactttgggtgtgccacaaccgatgcgagtcatcctcacggcagctgcgcgtgcac

SEQ ID NO: 616005 - DNA, 460 bp, Homo sapiens
  misc_feature (429)..(429): n is a, c, g, or t
cttctttacactgccggtttacactgtttctccaagacatcacagctgatatctcctggtgctatccccaaactgccactctaaactcttgaagtaaataaataatctttgctggcaggactctgctgaatctccttaggcactctctaatcagatatcctaggtcctcccaattcttagaccttttatacctgtttttctccttctgttattccatttagtttctcaattcatccaaaaccgtatccaggccatcaccaatcattctatatgacaaatgtttcttcttacatccccacaatatcaccctttaccacaagacctcccttcagcttaatctctcccactctaggttcccacgctgcccctaatcccacttgaagcagccctgagaaacatcgcccattctctctccctaccacccctcanaaattttcaccaccccaacacttcaacacta

SEQ ID NO: 616006 - DNA, 820 bp, Homo sapiens
aaatgttttacaacctgaacctcagaactgtgatcctccaaggagcgcgctacttgaagaaaagaaaaaaaaaaaaaaaagtcgaatggcttctcagggatttggtttcccgtgcacatttaagccatagttacagtacaggtggcagtatttaaagcactcagaattacggttctgttaattgtgaaagagggatcgacgtgacgtttcattggcgtgtcccataactaggtgtaaaatatgttttattgtttatatcttatatttttataattatgcaaattacattttaaattttatacagttgtgaagcttctagcggttagttcacacgtgggttgcaatattctgcattgagaaactgtgccaagatggggctgatttcttatttagtataagacttttttggttttttctttattctttaatcctcttcacatttaaaaaaaaaaaattctctctgttaggcccatgggatttacaggtggtcggcgtccatatgaggattgggccaatattcagaaaagaaccttaaatggtcgcttttaaagaccaggtgtcccttccctttctttccaatagaagggctccctggccttattattaaattcaattctgggcacgctgtggtgggggaaaactccttttggctctttcccaaccggtgtttataaagtgcgctggggccaaagatgtgtcgggcacacttcggggccaaaagaaggaccaaaaaggtccattgcaaacatttggagtcttaaaggggtaaagatatcagggagcaagtctgaactttacaaagtgctctgtaaataagact

SEQ ID NO: 616007 - DNA, 1276 bp, Homo sapiens
ggtcgttagttctttctcgtggttccatctgtggtatatcccctccctctattgtctcttgtctttcttattactggttcttctcattcttccttaatccttttgtatttgctctccctatctcttgtatttgtctttggtgttacttctttgtggcttcgtaacctacattgtatgtgtaccgtggtcgcttctcccattgctgtcttgtgctctctcctaggttcggttgtctggatggcatctgttattcctagtgtattctacctatctgttgggttggtgggtcgtttttgtctcgccaagtgttcgtcgctcggttttgagtcgacacgcggatcttctctgtgtctctgcgtcgtcatgggttgttttctgccgtacttgtcttcgttacgtgcttaatgatagtattttttcgaaactgtgtactttgctcgttgttatgctggcttcatttcgtttgtcgcgcattcttgattcaatctggctgtgtctgttttatctgtggtgttttcttctatgctgcttccctcaatcttccatgcctccgtctgtgtgtatctcattagggtgtctttgttctgatgatgtgtttctcctttttgtttatctatcggtgtcttctctactctgttttggacatctttctaggactgtcctctattattggtgtgtgttgtttctgcttcgtcttagccgtcttaggaaatcctcctttttgttgctaattatcgattacttgtctgccgacatatacgcttactacttcgtctcgcggatagattttacttgagattagacgactttcacagataggagcattgccctttctggtgcatcgcgtttcatctctctcgcgcgcgtcgtctcgtctcctctgtctcgtctctctctctcatctcttttctgtctctctctctctcctgctcgtttgctctctgctgccctgcatctcgtgatgaagatcctgttgcgggagtttcccacagccgtttgtagtatctagtatgttagagttgggaggggacacatagttatgtagcccagccccctcattgcccagaggcacccagagggcacagcacgtccagccgtgacgcccagagcagaagccaggaacaccaggttggggccctggtgctgccacactcctctgctggtcgggctgggacccttagcccctaggagaggtgttggtcacagatgttacctcagtatatgtcactgtcgaagatacaaaaaataataacccgggggacactaacaaagaagt

SEQ ID NO: 616008 - DNA, 495 bp, Homo sapiens
tcgacggggtacagcggatgacggggcgacactggtggaggcggcaagtaagaggagcagtaagatgacagtagtctaggagaggcaaggtggtggtgggaaaagtggtaaccaagacgagtcatagagaaacgccacactttgagactaatccaggagtcctttattagccggcgaccgagagacaggctagcgctcaaaattctctcggccccgaagaaggggctagattttcttttatacttgggtttagagaggggagggggaccctagctgtagcaatcttacagaagtaacacaggcaaaaaagttaaaaagacaaacggttacaggaaaacaaacagttccaggtgcaggggctttaaattcatcacaaggtgataggtgtgggggctctgggtgatatctgctggacacaaacgcgggggctttagagtactatcacctgagcaaattcctgggcactgtggacatagcttgcttgccacagtacct

SEQ ID NO: 616009 - DNA, 128 bp, Homo sapiens
acgcgggtaacatcacttatttaccaaagttggctctaataataaaagactcataacaacaacatgctggataagcaacgccagagaatctgaaaccctcatacatctgcttggtggtgacaagtcaa

SEQ ID NO: 616010 - DNA, 446 bp, Homo sapiens
ctttctatgagtttggtatggtgcgaggaaaatcttacagtttgaattatgacctaaaaatttttcattcccatgtctacctaagaaggaagcagtaaatccataatttaccttttgggcaatgctttgtgagcaaaacaaagtcacttttgccataacatcttgaatttaaccatatatgccagattactttatatgcatcaacaagatcaccagtgaagtttaatttagctaaacactggtcctgcttctgagaggggatcctatttgtttggaaaacgtgatatgcacaccaagattaatggctttgtatccgccacagaggtggctgtccaaatttcacatgcacaagaaattgcctggggatcttgggaaactggacactctgcttcaagttaatctggggctggccctgaaattttgcatttttaaagaattttaagggg

SEQ ID NO: 616011 - DNA, 473 bp, Homo sapiens
  misc_feature (4)..(4): n is a, c, g, or t
  misc_feature (324)..(324): n is a, c, g, or t
tacngcggctgtcgccccggtttccgggctttcctttcctgcagttaagcactaaaggaagctattctttgtctcatgtttatacaccagatgactgtccgtatggtgatggaactatgccagattacgaggaattcgagtcctgccagaatttgagtacccctgggcatagcactaatcttgggagaaaaaggtcagaaatagactctcactgacctccaagtgttttacaagttaagaacaaaagaacaaaggtttggggaactcctattctcttggggaccccttattaaaaacacccttaaagctttccttttgaaaaanaattaagccgaaaaccgaaagataaacctattgcgcctttttcccccgtttttaaagcgtataaaccaaggttttaattttttccaataaaaaataggggacaaataagaaaatttgttcagggatttggggaacagggggaatggctt

SEQ ID NO: 616012 - DNA, 711 bp, Homo sapiens
gaacatgaaggcggactaggagcgtgaccactgaagcacagcatcacagggagttggttaggcctccggataactgtgggcgagcctgactaatgttaggctccacaagaagtggaggagtagagtcttctctaaaccacccccaccccgcggggaaagggagactcccattcccggtctgctaagtagccggtgtttttccttgacactgaggctaccgctagaccacggtccgctggcaacgggcatcttcccagacgatggcgttaccgctagaccaaggagccctctggtggccctgtctgggcataacagaagcctcgcactcttgtcttctggtcactcctcactatgtcccctcagctcctatctctgtatggccttttttttcctaggttatgattatagagtgaggattattataatactggaataaagagtaattgctacaaactaatgattaatgatattcatatataatcatatctaagatctatatttggtataactattcttgttttatgttttattatactggaacagcttgtgtccttggtctcttgcctcggcacctgggtggcttgctgcccacatacaacaatgttcatatcctaaatccagaatctgtgaatatcttaggtaatgtgaccaaaggaaacttaagatatagcatagtgtcaggttacaagcagtgacttcatgatcaattac

SEQ ID NO: 616013 - DNA, 162 bp, Homo sapiens
cgttttccaaaatgacttctgaggaaagggaattggatgcatcaatgatcaactggattacattggtagaatttggagataatggtcctaatggtgacttagggatcaagtttttcagctccttgttaaccggcctgaaattcttcagtacactggcaaaat

SEQ ID NO: 616014 - DNA, 685 bp, Homo sapiens
  misc_feature (424)..(424): n is a, c, g, or t
  misc_feature (453)..(453): n is a, c, g, or t
  misc_feature (494)..(494): n is a, c, g, or t
  misc_feature (526)..(526): n is a, c, g, or t
  misc_feature (550)..(550): n is a, c, g, or t
  misc_feature (552)..(552): n is a, c, g, or t
  misc_feature (560)..(560): n is a, c, g, or t
  misc_feature (565)..(566): n is a, c, g, or t
  misc_feature (570)..(570): n is a, c, g, or t
  misc_feature (575)..(575): n is a, c, g, or t
  misc_feature (676)..(676): n is a, c, g, or t
gctccctttagtatatttctagcaaaacagtggcggtgtttcaatcaagtctcattaacaacggcagcaattaggaatgagtcccacctagcttccacatgcgtggccagcagctgtcacacgggcctgtcgtggcactcagcccatggcacagacatatgtggctcagggcaagaaccagtggatggggctctgcacaggaacgctggcctcgggatgggagacccggcctgcccaacactgctcagagcccctcccaactctgacaacaggctcgggtcaggactccccgaaatcaggcaccctcctgccccactgctgagaatccccaacgggccagacctagcttggaaactttcttccacctggctggccaggaaggcagcaaacagagatgatgactcggaatgatgggctattcggnaaatggctagggaaacaactgtttccctnctgtcctggcgggacccaccctgggctaacgggcttccccngagtccagtggctctggggtcctgagtccccnaatggaccctaggctgcgagaagncnggctgtgngggcnntccnaaggnctgcctcaggttttgttcctgtgaaagaaacggtggccccgggggctccaggcgtgctcaagtggggcccagggccaccagcatggggagtgggcaggggntgccacctg

SEQ ID NO: 616015 - DNA, 739 bp, Homo sapiens
ttttttttattatattggcaggtcaaaggctgtttcttaataacaaaggcaaacaaaatgaacacctcagcatgctgctgcagtccatgggggcccatcccaccgtttctggggagaggaatcggggtgggggcgcccgcaagcaggggaagagacacttacacaggccgtgggaccgccaagcaccaccacgctgcaagcctccgtgaagggcagacacatgtggacacacggacacgtgaaaccacaagcacggaaacagccacagggagagacgtggtgaagctggggacaagacattcgagcagctacgtgccaactgctgccctcttctgccacgaagttccctatggcgaagggagccattgctccgtgtttcactaaagaagccacggtaacttaactctgatggcagaaacgtctcgacttctctgaatctgataagctgggccagttaccaccgataacctccacagggactgccgatgagttccagattgtacacttgaaacagggagcattcgatcaaagatacccaaaccaaagaagacctgagcacttaaacagcgtgtccaaatacgtacctcttgtgtcagcgagacctcataagcggaggaccttcacaaggccaagtagacatgacttccctaaaaaatcctactcagggcttgggaccctgaaggaactccttgaagcctgcacccctgtgtgtgccaggcccagaatacccgtgccaggc

SEQ ID NO: 616016 - DNA, 490 bp, Homo sapiens
  misc_feature (185)..(185): n is a, c, g, or t
  misc_feature (240)..(240): n is a, c, g, or t
  misc_feature (312)..(312): n is a, c, g, or t
  misc_feature (360)..(360): n is a, c, g, or t
  misc_feature (396)..(396): n is a, c, g, or t
ggggcaaggggtcaaagactggagagtagtagtgctaagctttggagctgacaaaaaatacactagtagaggaactacggcacagttttcttgcgatctctctccctatccttttctgtccttgctccttcttgatcaaaaataataatttagctgattttttcctgtggctttacctgaatctnaatacagtaaagtcagcattctcttgaactaacaggaaaacctggcaagtgcctnaaagacaaccctgaaagctagaaagggaggagaaaatattctctctgggggttgcctggggacctctagganaggcttaaaaggctgacagatcagggcaatagaacagaaaattaggtnaaatataaaagcccagggatgacaaatttaagtttnaagaatgccacgttatctcccgttgcccactcctagtgggcttataacactttttcagagcaatatggctgggagatattctgtgtatttagcc

SEQ ID NO: 616017 - DNA, 273 bp, Homo sapiens
gctgaatcgatccacatcgtaatatgttattgtctcgtactgtattgggccagctgtaatctaactcagctaggattccggttgtaaattcaagtggaatatgagttggtcttatttgtgcccgttgatatctgagggctgtgaggaagatggccagtaggtcaaagggaatagtgttgaaaagctgaccagtactgggcaggtggccggctgtccctcaggcaccacaacgccgagccacggtaaggggcatgagccacatttgcagaatat

SEQ ID NO: 616018 - DNA, 493 bp, Homo sapiens
tgttctagatttgccaatgtcagggtggggcaaatgtcactgctcagattaggcttgtccaggaagcccggagttctccagctgaatgaggcattcccttcatcttgggtcctgggtgcattctttgcagaatttcaacaatggcactctggacactgtgcttactattaacttatgtttactttcctggcttgcttcacaagaatggaaattccatcaggaaaagagtctctctttacgcccagcactgtgcttggtaactgtggatggatggctgattgcctggaggccacaaatgcccaatccccagcaccaccagctgctggactccctcctccagcccttctggttacttccttcttttcccacctaagcatggttggtcttcatcttgctccttccccactgtcccaacattcactttcattgcacctgttctccaaggctctccatttagatgttctgggttgaccaatctaaccacaaacacctg

SEQ ID NO: 616019 - DNA, 464 bp, Homo sapiens
cttgccagcgagcataatcggcactttccgttatatcgctatcaatgctcgcatcactgcgtgtgtccgtcagtaacgtatcaaatttagcatgcgcttgggtcacaggttcttcttccacaaccgcattgagatagctgcggtcaggaccaatgctcgtttcgccagcgaccgtgtcatctaagtctggctggtcgatgagattgcgctcatgacgcggtatgatgggaataccgtttttatcataattgaccgctgcagcttcagcgtctttacggcgcttaaaactacgaatgaccataaatagccctgcaagcacaataaatgcagcaacggcaattaatataaactgaatagcggtcatgagaaacacatcctaatatatgacaaaagggaatacacaagagaggataaatggcaatagtctagcatggcaaattcatatcgtcaccatatagtcatcg

SEQ ID NO: 616020 - DNA, 674 bp, Homo sapiens
aagaaatatatcttcatggagctttaccattgtcttacaagagcagttaaaaactcattcttacccttgcttgctatcaagggttatgatggctgcctccttatgagactgttagtggagctctagtaagtttccttaagcaccacagaagatcatcatgtgcttggtcccacttttataggaaagaatccaagtttcacccagatagtgtcatcacttagctctcttgaagaagaccagtttagttggatcaatgtctaattacacatatagtaatacaagacaaactttgaatctttacatattaaatgcccactttataccagggtgtaatggttggaattatgggttgagttgtcacagtatagaagaatgtagaatgccactagaatatatctataattcacaaataggtgctcttagggctaccaatattcttgggctgacttaaatgcctggtggcttgcactcttagaaaagagactaacatctgaacaatggccccactattatggtcaatcttaacacagagcttgtgcggaaggtccctatactgctgactgtcaggatctccaggtcccacgatatgtactctgtggtcctgataatgacttcacggagcaccaggcattgcacttacaggacttgtatgtcgtaaaggtagaaactctcca

SEQ ID NO: 616021 - DNA, 724 bp, Homo sapiens
  misc_feature (206)..(206): n is a, c, g, or t
  misc_feature (217)..(217): n is a, c, g, or t
  misc_feature (503)..(503): n is a, c, g, or t
  misc_feature (618)..(618): n is a, c, g, or t
gtgaactacatgattggacagaagtggtaccggcagggagaatatggccagatgatgagctgcacatgtcttgtgaacggataaggagaatccaagtgtgaccctcatgaggcatcgcgttatgatgatgggaagacataccacgtgcgagacatgtgcagaagtatatctcagtgccatatgctactgccatgctttggagccancggggctggcnctgtgccaactgcagatacctgggggtgaccccatgtccgaaggccacttggcagtccttaacaaaattctaggagtgcctgttgaaccaaccctaacgttttttgccaaaaggggctcttgccttaaataaaaggccggccaaaattttcccgaaattaatttttttaacacaggaaaaagggttttttttgcaatatcatataaatggggaaagtgttccaacccccataaaagtttcttttttttttaaagccttttttttgagaaatttttccacttttttnccaaaaaatttttttaaaaaccaccggggggtttgcgggggtgtttaaaaaaagggcggcctttttctttcttttttaaaaaaaaacaccccgcccctttttaaaaaaggggggnatttgtttttgttttaaaaatttttcccacctccggtgtttttttttttttctttttttttgggggggcccccccccccttccttcttttttgtgggggcgggggg

SEQ ID NO: 616022 - DNA, 138 bp, Homo sapiens
  misc_feature (22)..(22): n is a, c, g, or t
cacatgcagccttaaactcctngcctcaagcaatcctcttgcctcagcctcccaagtaggtgggactacaggtgcatgcaattgtgcccacctagaaattcttttctaattcttcaaggtagataaatgaagaaaaaa

SEQ ID NO: 616023 - DNA, 414 bp, Homo sapiens
cattgatacaggtgtcgccatcacgcccagctaattgtatttttagtagagacggggtttctctatgttggccaggctggtctcgaaatctgcctctttatgagagacaaggtttcactctgctgcctggtgggagcgcagtggtgagatcctagctcactgctgcctccaactccttggctcaggtgatcctcccacctcagactcccgagtaactgggactataggtgtgcaccggtacacctggctaattaaaaaatgtcctttttatttgagatggaatctcactacgttgctccggctggtcttgaacttctgggctcaggtaatcctccccagccttggactcccaaagctttggattcacaggcatgagccacctcgcccagccagcacccgtatatggtgagaacc

SEQ ID NO: 616024 - DNA, 946 bp, Homo sapiens
  misc_feature (93)..(93): n is a, c, g, or t
cctgatgtgtggtgtccttgttacttgctgcgtagccattagtttgtgccacggcgtggtcgcacagctgctaattccctggcccattgtgtntgcacgctgatgacgcatccgtgggtcatatagagttggcactgcaagttgtgtactccggacccagtggtattgcgcagtcccacgggggtccactgtgggtgctccccactcttcggtggggggtcgcccactgttgcgcgcgaatcgttgtccccctcgtcaggaggcaaatctttgctcccgaggaagcccccctccacgtggtgtccccctccatgccagtgggtccactgcacgggtcggtggcctgtctttgttcccccccgctgttattaggcgcctgttatgcttcacttttcgtcccaacgaatggggcctttagagtagtatggggcgattaacccctgcgtgtttgttctatcgccactcacctgtcgtctgggctttatctagtggaatgctccccacagctcgcgtgccaaagtctcccgattcgttgcttgtttataacaacgacctctctgattgagggtcccgactcttttgccctcgccctgtgccgaaatattaccgcccccgctcgctcgcgtactctcagccccccccgttggtgtcgctcaacaccgtttctcgcgggagtaccactcagctgcgcctccttctttgttacttggcagcccccccgtcacctagttcactcttctgtggcttactctcgcgggtatcgttttcgcgttgtttgcatgtagcgcccgccttcgattgatctctggttgtcatttgctgtcggtgtgtgccctcttgattcttatgactgccagcgctggttcttatactgagtgatgccttctgtcccgctaacgattgtgtttgctcgttccgggttacaacccccacgcccaacaaaaca

SEQ ID NO: 616025 - DNA, 192 bp, Homo sapiens
aggctcaatagattctcccactttagtctcatgagtagctgggatacaggcatggtggagcatgcctgtggtcccagctactcaggaggctgaggcagaagaatcgcttgaacccgggaggcagaggttgcagtgagccgagatcataccactgcactccagccagggtgacagagcaagacatcatctcaa

SEQ ID NO: 616026 - DNA, 664 bp, Homo sapiens
cgctgcggctgcacacagtaccgcctgtcggagtaactgcgatggatgctgtccgtcggcgtcgctgcggccgtggtccgcgcccttcctcgccgggccggactggtctccagaaatgcttggggttcatctttcattgcttgccaatggaacttccatgcctcctaacactcatcttgcaaaaagactggcgactgctgagatgtcctctattcttgaagacgcgtattcttgtgcagctgatacctctgtgtgactcttgaatgatactgggcgtgtcttaagtattggtgatggtattgcccgcgtacatgggctgacggcacatgttcaagcagcacagaatatggtattagttctcttcaggcttaaagggtatgtccttggaactctggaacctgacccatgttggtgttgtcgctagttcggacatgatcaactagttcaggcacacggcagatatactgcacgaggacaggcacgccatcgtggtacgttccagttcgcgggcatggcatgctgttgcgctcgtgtggttcgatgcccttggtaatgctatggatggccagggtccacttggttccaagacgcgtagcgacttggctgagacgcccggtatcatcctcgattccgtgcggaaccctgcgtactggcttaggctggg

SEQ ID NO: 616027 - DNA, 698 bp, Homo sapiens
ctgccaatgatgccggcttaccacatcttctctcatggatccgtgataccaaactcatcggaacactagtggcgctgcttgccctatcacgacagtcaattctcaacacggacgcgtgcccccgagcacgagacgcgcaactgagcttggcgatgcaagactacacctggaactttgcacgcagcttgtgcacacgccctgtcacagcgcactgtagccttggcactgtgcatgcttgctgccgcacgaaccgcttagacacgctcgcataggaccaaggaacgtactacacgctacagctggatcctcacgcaccctgccttgaataaccatagcctgctcaagatctactcacagaccccctgtgcgactcccggagcccctatgtctcacaaccacttgcgcacacgcaacgaacaagacctacacactgaacttcgcgcaaaaccagaactttgtggtccacatgaacgactcgtgctcctttcgggctcaagcgaaccacgctacttctcctgggccctttcctggcttcccggctccctaagaaacggccttaacccgttaccaaaccaacgacactgcgggtaccacacggcatagttactgggctcaaaacgcctccaaatacggatatcttccagttacctacctcgcgccccaccgactggatgactcctcggtggaaaccccttcat

SEQ ID NO: 616028 - DNA, 343 bp, Homo sapiens
aattgattggtttccttggcaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaa

SEQ ID NO: 616029 - DNA, 139 bp, Homo sapiens
gaggccgcggggggtctcccagtggccaggtagagagcgcgcctaggtccgcggaaccatcgctcctgccgcggcgagcgggccgggagtctacggtcggtcatagccgcccgggaagccgcgcgaggacggcggccgc

SEQ ID NO: 616030 - DNA, 213 bp, Homo sapiens
cctgacttctcctgcgcacttggtttggggcatcggggtttgctatagccgaggccactttgatagaacaaagaaagggacttcgagtaagaaggtgatttacatgccagcctcagtgcccgagagtgaaggagaattcaaatcaaacctcgatcattcctgtgtgtgagcctgggtcggctcacgcgcctagtcatatgcaattggccttta

SEQ ID NO: 616031 - DNA, 488 bp, Homo sapiens
gagcggggtcgggtggccatcattgtggcggcggcgcgggcggctgttactgcggagacccatcccctcccccttctcgcacccctggcagatctgtcagtcggtaaaaagtcccgcagcctgtcaggtgaggccccggcctcgtgccgacgctcattcccgaacgacactgggcggccaggccgatccctgcacgggactcgactgacggcagcatgtcctccttctctgagtcggcgcgggcgacgacgctctgcggagctgagcacctctcagcagagcgtgcagacacctgatcactataggcatcatacaccaacagcaagcacgcgggaaccagtcgtctcacgtgatggaaaacgagaagcatccgtcaacagacaaaagtcaagatagaaagcattagcgtgaagctgatatattaagaagacatgatgtaagtcacaaaaatagtaaacaggaacaggagctgtaattccactacgaga

SEQ ID NO: 616032 - DNA, 130 bp, Homo sapiens
gagtctcaacaatacctgaagtttctcatactcatcatcccaagtctgaaaaacttcaaagcatgctaccataactttttcaaattcttcataagcaacatgcatcaatttcctagtgcccaatactgtg

SEQ ID NO: 616033 - DNA, 1201 bp, Homo sapiens
tgtggaggtgggggcaaccttattatggtggcgggtgggtggaaggggggtctcccagttgagcccgtggtgctataaaaagccggccgtcctccaggggttagactggggaggcttctgggggttctgggagtcccggcgatggcgcacagttccccagaaaaccccctcacagagtctgcccccggatgcacatgacataggaggggcgcttggagagtagacttgagcgctgtagaccggggtcgccctcggtgtggcgccaaggtgcgaattccctcgtggtggcccaagagaggttcagaagttcgtccccgtgagaggcctgaagtctcgaacactagacacccgtgtgggccctcaatacaagtttaaacctatacacaggcccaaaaagtgtgggggcacaccaagaacgagccatggggcctctcagaacaaggccaggaacacgggggggccccctttgtgtgtgtgcaccgtggtgacttttcccaccaacaggggcgcaagagggcacccgtgggcaactgtgacttcccgggcccaggtgtgacaaaagtgtgtgatgccagccacaccccggggccattgacctcgaaaacccaaaaagggcttagaaaccccccacagcacggggccccaggaaggggccaagcaaggctccccggggggctcatcggagagaaacccatcttccacgagcggggaaaaaacccctaagggggcccaagacacccctagacttgcgacgaaaacccccaacgtttctccaaacacaacacacggcgccgtcgaacaacggccgaaactccccgggggcggcgcggacaacacaccccaccgcacacgcgacccaaacctcgcgcacaccacagaaacagccacagagcaagacccaacacccaccgcagacacaccaaacactaaccagcaaggaaccacactccaaggcacacaccacccacacacaaacaatcacctcgcgcccagcaaccgcaccactcaataccgtgatagcccacgtaactaactaagtataacaaacacagatataccaacacaccaccaactccccggaccacctaccattcccacactaaaaacatagttacaaacaacaccccaccccacacccaccacactctaaactccacacatgaatcaccacaccacacaaacccaacacccttattctccc

SEQ ID NO: 616034 - DNA, 300 bp, Homo sapiens
  misc_feature (45)..(45): n is a, c, g, or t
tgatttatctggtaccagtagttaaggagatgtggccagactcantggttcacacctgtgatcccagcactttgggaggctagggttaggaggatcactggaggccaggagttcaaagccagctcaggcaatgtacaagatcctgcctctacaaaaaatacattagccaggcatagtagcggggggctgtggtcccagctacttgggatgctgaggtgagagaattgcttgagcccaggagttggaaggtgcacaaatctactgcactccagactgagtgacagagcgagacactgtccc

SEQ ID NO: 616035 - DNA, 577 bp, Homo sapiens
aaactttgcctgccgattaagctctctgttcaaagggaaccttcaataactggttttccgccactagagaaaagtacagtgttgtcgatgaccgcttctacggccaccacagcctcggccgtggatacccccccgtcccgttatgagccccccgcgcgtaggtatcaacgccctccgtggggggaaaacctcttggcctttgtgcgataagaaacgaacaccgcgcttattgatccggggttgtacggatagacaagtacgctcttttcgcattcttcactcagaggcccactccacgcatacatgttagtgggcacaacgcctcagtaataagtacgctgggtaagaataggttttgctcccccccgactcaacatctggtgggggggctacacaccacacctcgccgcctcgtcttacgaccatacaaataaccgtccctgtttaccaccttgaggaataaacacatacctaacttgtctgttcgaccgccctcttctcccgccgacttctgacccgtccgtatgccttccgcagcccccgcttcatatcccggtgtttcccccccaacatgaca

SEQ ID NO: 616036 - DNA, 407 bp, Homo sapiens
  misc_feature (1)..(1): n is a, c, g, or t
  misc_feature (11)..(11): n is a, c, g, or t
  misc_feature (21)..(21): n is a, c, g, or t
ngagaaggagnctcgttctgnctttcaggctggagtgcagaggcgctatctcggctcactgcaacctccacctgctgggttcaagcaattctctgcctcagcctcccgagcagctgggattacagggcctgccaccatgcccagtatttttgatttagtaagacgggttaccattggcgctggtctaaactctgcctagggaccacccgctagctccaaaggtggatacagggagccaccggcccgccggtagactgctagtcactctaaggcctgcaatattcttgcttaagatttaaggcactttgaaaaatcttagcaaaactcgggttgttgacaattgtgcgcgagataagaattttttggacatcagctagttatggattatgctcagacgcgctgttacc

SEQ ID NO: 616037 - DNA, 148 bp, Homo sapiens
cgcattggggctgacgccgtacctggtgggtgacgaattgactggcgcggatatccagatgagcttcatcggcgaaatcgcccgggcccagggcaagttgcaggcgtacccgaatgtggcggcgtgggtgcaacgctttcaggcaaga

SEQ ID NO: 616038 - DNA, 172 bp, Homo sapiens
aatcgagctcggtccccgcgtgcactcgtgcagtgtagaggcttactagaagtgtgaaaacgtggcttggattaaggcgacagcgatttctaggtagtcagtaaaattataattgtgatgatcatcagtgtaaactgaaggttaaatggtcgatattgcatcttctgccgtg

SEQ ID NO: 616039 - DNA, 366 bp, Homo sapiens
aaaaacttttttggaaaaaaaaaatttttattgctttaaagttttggaaaaggggggttttcttttccgggtttggtggaaagaaatttaaaaactttaaggttgtctttttaaccgcgggccaaatgttgattttttaatattagataaaacggggaaccgaaattccccccaaatttgtagaaaaggggggtctttgggggttgggaagaagttttaatgtaaaaaaccatttacaaaaaagtctgtttaatttcaaaggggtttgtgaaaaaaaacccctggggaaaaagaaacaaaaacatggttaatttggaacttacgtttttaaaccaaaaaaagggcccccaaaacatgttttttcca

SEQ ID NO: 616040 - DNA, 240 bp, Homo sapiens
tagagtgatcccgttgaggcattaggtagtactacatgctggcgtggagagctggatagtcagtgtccatgcccgggttggtcatcagtgtgcatgcagagccgcgggaaccgtcctctctctgtggggtggactggtgtcagcctgggctctgtggaggactctgcgcttagcctgtcgcctcctgtacacacctcccgtcgtgctgtagagtcccacgcgggtgggtaccgatgctcg

SEQ ID NO: 616041 - DNA, 779 bp, Homo sapiens
aagaagctgaagacgacaccgcacacaaaagcaaagaagaaagcacaaataccgacagtacacaacacataaccaatgagcaaggcatgaaaatccgcaaaaaatacaaaccacaacacaaccacgaacagcgcattgtttctatcgcagcaacgaacaaacgcaacacgaagcgccaaaacgagctatgtagtacagaagaactggacgagcgacaccagtctcagagtacaaagagataacacaaaagaatacgcgacaaagtaacttgaactagaacacgactgtaacagacagtgatatagaaaagggaggcaggagagcacactggagtgaggagcggaaagcagaaagcagtgtgcaacacgaacaacgagcaggacaggagaacaggctagggcggaaaaagaaagcattcaagcagagcaggaacagccggggcagaggaggtagctcgacgcgacgcgaccggactaaaggacaaggacgacgagcaaaacagaggcaacgtacaggtaaaggggaaagtacggagaagagtgacgagatacaatgaaaacaatagcaacgacctactgacagagaggcagagcggatagaggagacaagactggcagaaggcaacgggccagaagaaagaccgagagcacaagacggcagcggcgcaagattggcagggaccgggggggaaagacaaagcggggcaagcccgtagcggaaaagagcagaggagcggagcgcgcacagagagggaaggctgacgcgggcgcagcgagaga

SEQ ID NO: 616042 - DNA, 100 bp, Homo sapiens
gagagaactagtctcgagtttttcttttttttttctgaattttccgttggagaccgaaattttcccaatttttttcattctttttttaaaaaaaaggttt

SEQ ID NO: 616043 - DNA, 308 bp, Homo sapiens
gtggtcatagctgctcttgagtaccctagtactgtgagactcctttactactgagtcccttcgttgtgcaggttggggaagcctgcaatccaaatgcctgctgggccagtggccgaggcctacaacccaaaggcgtcctgtatcctgggagaccacagatttcaaggttgacaccaacagctgcaggaagtggggagctcggtgtacccattgacagggtcctaatgggtctgtgaggagctgtgtgaatgcagaaatgactttcttggataggggtctactgcattctgagtattacacccatgcac

SEQ ID NO: 616044 - DNA, 222 bp, Homo sapiens
  misc_feature (211)..(211): n is a, c, g, or t
acacgacgtacgatgtcgagccggtacgagatgatgcagagagacccgcccgtggtgagtcgtgcatgatgccgtgaggatgagaggaggagagaaggaaggaagagcagggtggaaagggatggggagagaattccaggccaagagggacacggtatgagcagatggatcacggaaggggtcgcaatatggaggattcactttcatacanggaatattatt

SEQ ID NO: 616045 - DNA, 1474 bp, Homo sapiens
ggtggttccaaatatttgccaccccacagaaagccgcagcaaagaaagttggccgccccgtctggctgttcttcccttgttgtggccggcgcctctaagaagaagatagaaggacggccccccacccgccgttgtgatgtggggagggaagatccccacggggttggtgaaaccagggagacgaccaacccgtagttgggccccccggagggagaaaagcctgtggggaaacttgggggggcctccccgctccgaagaagaaggggcctcttttgtgaagccccccacccccacaggggttaacacaccctggttggggagaacacacaacaaagagtggtttgtggggccccacgcgaaattatggagaagaattgtggaatctggaacacgttcctcatttaccggggggggtggacacccacaaagagcggcccctaaaaaggggccgtgtgaccaccaaaaggaggggggttctcacccccgagagtctcgttgtgggccgcacccaccgcccgcaagaaaaagacctctgtccccccccccgccgcatgagagacacctctccacccccgtaaggggcacctctttgcggcgcaaaacaggtgttgtgggcccctctggtatattttttggggggcgcacaatatgggcactctccctcgtgcgttcctcgtgttgttatacgccccgtctgatctctgctctttgtgggcacaacacggcgcctctctgtggcgccacacaaaaagagggccgttacacacactatgtcaccctccgccctctctgagaggagtccccaccccacacagagagaagatatcttataaaaagagtttttggcgccacacagggggcttacccctctgtatcttcacacaggacctcgcgcacacagtctgttgagtctcacacagagagccatagtggcgctctccactctctgagctcatttgagcccctcatttcttggagacacacagagagcactctcacaacccctctctctggggtggtgcgctctttttgtgtcccacactcattttgtgtgtgaaaagtggagacccactaggaggctcttttgtgatcacacagttctgagaaaggtgctctgtgtgtgggttggggagaaccacacagagaagccggggtggctctcaccccctccgcgacacaagtgtcctcttgctttggtggcacagagacgagaagtcggccggctctctctcggagagagaagagtttacgcctctaaagtgttcactttgagcacccaccgctccacagtgttgtgccacatggccgccttccacgagaccactggagaggaagaaagaaagcacattcacatgggagaccacctgagaagaaagagccgagaattgccaaaggaaagaaaggaggcttaaatgccacaggagaccagattttgcagttggtggggtttccaataaaagttattttcccctga

SEQ ID NO: 616046 - DNA, 1815 bp, Homo sapiens
  misc_feature (879)..(879): n is a, c, g, or t
  misc_feature (1300)..(1300): n is a, c, g, or t
  misc_feature (1428)..(1428): n is a, c, g, or t
  misc_feature (1625)..(1625): n is a, c, g, or t
cataccttcttcgaagagtgtctgtcatttgatttctgtatctgtttgagttgagcacgccatctccccctacgcggggtgttttttccctcaatggaggagcccacctactaggtttctgagatatgaagtaaatagatggggggcgccctatcaaaatcttggttgtcgcaggacgacagcacacatcacagtggtggggtgggaaatcccacgggcacaaattattccgtcctcctccctaggatggagggatagttactctttcctaattctgtagacaaacaatatatatcgcgaaccgcgtcctcacttgtggcgcgaaacatatcgacccctccctttaataagttggttgggttggtagccatagttatcactgttatactcggggcccttttttatttggtagtcgcgggagttgtttcctccccacgcgacccttatggtggtcgtgtgttcgcacaatagtgtgatttttgctctcgcggggaggaccccacccaccggctgggtggtggcccacctacctcgtcgtctgatgagaacaccaccctggggggcgtgttttttttcttctggaggggaccaccccacctccttcaaggaggagagtttgtgcatccacctcctggccgcgtggtggtggtgaagcaccacaaagctaggaggcccaccacccaccaagggggttgttctacttccttcttcctcctggggaggagggagactaacaggaagggtctccactaatgtggggagtgaagaaattctgtggggggcatgcatgatgagaatgaatgataccgacgccgcgctggtgggtacactgcctccacgaattgtggggggagagcgctacacacacttctcacaggnggaggagtacttctcgtcctctacaagcagtagtggaagagagcgtctctatataatatagagagtagcgctcgagagtagctcaacctcgagaggagagttatctcatctcgtccagagaaagagatgagaggatgctcgagaggggtgatcatcacagcacacacacactactcttctagagcgacgagatggctcttctcgacgaccaccactccttctgtgtgcgccgccgcccctagatggagagacacacacagtcatcagagagagtctctcacacaagaaagttgtttggtctcacaacacaacagagagacccttctgagacgacacacactacacgacacactctctctgctctctactctaataatttagagattatatctctcacacacagccactgtgggacacccanctctatggtgaaggggggcacacacaaaaggtgctcacgcactttcacacagcgcaacacgcagaacacacacgttctacactctcacatcttttgctctctcacacacagcggtcgcacacgcgcgnggagcacactctctcgcgagtactgtgtctcatctctagtagtaataaggtgggaaagagggccacagcagtgttttctcaacactctcgcacagcggttcatcagagaacatcgatgtagaaagagctacgtgtgtatctcacgccctccaggctttgtgggagaccacacaagagacactcggtgtgtcctgcgngtggagagaccccctcagagaggacacacacagagagctgagagtataaacacctctctaggcgtcacacagacattgtcatttactgtgaagagcattctattgtggttaaaagaagagaccactcaagatccctgggggaagactttagacacacaaacaagaagattttttggttgggaggaaaaaa

SEQ ID NO: 616047 - DNA, 412 bp, Homo sapiens
gagctgactctagaggataaacggctgtggaagacggcatgtggccatttcgggccgtgctctgagagccagacgtgggttgggtatgggaggacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttgggttccaagtcaggctttgcaagcctgctgtgtcaagccctctctcggcaccaggccaggtgggccagggtcagccctgg

SEQ ID NO: 616048 - DNA, 150 bp, Homo sapiens
actgtattcaagtcgtgcagtctgcctgggaaacttttactgcggttgagtccggcctccagcctaatctgtttaaccactttcttcatatcggtgacgctgtaggagccagagatggcacgcgagatcgccattgttacctaagctcta

SEQ ID NO: 616049 - DNA, 726 bp, Homo sapiens
  misc_feature (264)..(264): n is a, c, g, or t
ccagcactttcttctcctgaggcgccttgaacccacccgcgttctttccccccgtcgcgccgctccaccgattgaacctcgggggatacaagatccgcccgctctcgctcaccctcgcaaccgcgcccccggcgcccgctcggttttttgtctcgctgtggcgtgcaaacaacaacctgggggtgtgacacagcaaacagacctcgtgggggggctatacaacatccacccgacgtgtcgtatcgacacaaatacgaagagggntctttcttttctctttgtggggaaagggtttataacggacagagcccactcttggtgggcgccccctctgggagatgggcggaacccgcctctgtcacagggaggatttttcccgaagagcacccggctcttctgtccgccgatgacgatatgttgcctggataccgctccactactactgtctggacgcgtcttgagaagagatcgcgacacacagatggatggcgcccccccgagtgtttgcgttgggcgcgcacaacacccctgtcgagattccccagtaccttggggggggctaggggacacggaggacctattgttaatacccgcggattgagtcccaaaggatatcagctgtgtgagcactgcggagtatacaggcgtctgccactcactctgcgcctctctgggctagacataagagaacgagaaattcctctgtccttcaatagaacaagaaaa

SEQ ID NO: 616050 - DNA, 368 bp, Homo sapiens
tagtctcatcattgttgcgcattgcgttggttcacgtctttggctattgtgatgtaggtgccacgaatcaagcatatgtgtgcgtgtgtcgtttatagcagtctgctttctagtcctttggggtatatacccagtaatgggtctggctgggtctgatggtatttctagttctagatccctgtaggaatcggcagactgacttccacaatggtggaagtatgtttacagtgccaccaacagtgtaaaagtgttcctatttctccacatcctctccagcacctgttgtttcctgactttttaatgattggcattctaactggtgtgagatggtatctcattgtgcttttgatttgcatttctctgatggc

SEQ ID NO: 616051 - DNA, 100 bp, Homo sapiens
ttgctccaatcagccagcgtcattgtgtacacgtcgtactgctgtttttgataaccaacaaggggtcaatgtatagaaatccctgatgggagcaagatgc

SEQ ID NO: 616052 - DNA, 199 bp, Homo sapiens
  misc_feature (63)..(63): n is a, c, g, or t
aaaattaacccctgaaaaatgttccttaatgttttaacccttttactgtgtttttattcctcnaacttccctaatgatcaatcaaaaaaagtaccccccctcctttttcctgacagttctttcagctttacagaactgtattataagtttctatgtataactttttacctgtccaaataaaatacctttttttcaaata

SEQ ID NO: 616053 - DNA, 141 bp, Homo sapiens
ggattaccgatacaccgccaaacggcgaagtaaatggaaatgctacagagcaagatactcttctaaaaaatccaacaaggctgggcgtgatggctcacacttgtaataccagcactttgagaggctgaggtggtatagcct

SEQ ID NO: 616054 - DNA, 500 bp, Homo sapiens
  misc_feature (209)..(209): n is a, c, g, or t
  misc_feature (224)..(224): n is a, c, g, or t
  misc_feature (276)..(276): n is a, c, g, or t
  misc_feature (307)..(307): n is a, c, g, or t
  misc_feature (325)..(325): n is a, c, g, or t
  misc_feature (338)..(338): n is a, c, g, or t
  misc_feature (356)..(356): n is a, c, g, or t
  misc_feature (364)..(364): n is a, c, g, or t
  misc_feature (380)..(380): n is a, c, g, or t
  misc_feature (386)..(386): n is a, c, g, or t
  misc_feature (418)..(418): n is a, c, g, or t
  misc_feature (424)..(424): n is a, c, g, or t
  misc_feature (455)..(455): n is a, c, g, or t
  misc_feature (479)..(479): n is a, c, g, or t
tgatagaatcttgctctgtcgcccaggctggagtgcagtggtgagatctcagctcactgcaacctccacctcctgggttgaaagtgattctcgtgcctcagcctcctgagtagctgggactgcaggcacgcgccaccacgcccagctaatttttgtatttgagtagagacggggtttcaccatgttggccaggctggtctcgaactccngcatctcaggtgatntgctcgcctcggcctcccaaagtgatgggattacaggcatgagcaccgtgcncggcttcacacccatttctttaaaaaggatnccgtagcaggcagaaaangccccttccatcntgctcctctgatactgtngccccttngaagataatttccgtnctccancccacgtgtctgtgggttgggaacttgcccangcttgnttcctgggcccccctggaaagccttccccanagctgggtaaatcttgaacttaanggattgcctggggcaacggct

SEQ ID NO: 616055 - DNA, 518 bp, Homo sapiens
aggccggggtatttgacgatctggaaacggttcgcttgcgagcggtgccaacgactgaagagagatgccaaatcacagaagcttttcctatttgcaaaaggagatgactataacacaaagaatggaactgaatgagactctgggcaaaccccagaagagagctacaggacagacaacgaagatagctgaggaacggcaaatggctccctgattctgacatgatggcagaaactgaatgacccagccggaaaagaaatagagaactttcgcgggttgaaaggacggaacggctttataatgttgaaaacttcccatgtgatacaaaccttgggagaagtaacaatgaagaagtgatgaaaggtcaggaagcaaattttgtggtgagggcaagtaacatgaagagttgtccaatgataccagaaagggaaaccttgacagatggggtaattcttgtacaaatgggcatttgcctttcttggttgcaacttaaccgaaaaaggttttccctacggcaaaaa

SEQ ID NO: 616056 - DNA, 744 bp, Homo sapiens
tggtgacaggtgcctcacagaaaaagaaaaaaaaacaacccggcgccacggaaaagccagggcctggttcccccacgatgaaatatgctcttcccatcagtctccgtgcctctgggccctgtgtgtggcaccctgtggagaccctgtggttcaagccacgggtgtgggcctcgagcccgcttagggggtcacccccggtgcgcctctcttgcgccttgcgcgggcgccctgtgcctttgtgcgagggcggagcttgcccttctccctcgagcacagaacccccgtgaaaaaggctttttgctcaggggcggagacgcgatagaagttcctcccttcgtgcaacaagaacttctcgggaaaaataccaggcagaaacgcagaaacgacaattgttctctcctttcaaggcaacaaagaccccctgagggcgggggcggggcccaatggggggccacccggaaaaaggggcgaccagaaaaaccatggcgagtatacagggaccctacgaggaacaaacacaccgcgcgggggaaaaaaacccccgcgacagaaaaggggcaagaaagcaagcggccttttttctcgacaagaggagacaaaccacatcttctggtggggcgccaacttagtgaccatcacgcgactcattagggagggaacacacaacacatcaggaagaaaaccaccgaaacatatacaagcggggcgagtgaacatattaacaagatcacctccatcatcgcg

SEQ ID NO: 616057 - DNA, 246 bp, Homo sapiens
agattagctttcatttggggaatgaagttctgaaatatctaaagcagtttactcatcaattgaaaagtcctccaaaaagagaactattgggaagccccccccagagtggtggaaaagaaaagctcacacagtttttaaaagggaataacttaaaaaaatacttaaatggctaagtttacttggtgcagttaagaattaaacttgtcaattttaacattgctgaaacatctgaaataaacttatgtg

SEQ ID NO: 616058 - DNA, 189 bp, Homo sapiens
ggttaagaccccacacatgcccccagtttgggaaacagtttgttatggggttcccaccttgccaggcatcaacaaacacacacttggggagagaccctacagctgcctcaagttttagaagacctttggccgaggcatcacctcatcaggcaccagaaacccactacatgacagaccagcaggtgctct

SEQ ID NO: 616059 - DNA, 521 bp, Homo sapiens
  misc_feature (490)..(490): n is a, c, g, or t
  misc_feature (506)..(506): n is a, c, g, or t
  misc_feature (509)..(509): n is a, c, g, or t
cttctgttttaagcatgtaacattttattaaggcagtcatttaaacttggtgtagtgggaaattttagacataaattgtttgttttgatggcaagaagactgcataacacggagtgagtctgtgctaactgtacgacactcatggccaaggaacaaagctgggagtgatccaaggctttaaatttgaatatatttaacaccccatactttgctgagtttagagggcagactgtctgctatctttacaatttgcacttgcatttccccctatctttacacagaacctttaagctaagatttagttccctgaaagaatggaaagagatgtattaagattatggggttctcagcagagctggttggcccctttaatattaactgacttatggtaaatgtgattcatctatgaaaatagtggctataaatagatgttaatagcgctcagttgcagaacagccaggttgtgctcacatggccagattaggggaanaaatcctgttgggtanttnatgtggtctttc

SEQ ID NO: 616060 - DNA, 450 bp, Homo sapiens
tataagtagtcatcttcacagatctatcgctatctcatctgacccatacttgaggctaattgacttctaataactaagtcaggcaataaataacccagctggccaggaaactgatgccctgatgtagcagatggaggctctgatgcagtacactccagacaggtcatccattggagactcaggtttcaatgttgccattgatgagggctcatatcccccggtgacgatacaggcacctctcactagccttttgacagcctatttgacacctgggactgtagacggctcatttgcatgacctctccgtctggttataactcacagcaaatctcgagggatccccagatatgctcaacactcaaggtctagtgcacaacgccaataacacctgaatcaagaatcgtacttctacacaaagacaaataacaacactgcacagagaaatataaa

SEQ ID NO: 616061 - DNA, 199 bp, Homo sapiens
ggtagtccaagtaacgttgggcattccggataggccgagaaagtgttggggaagaaagttaaatttacgcgctgaatatgatagtgaaatggattttggcgtaggtttggtatatggtgtttcccccgtgtagaataggggaaatcagtgaatgaagcctcctatgatggcaaattcagctcctattgataggacatag

SEQ ID NO: 616062 - DNA, 850 bp, Homo sapiens
  misc_feature (41)..(41): n is a, c, g, or t
  misc_feature (64)..(64): n is a, c, g, or t
  misc_feature (69)..(69): n is a, c, g, or t
  misc_feature (72)..(74): n is a, c, g, or t
  misc_feature (78)..(78): n is a, c, g, or t
  misc_feature (81)..(81): n is a, c, g, or t
  misc_feature (85)..(85): n is a, c, g, or t
  misc_feature (91)..(93): n is a, c, g, or t
  misc_feature (96)..(96): n is a, c, g, or t
  misc_feature (104)..(104): n is a, c, g, or t
  misc_feature (106)..(106): n is a, c, g, or t
  misc_feature (112)..(112): n is a, c, g, or t
  misc_feature (127)..(127): n is a, c, g, or t
  misc_feature (175)..(177): n is a, c, g, or t
  misc_feature (179)..(179): n is a, c, g, or t
  misc_feature (186)..(187): n is a, c, g, or t
  misc_feature (189)..(189): n is a, c, g, or t
  misc_feature (199)..(199): n is a, c, g, or t
  misc_feature (203)..(204): n is a, c, g, or t
  misc_feature (209)..(209): n is a, c, g, or t
  misc_feature (212)..(212): n is a, c, g, or t
  misc_feature (218)..(219): n is a, c, g, or t
  misc_feature (241)..(241): n is a, c, g, or t
  misc_feature (244)..(245): n is a, c, g, or t
  misc_feature (257)..(258): n is a, c, g, or t
  misc_feature (265)..(267): n is a, c, g, or t
  misc_feature (273)..(275): n is a, c, g, or t
  misc_feature (289)..(289): n is a, c, g, or t
  misc_feature (296)..(296): n is a, c, g, or t
  misc_feature (525)..(525): n is a, c, g, or t
  misc_feature (532)..(532): n is a, c, g, or t
  misc_feature (535)..(535): n is a, c, g, or t
  misc_feature (542)..(542): n is a, c, g, or t
  misc_feature (552)..(552): n is a, c, g, or t
  misc_feature (646)..(646): n is a, c, g, or t
  misc_feature (707)..(707): n is a, c, g, or t
  misc_feature (787)..(787): n is a, c, g, or t
  misc_feature (789)..(789): n is a, c, g, or t
  misc_feature (838)..(838): n is a, c, g, or t
ttttaataaaatagattaatttcatattacatagagagcangtacatccattcatccgtgatanaattntannnatanttnccanaaaacnnntancctttccntngcaatncatccagtataacangccttccacagatacagcattcccatcctcactcccattcctattttnnnanattttannantccacacaantccnnaaccnccnccccgnnatccctataccacaatccagantcnntcagtttcttcnnatatttnnntggggnnntttggggggggggngggtgtntatgtaaaaggctgaagtcccctttaaccaatacccatcccacctcccacactcattattttcccttctccactcttcacaggtgaccactatcaagagtttggtctgtatccttccaatccgtttcaaaaacatgtacatacatatatgcatccattaccaatagatagtactgagttttatgaggaaacttttaattcaaatttacaaaaaagtcattgtactatcngtatcantcngcaactngatccccccncaacaattctggggtctttctgttaattcatgtggatttcatttgttgcgttttacagatatatagtattacataagaatttcccatattgttngtgatgggctttctcagttgtttctaatttttggctactacaaatcaagccacagtaaatntcctagtgcgtatttcctgagcattcatactcataagtagaaccgctaagtatttctcaaattgttccaaggaatgtttncntattcacaaggtcatatgcattttagtacatagcttttccatatttctntttttaatctct

SEQ ID NO: 616063 - DNA, 244 bp, Homo sapiens
ggtcgaacagcggcaggctcgagaccacggcgatcgccttctcgtgcagatggcccgccagcgtcgtcgacagcgcataggcgtcgccttcgaccacagtagcgcgcgggaagcgcttgcgcagcagcgtgcagaaatccgggctgtactcgaccaggatcagacggtcttcgctgatcccacgctcaatcaaggcctcggtcaccgggcctgtgcccgggccgatctcgatcaccggacccgg

SEQ ID NO: 616064 - DNA, 396 bp, Homo sapiens
cggttttatttggtaaatctttcaaggcacacattttaaagagaataaatgagtcttggaaatcttgtaggtaagggtaaatattaggatgcatccagttacatttacacacacatacagttacatttacacacacatacacgcatacagactgagtcacgtgtgtgtatatatatatatgaatttaccaattgatgttaactaatatttataagagccagttggattgatatatattgttgaacctgaaaaatatttattatatacatgtttaaaatacagaaataaatagcaattgcactaggcatttgaaactgtactaaaatataagctgtgaacattttgtgatcattacaaattcttacactgaataaatatttttatttttacaatatt

SEQ ID NO: 616065 - DNA, 410 bp, Homo sapiens
ccttccccacagttaaggataagagacaggtgtaaaggtgagaaagaggccgggcatggtggctcacgcctgtatcccagcactgtgggaggccaaggcagatggatcatctgaagtcaagagttcgagaccagcctggccaacatggcaaaaccccgtctctactaaaaatacaaaattagccgggcgtggtggcacatgcctgtaatcccaggtactcgggaggctgatgcagcagaattgcttgaacccaagaggcggaggttgcagtgagctgagaacgtgccattgcactccagcctgggcaagagagcgagactccatctcaaaaaaaaggtgagacagataggtgtgacctgaggtggcaggtgtgaagataggaaaggcaggctcatgtgggggaagggggg

SEQ ID NO: 616066 - DNA, 514 bp, Homo sapiens
tcacttagaggtaggccatgtatccatccttatcacacttcactttttccaagaactacgactggcttgtcttctatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggattaattaacatacatttaacaaatgtttattgaaggcctactgcaccctagacatgtaataaataaataaacaaataaattagtaaggtagcttcagatagtgataaattctattaagaaaatcaggagccggacatgatggctcgtgcctataatctcagcgacttgggaggctgaagcgggaggattgattgaggccaggagttcaagaccaacctgggcaacttagcagtacctcgttt

SEQ ID NO: 616067 - DNA, 432 bp, Homo sapiens
ttgttggctgggtgttgtggaggcagatcctcattccacctgatgatggctgtgggaatgctccttgccagtcctcagatatatatgatgaggctcctgcacaggcatttagcacaaggggtccagcattgtcttctctccaggcagatattcttagaaactttgatttgcagttgtgagcccgtgaacctgaacggagtgtgtgtgtgtgtgtgtgtgtgattttccatcttgtgggccatggccgctgggtatttatagctagatcttcagggccattctcacgtggctaaagaaaatgaaaacctcatgtggatgttgttttgttttctctctctgcctccggcattgcgagcactccagttgttacacccttattgttgtaactagagccaccctgagcatccctgcgatggagcggttatgtacatt

SEQ ID NO: 616068 - DNA, 580 bp, Homo sapiens
tatcagaatggaccgattgtaatcatgatcgatggagtggaatggaatcatcaaatggagtcaaatggaataatcattgaatagaatttaatggaatcaccgaaatgaatcgaatggaatgatcatcaaatggaatcgaagggaatgatcaaatgggatagaacggagtcatcgaatgaaatcaagtggaatcatcaaatggattcgaatgaaatcatcatcaaatggaatcgaatggaatcatcgaatggactcaaatggaatcatcattgaatggaatgaaatggaatcatcgaatgttatcaaatggaatcatcattgaatgaacatcgacatggaaacatccaatggacccgaatgcaaaaatcatcgaatggaatcgaatgcaatcattgaatggactcgaatggaatcatcatgggatgggatcaaacggactcattgaatggaccagaatggaatcatcatggaattggatcaaacggaatcattgaatggaccagaatggaatcatcgactggacttgaatggaatcatcaaatggactcgaatggaatcatcactgaatggaatcaactgc

SEQ ID NO: 616069 - DNA, 1125 bp, Homo sapiens
  misc_feature (324)..(324): n is a, c, g, or t
  misc_feature (338)..(339): n is a, c, g, or t
  misc_feature (371)..(371): n is a, c, g, or t
  misc_feature (375)..(375): n is a, c, g, or t
agcggattggtttaccctcaagccgatgactccatggctactgatattagttagttgtaggatgtttaaaaagcatatcagacccccagatttcacggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggacctttngtgttaatctgttnnctccccagtcatcttatttggctatgttaaanaaanaaaaaaaaaaaaagcgaaagaaaaaaatggtgtcatcactgtgttgcccaggcgtggtctcggaacttccgtggcctcaagatgacttttcccacctcagattttcccaaagtgctggaatcacaggcatgtacccacagatgccgttggtctaagctgtgttttaaaattatgccatgcatttaaacataacaccgggccatcttccttatcccttccttatcccatatgtttactgacaaccattattttactgtgctacaattaggttataattttccccaggagatttagcttaaggtgtatttaacactatagaaaaatacccctattagcaaccaatgtgtccagctgccccccaaggtttacagcagaggatagccggggaaacaccaacattaacctcttggctatactggtgaaaccccatccctctccgtgccctcctaatggtactgcttacacatttaatttccgttatttatcaccaattgtttaggtggttcataaaccgcggtatttatttaacacctgaaaagggcatgaagcttacaaggggaacgtcatgttgacctttgagcaagaatgataggactcattccccactgtgtaatcgggtacatcacccatcattaggggggaacacttgtgtattggcagagggcttccgcaacttccttactttggaccacaggtccccagaaaagtttaggcacacactttgggtattcccttctcaatctccggata

SEQ ID NO: 616070 - DNA, 774 bp, Homo sapiens
  misc_feature (324)..(324): n is a, c, g, or t
  misc_feature (338)..(339): n is a, c, g, or t
  misc_feature (371)..(371): n is a, c, g, or t
  misc_feature (375)..(375): n is a, c, g, or t
  misc_feature (658)..(658): n is a, c, g, or t
agcggattggtttaccctcaagccgatgactccatggctactgatattagttagttgtaggatgtttaaaaagcatatcagacccccagatttcacggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggacctttngtgttaatctgttnnctccccagtcatcttatttggctatgttaaanaaanaaagagaacaagacaggaagagcgacaagaggacgagatgggtggtcccactggggtagcccaggcgggactcgagctcgcgggcctcaagtcgacttcccacgcactcagagttcccagagggcgggaatcgacagggcctagagccatgagtggccggggcactaaggccggggttcacaacttattcgccagtgcattcgaacataaccccggggccatcttcatatccgtttcctatcccagtattgtcgggtgaaaccatctagtttaagtgtgcatnacattcaggtaaacttgtaccaggagactttagccttacgggtttgtaacacgttatggaacatgtcgcactactagaaccaagtgtccgaggtgaccccaaaggcttaacatgag

SEQ ID NO: 616071 - DNA, 503 bp, Homo sapiens
  misc_feature (87)..(87): n is a, c, g, or t
  misc_feature (333)..(333): n is a, c, g, or t
  misc_feature (430)..(430): n is a, c, g, or t
  misc_feature (486)..(486): n is a, c, g, or t
  misc_feature (488)..(488): n is a, c, g, or t
  misc_feature (491)..(491): n is a, c, g, or t
tatgtcgcgggcgcggagccacctgcgcgccgctctattcctggcagcggcgtctgcgcgcggcgtaacgactccagtgttcggggnctgcggcggtggggctttttggaaagggaccctgggccctgggtttttggggggaccccccctgggttgtgttttgtgtcccctggcacaaagggggttaaatggcccccccaggaacgggcccacgttgggacggtttagccccaacggcggaactttgtcccaggatgggctggcatattgcccttcaaatgttaaccccctttgtccaatgaaacacagagtagctctggtcttactcttgtngagcaagggttgaaagtcggcccaagtctgtggggttgatccccttcaagaaccagcagttttggaatgcccaatggggacacttgttacctttggncgaccggaatgttgtgggctttgcaagtgtagggacgtgaacttggggatcctggncntangaatcattcagt

SEQ ID NO: 616072 - DNA, 157 bp, Homo sapiens
gaaacttccagggtgctgtattaaatgcagattcccagagggaatcccacaagctggcaaactttcctgtcaaggtacatctttcattgtgtgccaatcttgcatctgacctccttcctatttctggggacttcctcattgccacacggtctctcaa

SEQ ID NO: 616073 - DNA, 968 bp, Homo sapiens
tccctttttaatttttatttgtattaataactggttacacgggggattcataattaggcatcaccagtagtattgggcacagtttggtaatataaagctcagggtacaagtcctagtaacacattatgggtcgtacccaaagtacaaaaagaaaaaaaaaaatacaagaggtctattatcatcctcccagtgggtgattcttctatgaatatacagttattggtctataggaaaacaagttatgttccaggatgaaacacagatggcctcctgcacccactacctgtctgtcttctaggaaaaataaggggcgggggggcccgacatggacagacagggggtttcaaagtggcggcccgtgcgtgattgtggaaacctccgaatgccgtgcccctcttgagcgtatgaagaggggttgttaaacctgtgaggaaaaacacgccatgggatctgtgcgcgattggggagaggggcccttcaacatatacgaggacatgctccgtggaatagttgcttgccacgacatgaggtttgtagtggcccaccaagattattctggcgccctactaagggggatggattccaatatcaaggccataactacctatagtgtggggcaacggcaagaaatccccttcacaaagggcgaggtctatcgaacggaacgtgtacatggtatcgagacgataacacatcctggcatcacaaaactcccgtagcctctactacgcggaatggtcccctaaaatacctacgagagtagaagaccccgggggagtctcgcatcgtggatccccccaaaaagcctcctcgtgggacccaggggctcggtaacctcccggagggatgacacaacgggccagaacacctgcaaagaaggcacccagcatttgcgggataaaccggacactgagcaccccctcgcggaagtgggcaacaaagcaacagcggactaggaagtgaccccc

SEQ ID NO: 616074 - DNA, 210 bp, Homo sapiens
ggacttatatacacctatacatatacagctgtgacacagtgagtcctgtattaaaaaaaaaaaagaggaagaagaagaaagaaagaagaaagaagaatgaagaaagaaagaaagaaggagacaattaattaaaattctaataatcagaatttctacggggactacaatcttttctcaaggtcccatactggactcaacatggcagtggta

SEQ ID NO: 616075 - DNA, 168 bp, Homo sapiens
aacgggtgatgcgtttggaagtatgcgtttgagaatgttttcctgtttcttatactaacattagttcttctatagggtgatagatatgttccacttgggtgttgaggagttcagttatatctttgggatttaatagtgtcgtgtgtgttgagcttgaacgctttctta

SEQ ID NO: 616076 - DNA, 105 bp, Homo sapiens
cagaattacaggcacccgccaattatgcctgtggcataattttttggtattttaagaagaaggcgggtttcggcctttgctgggccaaggcttgatcaatgaaac

SEQ ID NO: 616077 - DNA, 465 bp, Homo sapiens
ccgtcccctcagtcccagctctcaccaatgccaaggagttcgtgtacaacggtggtggctcagcgagccttttctttgatacggccgatggccagggcagcggcactcagagcccgtttggagtcagtggggctggcacatgcaacaacagcagctttgacatggcccaggtatttggaggtggtgccaacagcctcttcctggagaagacaccctttgtggaaggcctcagctacaacctgaacaccatgcagtatcccagccagcagttccagaccgtggtgctggccaactgaccatctacctgtagaagacaccctttgtggaaggcctcagctacaacctgaaccccatgcagtatcccagccagcagttccagcccgtggtgctggccaactgaccatctacctgcccgtggggccaggagcacccaagaccacagaaaagagaaaggaaaggccaaaa

SEQ ID NO: 616078 - DNA, 236 bp, Homo sapiens
  misc_feature (116)..(116): n is a, c, g, or t
  misc_feature (125)..(125): n is a, c, g, or t
  misc_feature (166)..(166): n is a, c, g, or t
  misc_feature (176)..(176): n is a, c, g, or t
  misc_feature (214)..(214): n is a, c, g, or t
atatatccaaacaacaagcataatatttcgcccactaagccaatcactttattgactcctagccgcagacctcctcattctaacctggaatcggaggacaaccagataagctaccncttttaccnatacatgtggacaagatagcatccgtacatatacttcacanacaatcctanatcctaattaccaatctatctcctctaattgaaaacanaaatactcgatatgggccccac

SEQ ID NO: 616079 - DNA, 638 bp, Homo sapiens
aattagcacgaatgtggagatcgacagatgctccgcggcacggcctacatggccttcctcatacaccgcgacgaaataacgcagttgcttgaaatccataaggttttgcttatcgaaaaagctggaaaatcgaaatggccgctggcccccgaggcgcctagtctagcgcctattcgcagggcttacagggccggatcggacaatgaacagcgtttttggttgatagcgtttacataggcaaggcaaaaaatctgaaggccttattggcaggcggcatcgaccaaggtcaggttgccaacggagggtgaagtgtgaacttgttccgtcgctggcgcgccgagtcctggatgacctggttgtgcatgccccgcgtgcagatgtttccagccagtgcctgattgcccactgttggcgcgcccgccccaggtgtttgtacagggggcagggttcctggctttcggacgcctgacgaccgcgcttatcttggatttccagtcaaggcggcggggcccaacagcctgggtcacagtccccaggccgtacgcgaagccatttgccaacagattcacaccgggatcaaccctgggctgggtttgcacaaccgcgcgcaactggatcttgtcgatcgtctgtgccac

SEQ ID NO: 616080 - DNA, 388 bp, Homo sapiens
cggaccagcgcacgagcctcatcccccacactacggccggctagataggtccgatggtgggatttcacggctgacggcgggctgccggtcgaatgaaatacagatccccaggtcgctagccgggtgtcgatggaactctccacttggtaattccaattttggtttccttatccaacgggatgtcttagattccaacctttggaatttcttactctcaaaaggcaccccaggtgtcctctctgtgccttggacgaggtttggtttttttttctttctttcttcctttttttccatcgggggtacttctcccttctctcggcttttaagactccggccggttctccagggtcttctcatgccggtagcttctcggtggcaattacccttc

SEQ ID NO: 616081 - DNA, 451 bp, Homo sapiens
ccctagaggatccaagcgttaacggatattgtacctcacagtaatccactaacagtggcagtcctgtccttggggaaagcctcatatagattacagattccctcattcttcctaccacttgaggaagagcaagctgatgagccagaagatgtgtgatcatgctctcatgcccttttctcccagaggtaaggtatatttagtgacattctgttgttattactatagtaagaaatctcttcgcaaagtatttgataatttaaaattgttaactaataccacttcatattcattgtcttaatcaccataagaatctcaagatgaagatgtggcaagtaaaactatcagaggttaaataacatacaagctcataatcttcataaagaaagctgagagtaaaacccatgtcagctgaccactaacccaagttttcttttcacagcggttaaagctt

SEQ ID NO: 616082 - DNA, 232 bp, Homo sapiens
  misc_feature (211)..(211): n is a, c, g, or t
  misc_feature (219)..(219): n is a, c, g, or t
cgagggttcatcatattggccaggctggtcttgaactcctgatctcaggtgatccacctacctcagcctctcaaagtgctgggattacaggcgtgagcaccggtgcccagcctaattttttttgacagagtcttggtcttgtcgctcagactggagtagtgtgatcttggctaactgcaacttccacctcctggattcaagagattctccngcttcagnctccagagtagct

SEQ ID NO: 616083 - DNA, 437 bp, Homo sapiens
  misc_feature (52)..(52): n is a, c, g, or t
  misc_feature (67)..(67): n is a, c, g, or t
  misc_feature (109)..(109): n is a, c, g, or t
  misc_feature (124)..(124): n is a, c, g, or t
  misc_feature (137)..(137): n is a, c, g, or t
  misc_feature (161)..(161): n is a, c, g, or t
  misc_feature (190)..(190): n is a, c, g, or t
  misc_feature (222)..(222): n is a, c, g, or t
  misc_feature (335)..(335): n is a, c, g, or t
  misc_feature (436)..(436): n is a, c, g, or t
cagttgttgcactgtcttctgttaaaaatacggaccaagggcatagaaagtntgctcttcagggggncgcgggttcagaggatgtgtgggcggttgtgccggacacggnttcgagccttggtcngggctttgaaggnagcagcattgtacaggtgcttctnaaagcgtgggccttggaggccttcagggnagtggcatccagcaacagcacagggcccaggncaaagatgtcacggagtagctcattgttctggagatggtggtgcatgcccgaacccagcacttccttgaaggcagcgtagatccggtgccgagcccagctgtccatgtagagncctcaaagccgaagcgcactatctcttcttcgcattcaccgccctccacggagtgcagcacggcgcggaaagtagagcgctggcgccgacgatcagccttng

SEQ ID NO: 616084 - DNA, 217 bp, Homo sapiens
tactctgactattgaattacttaagttacgaaagtccttcacatttttcacactaagctactatatttaaggacttccaaattcttctaactcttccaaaagccttccgccttagttttgtgtaaattacaccagtccttttagtagctttgtgatgtgattgaataaccaactatcccctatctagctacaagtattcttctaaataggtactggt

SEQ ID NO: 616085 - DNA, 146 bp, Homo sapiens
agatcagccttccctgccgtcaagtggcgtgtactcgggatttctgctgtgttgtggccttggtcaaggcctcccctgagaagccaggactggcctgctgacaggctgagtctaccttggcgagtaccaagatatttttcccgggc

SEQ ID NO: 616086 - DNA, 923 bp, Homo sapiens
  misc_feature (155)..(155): n is a, c, g, or t
  misc_feature (160)..(160): n is a, c, g, or t
  misc_feature (172)..(172): n is a, c, g, or t
  misc_feature (182)..(182): n is a, c, g, or t
  misc_feature (186)..(186): n is a, c, g, or t
  misc_feature (193)..(193): n is a, c, g, or t
  misc_feature (207)..(207): n is a, c, g, or t
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (250)..(250): n is a, c, g, or t
  misc_feature (252)..(252): n is a, c, g, or t
  misc_feature (255)..(255): n is a, c, g, or t
  misc_feature (259)..(259): n is a, c, g, or t
  misc_feature (272)..(272): n is a, c, g, or t
  misc_feature (282)..(282): n is a, c, g, or t
  misc_feature (289)..(289): n is a, c, g, or t
  misc_feature (304)..(304): n is a, c, g, or t
  misc_feature (385)..(385): n is a, c, g, or t
  misc_feature (485)..(485): n is a, c, g, or t
  misc_feature (508)..(508): n is a, c, g, or t
  misc_feature (522)..(522): n is a, c, g, or t
  misc_feature (528)..(529): n is a, c, g, or t
  misc_feature (538)..(538): n is a, c, g, or t
  misc_feature (541)..(541): n is a, c, g, or t
  misc_feature (545)..(547): n is a, c, g, or t
  misc_feature (551)..(551): n is a, c, g, or t
  misc_feature (561)..(562): n is a, c, g, or t
  misc_feature (572)..(574): n is a, c, g, or t
  misc_feature (584)..(585): n is a, c, g, or t
  misc_feature (594)..(594): n is a, c, g, or t
  misc_feature (610)..(610): n is a, c, g, or t
  misc_feature (631)..(631): n is a, c, g, or t
  misc_feature (633)..(633): n is a, c, g, or t
  misc_feature (642)..(642): n is a, c, g, or t
  misc_feature (644)..(644): n is a, c, g, or t
  misc_feature (684)..(685): n is a, c, g, or t
  misc_feature (687)..(687): n is a, c, g, or t
  misc_feature (690)..(690): n is a, c, g, or t
  misc_feature (813)..(813): n is a, c, g, or t
  misc_feature (816)..(816): n is a, c, g, or t
  misc_feature (819)..(820): n is a, c, g, or t
  misc_feature (822)..(822): n is a, c, g, or t
  misc_feature (826)..(826): n is a, c, g, or t
  misc_feature (862)..(863): n is a, c, g, or t
  misc_feature (896)..(896): n is a, c, g, or t
gacggaccagagcaggtatggcgggtgcagtggcggcccggcaggttacggggctgggtgcggaggagcgtgatctgagtggagagcgggccggggcaggagcgtcgggtgggtcggaggtgcctggaccagtccatgctggacgctgcctgcgnccggntctgctgtgtcngcgccgcccncggngcgtccnggcccggctgggcnccgcccccgcggcccccgcggcntncnccccgnccccgccggncnccncccnccccggccccccngcccgccccnccccgcncccccccccctcccnccccgcccccccccgccccccccccccccccctcccccccccccccccccccccccccccccccccccccccccccccccncccccctccccccccccccccccccccccccccccccccccccgcccgccccgccccccccccctcctccccccccccggcccccccccgggcccccccncccccccgccccccccccccccncccccccccccccngtccannctttttctnctncgcnnngctncctggtgtcnngccttattcnnngtgccctgcnngtggctttnccccctcggatgtttnccctccccccccccccccccncngtgtcttcngntggagctggaggaggggaaggcagggagcggactccgccnntnttntctgtccaagattgaagaactccagctgattgtgaatgataagagccaaaacctccggaggctgcaggcacagaggaacgaactaaatgctaaagttcgcctattgcgggaggagctacagcngcngcnngngcanggcccccccccccccccccccccccccccccccccnnagaagaaagtgttggtcaaggtacatcctgaangtaaatttgttgtagacgtggacaaaa

SEQ ID NO: 616087 - DNA, 374 bp, Homo sapiens
actgtcttcgaataatctcctgcacatgggcccagtatgtagagatgagtccagtgaggctagagccaagggacagcatgccctccttcccacaggccttggggatagctctggactgagcagggcttctgggagcttgtgggtagactcactggattacaccacgtgtctgtatggactcccagggtaagagctgagctctaccagtttttatcactatggcatatatagcacttggctattctagcctttaccgctgggagctccccaagtttgcccaagtagggcctgcttccctagagagctgagctcaggggtccttgggaagaatcacaagagttaggggtggcctaacttgggccttctactctcaa

SEQ ID NO: 616088 - DNA, 1027 bp, Homo sapiens
  misc_feature (127)..(127): n is a, c, g, or t
  misc_feature (806)..(806): n is a, c, g, or t
gttagtctcactatagctgattgattgctgggcgacatagatcgtgccaagtcctgagagcgaacgagaggtaacctagatgccctaccgtattcggatcgcgagcatgtgcctagccatagctggncttcctaatggtaacgcatgacaatgttaaaaatgggtgatcgttctcaacgcccacagtgagtattgtaagtaattctatcatttcaaaggtatttatccaatttgaatgaatcggacgagcatttcggacaaacctgaaataagatatccacacctaatgaagatcggctgacccactgaatatagagccggtatatacccacggcattacacataaaacaataaatgctatctgtaatctttatccctcacgcattatctaaacgtaggtctctgctcgtccttcattgcgaagtaaggtgtgaaggcccgaaatgcctcgagatcgtgggttgaaaccggttctgactcctcttcgtgagacagggctagactcaaatcaccaacacgctgaaaggactctcgcggttaagaatcttataatccgatgcatgtcctgcgctgtaaaacgattccctcaaagacaagggggcttgtttctttcccatacctaaattactttttaagagagagacactattcgaggtgtgtataataccaaaagaccaatgttttaatcaaaatttgactatatagaatgccccccggacatgaacaaataatatactgcgctaaactaacaccgatagaggaaggcgcaccccgatccgtaaccgggtgctgagaggtccggcaanaggttctccggtaagagtgccgagcggaccgcgaggtgccgccataagctttttaccttttcccataaagatttctttggtgtaccccccaatggtttccccattaaaggccattggtctgagcgacaagttccacctaaataaacttaacttttagaaccgagggcaattcgccgggaaaaagtccctttcggaaaagtataaccaaactcggtttgcct

SEQ ID NO: 616089 - DNA, 259 bp, Homo sapiens
tgttcactacgtgcagatcgccatgcgcgccagtgtggcgcccagcgagcttggcgacggaatcgccattggagacgtcagcttgtactaaatgcgcattgccgccgggcacgcgagtggcgctggctacacgctcaccggcctccgcattcaagttgttgacgaggacgcgtgtgccttcgcgggcaaaggtgttggcgataccctcgccaaagcctgaacccgcgcccgtgacgatggcaatcttgccgggtaccga

SEQ ID NO: 616090 - DNA, 257 bp, Homo sapiens
  misc_feature (43)..(43): n is a, c, g, or t
gtatgctgctgagtcagccatcacaaccaaatcccattagtanaaagacgaagaagtgaaaaaacaccatcctcttgctttaaggccgttttcagatattgacacgctatttctgcttacaacctgatatggtttgaatatttagcccctccaaatctcatgttgaaatgtaatctccattgttagaggtgggcctagtggaggtattggatcatgaggacagatccctcgtgaatggcttagcgccatggggatcc

SEQ ID NO: 616091 - DNA, 1019 bp, Homo sapiens
tcacttgttccttaattagggacctgtatgaatggctccactggtaaaagtaagagacagtgaaccctcgtggagccaacatacaggtccctaataaggaacgagtgatatgtaccttgcaggagggaccgggcgtacatgtgtatgagaggcgggccatatgggatttaaggagaagataccggaaaacacgcgcggctacgcatcagccgacgtaccaacacacatagagaaaacccaataccaaaatgaacataccagcgcaacggcatagcacaagacgagggaacaaaacagaccgtcaggccgcaaagcacgatactcgcgaaagcaacaagtcacatcacaaacccaagcaacaaaccacacacacaaaccacaacacacacacacaaaacaacacacaacaaacacaacagcaccacccacaaccaaaacagaacaagcaaaacaaaggccacaagaagacagaaagcacgatagaacataacaaagcatgcaacacaacaaagacagaccaccacaagaaacaagcgacagagacgcacaacaaaaggctgaatgaagcagaacacccaagcaacgaggacagaataagcagacagagaaagagcaaacagacaagacgaaacgagacgacaacagaaacaaacacatgaaaaaagaccaaagaaagaaaagaaacgaacaacgcagcacgaagggaagcgacagacgcacaaacacaagcggctgtgacagcaaaacggaaagagatcgagaagaagaaaaaacaaggaagaggaggccgcggacgcagcgcaggaagaccagagcgaggagacggcagagcacgaagcagcagccagaggaacgaaagaagcaaaacacatagagagagacaggacgagcagtacacagtagcacacagacacacgaatggagagagaagagcagagagcgaaggagagacacgacggacgacaagagcacgcagacagagagcgcagcatggaacacaaaacacgacaaaagagcga

SEQ ID NO: 616092 - DNA, 428 bp, Homo sapiens
ggccgggggacagattttgtgggtacccggtttacggggatctcgccgggtgtacgtttacctgggcgtgtgctgcaccctccgcttcctgtactaggcgacgagacccagaggctagaagttgaccatgtctattctcaagatccatgccagggagatctttgactatcgcgggaatcccactgtcgaggttgatctcttcacctcaaaaggtctcttcagagctggtgagcccagtggcgcttcaactggtatctatgaggccctagaactacggggcaatgattagactcgctatatcgggaagggtgactcaaaggctgaagagcacatgaagacaactattgcacctgccctgggtagctagaaactgaacctgacagaacgagagaagattgacacactgatgatcgagatggatggcgtct

SEQ ID NO: 616093 - DNA, 366 bp, Homo sapiens
gctggacgacaggtgcatgccaccatgcctggctcatttttctactttaggtagagatggaggggcgccatgtagctcaagctggtatcaacactcctggcctcaagcagtctgcttcccttggcctccccaagtgctgggaattacaggcgtgagcccctgcgccaggcgtatccccttcaattttgctgaaactatcagccattctccattttcggcatcatcatatttgctgcttccacctcctgggctgctatgcatgacagattcacagttggcagcctcagttgagctctcagtgttgactggaaattctttaaccttgttgtgatcccctttttttttccccacccatgcctccatctt

SEQ ID NO: 616094 - DNA, 93 bp, Homo sapiens
  misc_feature (44)..(44): n is a, c, g, or t
cagtgtcctgaacggtggactgtagactagatactatattaaanctgtactgttatttacagatgtaataaagcagtttgacatgacaaacac

SEQ ID NO: 616095 - DNA, 156 bp, Homo sapiens
agccaaccgaggaggggaggctctcttgtgctcacataatctgtgtcttgtgtcacacaatcatcattaccattagctatattgcagctcacacatatgtatgtatgcacttgaaacgacgttagttgacgcctgtcttggcagtttactgtatgt

SEQ ID NO: 616096 - DNA, 1363 bp, Homo sapiens
  misc_feature (665)..(665): n is a, c, g, or t
ttgtatgactcctattggtcagatgtctatctgtgtttagtcatgtagtgcaccctgtctttgtgtcgtacatctccctttcgtctgccacgattttgcttcactggtgggctctttttacgctgtttatgttgtcatttgaggtgtccctccaagtacaacgggcacaaaattggttgtgtatgaagctcacttgctcgtaccagttctgatggcccctctgttatgatggtgggtacaaccacacaaatctccccccccgagaattggttttagtatccccccttgttgacaaccccactgttctcccctctcagtaatcttttccaaattaggggctttttgtggtaccccctaaaccccgaaataatgttttgtacttctcttctattgtgaaaaatcccccaggggtctctaaagacctggagccgtttttaggagggggcctttctcgacaaaatttggaggtatacagcttggggcgttcacaaaattggtcccctggcctcttctcacgcgttaaattatttttttaaagggacccaactggggaaaccttctgggactttgtttgcgaattggcgtcacataaccctgttgaatcccccgccaccttttgggaaggctttaccggtggggcaagaatcaacattcttgaaggccancctgagtgttttgaaagaccctttgccttggccccaacacatggcgcacaacccccccgtcttctttatattaaaaaatactattaaaattatacccctggcaattggtatgcacatgcgcgccgtatataagtcccccaccttgcgtcacaggagaggctatataggcacttgagaggatttccgcttgggaccctcaaggagggttgcgagaggttgcactatttcacacctcgaggattcacttatccccctttcacttgtccacgccctcgggtggaacacgaggcccaagaaacttcttgtttctccacaaaaaaaaatataaagggaaaactttgctgaatggacactttgtgttaatataatcccctctcacgtagtttattccctccctctttccccaccacgcacgctgtttctttcctcgtcaaactaagaaaaggaggcacggacagtaaataaaaacacttttggtcgtgaactaaggccaccacccacaactcttaatcactctcccacttttcctctagacactttaaatcttcaaggcacggtaccctctgtgtaactcacgagaaatttgaagagagttaatttggttttcccaaaagcaccctgcgggttattgatttgttctttaccactattgttctcatatttctcaccactataataaatctctatgagagcttcca

SEQ ID NO: 616097 - DNA, 182 bp, Homo sapiens
tgtgactgctatatgtgtgtgtgtaccctctgggggacggcacgctctctgaccacttcccaaggctacatcttctggcatatatcagtgactacatctcatgcttctatcatcagtatcccaatttccaccctatattagggcgcgagcgtcacatgttgatgaccgtgatctgctgtgtg

SEQ ID NO: 616098 - DNA, 1041 bp, Homo sapiens
  misc_feature (151)..(151): n is a, c, g, or t
  misc_feature (670)..(670): n is a, c, g, or t
  misc_feature (672)..(672): n is a, c, g, or t
  misc_feature (680)..(680): n is a, c, g, or t
  misc_feature (697)..(697): n is a, c, g, or t
  misc_feature (797)..(797): n is a, c, g, or t
  misc_feature (811)..(811): n is a, c, g, or t
  misc_feature (834)..(834): n is a, c, g, or t
atcagtctgatcatcctcattggacgccacaggggcgagagggtggttcacctgaagcagctggctagtggcttattacttgtgagtgtggacccttctggatccttcgagatccgaggttgcctcgtacgaatgaacatcacccatgaanatttgtcgattgcctacgttcaagcctcaatagatcgatagtcgacgcagatgtagaataagtcccagaaatagtccttactggatggcttacattctaagaagcgaatcaatgctagcgcgaacggcctcagacacgcagagaagtggtgatgactccttcagaacgcacatttacacatatcaagcaacaacattatttatatagcccatatacaacgctagtgtgtgcgagctgcgcgcgccctatgtgagcagccactcgcaaggaaaaaggacgcttaattttggaatgacaacaccgctctgtttatgtatgagaggtcgcacgacgacaagttgtcgcgacttctcgaaggaaaaaggagtcatggttgagtacatccgctgttgaagaccaagaaagtgtaggctgaaaccccctatggggcggaatgggactcagtgtaggcgtgaacgtgtgccaaaaccgagaagtggtggagtgaaaccccaccgctctcaatggttgaataaacantnacttaccncatggtcgtgggagganccgccctccgccggggcactttcttcttcaacagtacgcctctttcacaacaagagagtgggctcacagtgccctcgcacgcaaagtacgggcgcgcgtntgtctaagcgaacntccgaagagaagacgcgcgcaanacgcgtgtgtcgccgcgggaactgtgggaaatgtaacgccctccgcgggggcgggtaggaataggcaactttacaacgggccaattttgccaactggtattccatcctcttggtaagacaattttcggtccaatcccaacttcccttaacacgccttgcccctttcaacaaacggtttataagttaaccaccttacaacgaactgag

SEQ ID NO: 616099 - DNA, 369 bp, Homo sapiens
  misc_feature (190)..(190): n is a, c, g, or t
aaggtttcgcaggttaggggggcgccgccttttttacccacaccagcaagggaggccactttgccaatttgtagggcacttcgccttttaagttaaggggccagccaggcccattccactccactcaggttatttagggccaaggcccctgccccctgtttgggttggtgagctgggagttcaggtgggntgttcccagcctccttcaggggcccccccaattttttggacctttttcagtgtgtggaagttcatgtgggcccctgagggctcatgcctgggaagtgttgtggtgggggctcccaggaggattggcccagagagccctgagatagcggggatcctgaaatggactgaataaaaaggggt

SEQ ID NO: 616100 - DNA, 944 bp, Homo sapiens
  misc_feature (18)..(18): n is a, c, g, or t
  misc_feature (207)..(207): n is a, c, g, or t
  misc_feature (217)..(217): n is a, c, g, or t
  misc_feature (239)..(239): n is a, c, g, or t
  misc_feature (260)..(260): n is a, c, g, or t
  misc_feature (272)..(272): n is a, c, g, or t
  misc_feature (306)..(306): n is a, c, g, or t
  misc_feature (391)..(391): n is a, c, g, or t
  misc_feature (399)..(399): n is a, c, g, or t
  misc_feature (468)..(468): n is a, c, g, or t
  misc_feature (471)..(471): n is a, c, g, or t
  misc_feature (490)..(490): n is a, c, g, or t
  misc_feature (498)..(498): n is a, c, g, or t
  misc_feature (501)..(502): n is a, c, g, or t
  misc_feature (555)..(557): n is a, c, g, or t
  misc_feature (566)..(566): n is a, c, g, or t
  misc_feature (578)..(578): n is a, c, g, or t
  misc_feature (580)..(580): n is a, c, g, or t
  misc_feature (586)..(586): n is a, c, g, or t
  misc_feature (588)..(589): n is a, c, g, or t
  misc_feature (598)..(598): n is a, c, g, or t
  misc_feature (600)..(600): n is a, c, g, or t
  misc_feature (604)..(604): n is a, c, g, or t
  misc_feature (614)..(614): n is a, c, g, or t
  misc_feature (627)..(627): n is a, c, g, or t
  misc_feature (785)..(785): n is a, c, g, or t
  misc_feature (790)..(790): n is a, c, g, or t
  misc_feature (871)..(871): n is a, c, g, or t
  misc_feature (882)..(882): n is a, c, g, or t
  misc_feature (934)..(934): n is a, c, g, or t
gggggaggaggaagaagnggcgaggcgggggcaggaaaggcggggaggggaacgagggcgcagccggggagagccgaccagcccaggaacggggaaggggcgcgggaggaagagaagaacaaaggggagggggaagaaaaggaggaacaggcgaaaaaccggaggacaagtcagccaaaggtgttaggaaagaacaaccgaggcacnatcgccacgngggcgaggggacaacgggcganagcgcacgcggtaggggggcnggccgggcgganacagccggtcatgcccgatagccccggagaagancccgggggcgccataagacagaggatgataatgcccggcaggaggcgcggaccacggccctgataacggtacatgccggtgcgcnctaaaggngtaaccaatcatccgatggggaaaagaaacggcacgtaaagggtaaggaggaatggtgtaggaactgtngcngtgggtagaagggcgagangggcaganganngccccagaatgcgggcgcgcagggactgccgctggtaaaccacgggcgggggnnngggggcggnatggagcgcgcncnccacgnanncgcgattgncnaaancttttttttnaacagcggggggnggggacggcccggggcccaccgccaggccaccgggggaagcccacaggcagccaagacccggaaaggaaaggaacacaaaggcggacgcgggaaggaggaggggcaaacagaacacgaaagagaaaaggggaagcggcaagggggggggaaggcagancccancagagcccgggccacccaggggccaagaagacaaggggcaaagcgacaaaggggcaagagaaaaaggggacgaggaaggcngggggaaaagncggaagagggaagggacaccgaaaagggcagggcggggcggaaaaggggcangggggacccc

SEQ ID NO: 616101 - DNA, 278 bp, Homo sapiens
tagaggaccccaaacaccgcattcttctcaagcttaccttctaacttctgcccaccagaaattaattgatgggcttttaaaataaattggttacccactaatttcctcattttttccagtgctattttatcccaatttttcggctttatattttttctatcttctatacttctccaatacttgtcttagcttattttttcattttctatctgaaagtcttgacgatattatcatcatctactcatgttgtctctatctcccaattttcttctaagttg

SEQ ID NO: 616102 - DNA, 113 bp, Homo sapiens
  misc_feature (97)..(97): n is a, c, g, or t
aaaatcattttactctgttcataggtcacatttaaatgggcagaactgcttccattacaaacacatatcgtgcaaagaaaaataggtgaagaattgngccataggaacacaat

SEQ ID NO: 616103 - DNA, 649 bp, Homo sapiens
  misc_feature (14)..(14): n is a, c, g, or t
  misc_feature (32)..(32): n is a, c, g, or t
  misc_feature (98)..(98): n is a, c, g, or t
  misc_feature (127)..(127): n is a, c, g, or t
  misc_feature (138)..(138): n is a, c, g, or t
taaaaatcgtaaanggccttcctttatttatnttggcaatatgaaataaaagctcggcacaaacacacgcacactcacaccagccggggaggagggancgggggacaaggtcactgggcaacagggnggggacctcanaccctcaaggccccgggggcgttgtggccggggaggccccgggtccccagagccggacgggccgtgttgaaagctgcagggtcggggcaaaggcacggcccccactcgggaccctcgggcacccccacccacgcgtgggccgtcccccagtgggtggaccgtgagcttaaaaggccggggtggtgggcggtggccgatctgtgcgcgtgcagcggtgggacagctggggccacggtggggtggcaacctttgggaccccttaaaccagctcccgcgtgggacggaacagggaaggctgtgcttgggagccgccagcccagtcggggtcctcactctctctggcctctcctccctctctctatttcatatataactatatggtgcctctctctccattctctctattggagctctcgggatcttattccaggaggcaacgctccaaaacttctcttctcagtggcagaggggggttgcgtggggcctgtctcccgggacccagctccggggg

SEQ ID NO: 616104 - DNA, 131 bp, Homo sapiens
aatttgttctccattgagtggggaagaggcattcctctctacgaggggggtcagacaaggttccatgtagcttatccctctagctgagcattctccataggtaggtgtctatgttgcacttcgagatgctt

SEQ ID NO: 616105 - DNA, 180 bp, Homo sapiens
agtaagtccctattgcagtcgttctcaagttcttcactccagttgaaagcattcggggatggagaatcactggctgatgattctgaattcacattaggctctgatattgaaattggacactttatccgatgagacgaatagtcccgcgtgttgtgctgtactcttgtatggaatggccat

SEQ ID NO: 616106 - DNA, 291 bp, Homo sapiens
gggcgttcttccttcatgtttctctgtcccaggccgaacgctcctcaacatctccctttcatggcttgattatttagcttccatggcttctttcagctggtggttctcggtcaggcgctctttcatctgctgcagccagctcctccggggtcaaacgtgtccaggttggggtggggcaggtgggggggtccatttcctgtgctttcagtggggcttgtcctctttttcagtgaggccagatgagcaggttgatggcagcgtcgcgcatgggtcacgagctcgcactcgtca

SEQ ID NO: 616107 - DNA, 171 bp, Homo sapiens
atcacttgaacctgggaggcagaggttgtggtgagccaagattgcgccattgcactgaagcctggggaacaagagtaaactccgtctaagagaaaaaaaaaaaagggggtaggtaccagcatggggcctaatggcctttaatcctagcattttggggaccaaggcaggaag

SEQ ID NO: 616108 - DNA, 533 bp, Homo sapiens
  misc_feature (483)..(483): n is a, c, g, or t
  misc_feature (515)..(515): n is a, c, g, or t
gttacccgacctacacagtgttaccgaacaccaccagggctacaccccagtgcagaatcatgctgacccaaccatagcgggccggcggattacgtagctgcatgtacttaatcccgtaagaactgtgcccaagactagcgctttacctatcgaattaaagcggaaaattttgctttgaaatatcgaaaaatacgataacgaggctaggcatcataaattaacaagggattaagactatccctgggaaacgtgacagaccgtcctgcatttaccgcgaatttccccacaatggcttgtgacccaagccaccattgcataggcttgcgcgattgtttcgcctgcgcccgccgcaggaccgcttcgaggagatcaccgatgggcttgaataaccagtggatgcaacgcgacctcgcggtgctgtggcatccctgcacccagatgaaagaccaccagcaattgcccctggtgcccatcaagcgcggngaaggcgtatggctggaagacttcgaaggcangcgctacctcgatgccgt

SEQ ID NO: 616109 - DNA, 1518 bp, Homo sapiens
  misc_feature (935)..(935): n is a, c, g, or t
  misc_feature (1366)..(1366): n is a, c, g, or t
gagcaaacctggccactgaggaggagctgagcgaggcaaaggatctcttgaaggaaaggtcgtaaggtggtaaagaaggtccccaaaggaacatccgagttaccaagcttgacatggcattttggcatggtggccagccacaagtggctgggtgacaggcagcatgcacatcatgcaatcatgcatgcatcataggaaccatgcacggattttcataggcaggcaggcaatcgtccaggcatgcagcagtcagtgcacagcacagcaggcacagcaatccatgcaacactcatgcacgtattgtgggcagctcctagtgcgatgcatgcatctcgtcatgcatcacacgaacactcagcactgtaagcaacagcctgaagggccaacacacatgattagcgcagcacaactcattaaacaccacaggcaaagcacctggcaacagcagcaatgctctatccaagcaatggcacaggtggggaacaacaggcctcgctgtgtgaaattcgtgcggcgttgccattcgaaaacatttccggaaattatccaggtagagatgtaccatgcaagcggcgcattagtacagggaaggccatttgcgcagggataagcaaattccagtacccaagttggagaggaacagttcccgagtaaccacgggggcaagaggacacaaccccagtgctcgccgattccgaaaacggacaacttctcaacttgggcctgttaccggccaggacgcttaagtcgtgtcccgagcgcgtattttacatacccaaggcgaaaacaaccggtgcgtgagtgaacgccagttaacgaagatcgaatagcactataatcgatgtccaataacgaatggtcggaagagtttctgttttctgggtagcacacacacgggacacacggcggaatctctttcgacaacaacagggcancacgacgtcatgcatgcgaaaagcacggaatatatcggcataccagacgcggacaccggtcgcattgtgtgaaacgtcggactatactaggacgacacatgtgcagcattaacctttggcgtttcacaagccaaacaaacagtatcgtcgcacaacgattagtggtttaccggtattactcgttaggacacacaacagatatcacacgccgccccgggtgttcccgacttcggcagggaagcatgtggcctatctcccgtcaacagtagcttggtacccatcattcccccaaaggactggacgcacaaaatcgcgggctaaaaacacacgatatcccgccccaccttttttggccgacaaaatttattcggcgcaacacttattcgagtaggtcacaccgttgctcgatacaaacacacgattctcaaaanacccccttacccccaacatcgtgcgtacaccagcccaacatggctaacaacgcaacatttgggtctcccacacaggcgaacacttattgggcaaaacacctaaagtcttgtgcgagtaagtgagggttcacgacagctcgacgcacagcatg

SEQ ID NO: 616110 - DNA, 893 bp, Homo sapiens
gccgtcgtgccgtcgtcgcgtttctctgccggtcgcgatggaacgccaggagatcggccgagctggtcattgacaatggctccggcatgtgcaaaggtggttgaccgtggggacgacgctccccgagccggggtcttccttccaggcgtcgggcggcctccaataccaccgatgggcggtcgataggttgggcgtgggcctaggaataggactcctactgtcgcgtgctgacgagggcctcgaggaggctaggcgtgggtaatcgttggacccttgagatgtactcgcctattagagctattggtgcgatcgtcaatccgaatcttgggtactgacgagtgtgacgcagagtaatcatggccatctcacaacgctttcttacgaaactgaagactgcggactgttggccccctggtagggtaggcgagcctcggagtggcgtgtctgaaacactgaaggggcactcgcccatggatagccctctaaaggggacccagccacgcaaggaggacaagcaatggagcgtccaggagtttatgatctattggagggaccccttatgcgttaacctaccactcgctgggcactatctcgcgttaccggtttgggggcccttgtcccgaaaggcccggggtgcccgtgcgatttcgcctgtacccttagcaggcgctcccttgtgggggccgacgagggccaaccttaagggttcaactattgggttccaattgggcgtagcgttccctggggccaagaaaccaggggaggtcttccaaaccactctattccaaccgggggtaggaccgcttcgagttgccgttaatccgtgcaggggggcggccttgtatctggcacccctttgcctcggccctatgcaggcctctatttcccttgtg

SEQ ID NO: 616111 - DNA, 999 bp, Homo sapiens
ggttgcctctcgggttcgtgcattaggccggaatatggcctgtgctcagtgcgtgaagagactggatccgccatgcgcgctgtctgaatacacccgcgctatcgcttgcgcttctcataggcgacagcgagttgctgttcacagtcctgtatacatagagcatctcacgtgagtaccttactatgagtgttccagtatgttaagcatgtatatccacgccaagaaagtattctgcctggcatattcgttgatgcctgattcttggggggatggttaccctaggtgggtactcaatgcattctacctctacctgtctcatgagtgcagggcagaagccgtagtgcccgaaggcagagagaatgatccccgttccaatcatcgtaagccctgcctgaggacaagctttgatggggggccccagcttcaaggctggggtgggaacagcacccccaaatgccagcctctcctttcttcccagtccaccagtatactgcggggcatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaagagagagggagaaatgccgtctaagcattctgcttggggggatcccccacaaggaccctgggatactggctgggaaaactgttcctaagtaaaacctattgacctcgctcgcccgaccggctggaagccacgcatttccgtgaaggtggatggaagcgctttggcctcattttgaactgaagctgggtcaccggtctaagcctccagtgattctaaccagaccagcctggagaagaggtggttgcagctggtggacaaagaaggccgcgggctgaaccttccatatccacaggttcagcatcggacaccttttaccacacaaggcccgaggtataccctctgaggg

SEQ ID NO: 616112 - DNA, 165 bp, Homo sapiens
gtccgtggggctgcgggaaaacccggctctgacagagactggcgcaggctcagagaacaaactgtcaactccaggaggttttatctgcttcccccttttccaggaactgaagctgtgcccaccgtgtgctcacccctgtacccacccccgtgcccaccccggatg

SEQ ID NO: 616113 - DNA, 619 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaacgggaaaaaacaaacaaaaaaacaccaaaggaccgaaaaaaaaaaacaaaaaaaaaaaaaaaaaaacgtgtgttgggcgcggcgcgccgccgcgggcgccccgcgaaaaaggtttttataaacacccttgcggtggggggcgcgcggggcgccccatgggggtaagggcaacaagcggcggcccaaaagggcggggtttcctcagagaggggaaactccgccggggaccagagcgacacagagggggcgcggggaattctctctctccccaaatatataaaaaaaagcgcgcgcgcggggggggaagcccaccggaggcgggtcctcggggaaacacaaaaatcccgaaaggggaggaggagccttcgaaggggcggcaccccaaccgagggggaggactctcactccacccgggggggggaggctcgccaaagaaggagagagcgccgagaaataactctaaatattataaggcccgcggagtcggtggga

SEQ ID NO: 616114 - DNA, 96 bp, Homo sapiens
tatttataaaaaatatgagagactggcagctattaacattgcaactggaccatatttcccttatttaataagggaaatgactagttctagattcgc

SEQ ID NO: 616115 - DNA, 976 bp, Homo sapiens
tacccctccttagtttttatgccctcaaaaaccaatttaaacccccccccattgtaaagggggggcgggacaaaagacaaaaacgacacaaagccagctgggaacacaacccgttcgggtgcccccggtcatttttcgccctgatgtgggtttggtggttttcaactctgtgtcccgtgtgcgattggggtagagtgggggggtggcgcctccgggggggccatgtgccacgtgagccccctttgcgacgctcagcagggggacttggaaaaggcccttgcccgaacttgtggtcttgggggaccaggggctgatcccccacaaggttctgtgcaggcgggaagcggggggcttgcggcgaacacaggctcctccaccccaaggttgttccagagaagggtctccgagcgcagcgcccccaccgagtcgacggtgcggacccaccctgagcacgacccactgaacagtcctgacccgacacagagcgagacagaggggggaagcaacgaaagagcgtgctgcaacacacggaacgacgagtgctcccaccatcacgggcatcggggccacagagagtttgagacaaaccaactccccagcaaacaaaccagcgacgcgagcaaccaccaccatcaccaaccaagggggaaaaactcgatgtggacggccacaactccaaacaccagaggacgtgagaaccaccaagaaaagtgaccaaaaaagcaccagtgagatggaacccaccacgcggagggacacacgagggggaatccgaacagccacgtccacaccgcagcccctacagacgagcctcgaacacaccaccacagacgcgccacagacgcgaagcagtcacggcacagacccaggacaagagtgggactgtacaccagcggacacgcccatcgggatcggggagaacacagaacaacgacccacccgcgaacaccaccggcatgcaagaaggcacagacgt

SEQ ID NO: 616116 - DNA, 407 bp, Homo sapiens
gggccactgaggaaatcatccgcgccgccgcgccgcgctgcgcgcgcctcgccgggaggaagacagcgccgccggcaccgcagcgaccccgccgagagtccacccgccacaggcctcgggccaggcggcaggagctgcctcccgccagtgagtgtgacgtgaacagagaggtggagcgccttatacctgaaaggatgagaacccaaggggtcaaggagttagttggagccattgagaccagagtgcgaagacccagtttagtataccagaagtgggggatcgccggaaaaaaaataaactaggttaaaggaagggggagaccaaaggccggttggacgagaaagggggcattgatgtagggcacccgagaaccttgcgtggtaatggtggaatgagatagagcttaa

SEQ ID NO: 616117 - DNA, 730 bp, Homo sapiens
  misc_feature (24)..(24): n is a, c, g, or t
  misc_feature (90)..(90): n is a, c, g, or t
  misc_feature (100)..(100): n is a, c, g, or t
  misc_feature (111)..(111): n is a, c, g, or t
  misc_feature (121)..(121): n is a, c, g, or t
  misc_feature (142)..(142): n is a, c, g, or t
  misc_feature (155)..(155): n is a, c, g, or t
  misc_feature (166)..(167): n is a, c, g, or t
  misc_feature (192)..(195): n is a, c, g, or t
  misc_feature (198)..(198): n is a, c, g, or t
  misc_feature (205)..(206): n is a, c, g, or t
  misc_feature (237)..(237): n is a, c, g, or t
  misc_feature (240)..(241): n is a, c, g, or t
  misc_feature (266)..(266): n is a, c, g, or t
  misc_feature (288)..(288): n is a, c, g, or t
  misc_feature (301)..(301): n is a, c, g, or t
  misc_feature (304)..(304): n is a, c, g, or t
  misc_feature (306)..(306): n is a, c, g, or t
  misc_feature (328)..(328): n is a, c, g, or t
  misc_feature (330)..(331): n is a, c, g, or t
  misc_feature (339)..(339): n is a, c, g, or t
  misc_feature (365)..(365): n is a, c, g, or t
  misc_feature (427)..(427): n is a, c, g, or t
  misc_feature (439)..(439): n is a, c, g, or t
  misc_feature (499)..(499): n is a, c, g, or t
  misc_feature (574)..(574): n is a, c, g, or t
  misc_feature (663)..(663): n is a, c, g, or t
  misc_feature (685)..(685): n is a, c, g, or t
ctgcaggtaggccttgtactggtnggaggtgagggagagtgggtgggtgttggaaatgtgcaggtccacagtattctccagggaggaggnagcgcctagncgggggatttntaccaagggngtgagggacgtggggagaagnttgagcatcaggngggtgttggtnnaggggtggtggtggggggatgagtnnnncanagagaannagaggggatagggtggtgagggtgcggttcnttnngtgaaggtaatgagatgtggggggngaggagggtagaatgaaggggnccaggtgaaacangcntncttccttgtccttggggacctngnnatcagggncatgggcgctgttggggaggaggtgntgggtgagtgggcagtatgtgtggcagtgcgcagcgggtggggccagagggagtgctcgggncgggagagagcnagtggcccagccagggaggtcaggagatgggtcacgtagctcatcactcccctgtctgtnagggacatgccagggtctggcagtgtgactggccatccaggcagcgtcctgtctcccacttcggaccccaacagncgcaggcctccgggcaggagatggtctgctggaagacttggcggccccggtagaaggctgtcacctcgaactcccactcttcccccggnaacaacagccgcttcagtgggntctcagagggccccaggtttgggaagggagtgggattgtccaagc

SEQ ID NO: 616118 - DNA, 375 bp, Homo sapiens
gggaggcgaggtatgcaggtcaccggaggtcagcgagtcacagacagagacaagggcaacagggtgaaccagtcgtctacgaaaaatacaaaaatggggccgggcacggtggctcacgccaggtaatcccagcacatgggaaggccgaggcgtgcggatcatgtcaggagttctagaccagctgggccaatatggtgaaaccccgcctctactaaaaatacaaaaattatccgggcatggtggcatatgcctgtagtcccagctactcaagaggctgagggataagaatcgcttgaacctgggaggtggaggtggcagtgagccaagatcatgccactgcactctagccggggtgacagagtgagactctgtctc

SEQ ID NO: 616119 - DNA, 359 bp, Homo sapiens
ttagctaggttcctggagcctcagctgtcagtctagatccctggcatggcctgtgtgtttgtcagggcgtagtacagctgctggagcaaaatagggctgagaaatgcttcatagttaagatagcagttcagtctggtactatcctcactgtggtgtgaagtaggtatctctatgccagaggatagctatcctaccacgcggtgatacagggacccaggctccaactgtcttcttccccttctctatccagccagtattaagggaagcagaggtgagggaggagccctcccactcttagaagcctcagtccacctactgctcacaataagactagcgggggagactataaaatagtctgt

SEQ ID NO: 616120 - DNA, 461 bp, Homo sapiens
tgtatcgatgcacagaggctaagtcgtccctgctgagtaatgtggggagacagcaccaaagccaggcagttgtgctccagagaagcccttacccactcctacaaatgccctctcaggaagcagagggcagcgtgctcgggtttcacccatatatgcagcatctggctcagccacggaagggcacttaccaactatgaacacattacaatgtggcaacgtggatcaaagccagacttctctttcagaacctttaaaatgatcataggaaaactagcccaggaactgctggtggaaaatggcaatttaaaaactctactaccaagaatatcaaataccaacatagagaatcatataataaccctccacaaacttctcacccagctcaactagaaccaccatgcacatgtggccagaataatctgcccccagataattctgaaacaaattctagatatcacatc

SEQ ID NO: 616121 - DNA, 315 bp, Homo sapiens
ccctagcaaccttccttacaagcagcagataattaaaaaaaaagaaaaaaaaagggatgatgcttattagtaggcttagcaagggatatgaaatgcactctttaaaaccggacagattcttaaccaaaaagtttgaaagattggtcgtaacaacgtagcattcagtaacgtgggacaccctcccaacataagatcgagattcccacccgttttttaagcccacccttctctacccagtagcatttaaccgcatagctctctcacaaactaccttctctctcccaccagctctggggcccccttgaaacccagtta

SEQ ID NO: 616122 - DNA, 224 bp, Homo sapiens
caactcttgtgcctgaggcccggaaccgtttgcacccggcctgccccagtcaggccgttttaaaaaagcttttacttgggcgccccccgtctttggcgcgaaccctggaatgcatatactactttatgtgctgtgttttttatttttggaaacatttgattttttcccgtaagtccccatatacttctataaaagcgtgacttgtaataaagggttaatgaaga

SEQ ID NO: 616123 - DNA, 952 bp, Homo sapiens
actgttctactataggtggccaaaggaatgtcactcgggtccccttcatcgcgccctttatcgtaccccagggacattcccgcgggctacacaaaccccagtggggaaccacaagaggggtctttccacgggtgcggggtgaaccccaaataggtgcacccttggcatcgcatgtattttgggaccccctcttccggcacacaagcagcgtggttcttcgtcacgtcccctctcacgtgccccatttactgcgcgactgctcttctgggcccccccctgtacaggcgcgtaattccctgcttgatgctcgggttctatctcttctatggcctcctcttgttctccctcccagtgacccacccttccgaagatgcccacccctgtcggcgctgtgagcgttccaacaaaagcatatttataaggcggggcaaccaacaaaatcacggccccctcgcagagtgcggttctggaaaaaaaacagtgggcccaccggcggctggccccccccgcccatacggcaggctcacctgtgtgagcgcccacccccatgtcacgggcgttctctaataggcgcggcccgcggtgtaactcccccggcgaaagcaggatgacgcggggtaccgtccccccagcgtgattagtcccgtggctaccccccctctgcgggttgttatccaccacgccaagagagaccaggtacaaccccccggccggttggagaaacccccctcttctcgcacccacagaatcggacaaaagcctgggaaacttaccctctactccttgggtcagtgcttcactgaagttatctcttcctcctggtaaaaggagcagtggctcttcttatctatggtcttaccagaaaatcgtgtacagataacaaattctgcactcattcaagacttgcattgtaaaaaactcaaaacaaaccatataaagaacaaacaaaaca

SEQ ID NO: 616124 - DNA, 980 bp, Homo sapiens
ctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctga

SEQ ID NO: 616125 - DNA, 258 bp, Homo sapiens
gacacgctgtgcggcattcaccgacagtctgtcatgcacccaccaggttggccatgtccttgtgttcctatcggatgctcccagtaaccagggggaccacccgagctaatcatgcgaatgtcctgttcgccagctagacagcgatagaagaaacgattcgtgcacttttaacctgctctcatcagggcccaagggctggctgggattattgtttttttttcccactaactgtgtttctgaccaaagtgaattggaggc

SEQ ID NO: 616126 - DNA, 427 bp, Homo sapiens
  misc_feature (63)..(63): n is a, c, g, or t
  misc_feature (145)..(145): n is a, c, g, or t
  misc_feature (218)..(218): n is a, c, g, or t
acaagattagggacactttttgaattattccttcaaatatgttttctgtgttgtatacttttnctcctctctcaggaatgccaataatttataggtttggtcactttacataatcccatatttctcaaagattttgtttattttncttaattctttttttaattttttgtcagacttggttattttgaaagactggtcttcaagctctgaggtttttncttctgcttggaacagtctattgataaaactttcaaatgtgttttgaaaatttcagttgagtttttgaattccagaagctctgattgatttcctaagatgtgtatctcttacttcatttcctgaattgatttagggagtttctttgtgttgactttcaacacactctagtgcctgtgttttaagggctgttgagcaagatggaagagtg

SEQ ID NO: 616127 - DNA, 100 bp, Homo sapiens
tcggtaccatatatacattagtaaagttagacccataaatgaaaaaaaaatctcaagtaagtgaaccagttaaatgtttttttgcattacgaactgtaag

SEQ ID NO: 616128 - DNA, 347 bp, Homo sapiens
  misc_feature (271)..(271): n is a, c, g, or t
  misc_feature (279)..(279): n is a, c, g, or t
tgctttaatgcagattagccattaattaaagtaatatgtatgtggaattgatcctgcattatgatggtagctgtgatttgctcattagtgatgcagttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcactaangcctctgntgcccttaacattttttccttcatttcaactttggtgaatctgacaattatgtgtcttggattgctct

SEQ ID NO: 616129 - DNA, 119 bp, Homo sapiens
  misc_feature (53)..(53): n is a, c, g, or t
  misc_feature (98)..(98): n is a, c, g, or t
  misc_feature (104)..(104): n is a, c, g, or t
acagtcaccaaccccaagaggaccgcccaggccggacgagcaagaaggcctgncaacagactgctgccgaaggtcaaccagaccggctcggtgaccgnatcganccaggcgtgcaaaca

SEQ ID NO: 616130 - DNA, 126 bp, Homo sapiens
gggagcgtggcacttacctttgtcccttgcttcattcttgttacaagataaaactgggcacaggtcttaagtacaatataaatgaacaaactttcttttatttccaaatccatgtcaaatatttta

SEQ ID NO: 616131 - DNA, 699 bp, Homo sapiens
  misc_feature (24)..(24): n is a, c, g, or t
  misc_feature (73)..(73): n is a, c, g, or t
  misc_feature (85)..(86): n is a, c, g, or t
  misc_feature (106)..(106): n is a, c, g, or t
  misc_feature (109)..(109): n is a, c, g, or t
  misc_feature (113)..(113): n is a, c, g, or t
  misc_feature (130)..(130): n is a, c, g, or t
  misc_feature (199)..(199): n is a, c, g, or t
  misc_feature (204)..(204): n is a, c, g, or t
  misc_feature (215)..(215): n is a, c, g, or t
  misc_feature (264)..(264): n is a, c, g, or t
  misc_feature (272)..(273): n is a, c, g, or t
  misc_feature (315)..(315): n is a, c, g, or t
  misc_feature (317)..(317): n is a, c, g, or t
  misc_feature (344)..(344): n is a, c, g, or t
  misc_feature (386)..(386): n is a, c, g, or t
  misc_feature (437)..(437): n is a, c, g, or t
  misc_feature (576)..(576): n is a, c, g, or t
  misc_feature (675)..(675): n is a, c, g, or t
tgtggacagggaaaacagcaagtncacaaagtgggacaggaccaaaggacaggctgggagttaataaagagtncacactgcttcnntgctttccccagttactganggntctnggccacctcctcctcancctcctcctcgaactcgccctcctcctcggctgttgcatcctggtactgctggtactcggacaccaggncattnatgttgctctnggcctcggtgaactccatctcgtccatgccctcgcccgtttacaagtanaggaaggnnaaacgccggaacatggccgtgaactgctcggagatgcgcttnancagctcctggatggccgttctgttgcnaattaaggtggcggacatttttagcccccgaggtgggatgtnacagaaagccgttttcacattgttggggatccactaaacaaaatagctgcngtttttgttttggacattaagcatttgctcatccacctccttcatggacatgcggcccctgaacacggcggcaaccgttagtagcggccatggcgggggtcgcaggcagccatcatgttcttggcatcaaacatctgcngggtgagctcgggcacggtcagcgcccggtactgctggctgccccggctggtcagttgggcaaagcgggcatgaagaagttcagccggggaaacgggancatgttcacagccagcctccgcag

SEQ ID NO: 616132 - DNA, 296 bp, Homo sapiens
ataggccataccatgcagatgcgagcggtgcaagggaaactgtgtacgaacgtacggaattcgcattatgaaagttcgacacaaagtgctgtttgggggtttttcggtgcaattgcgcagcaaaaaatgccaggcgaggcgtctagcgcactcggttggggcgcgactgttacttatctagatccacaccgtagaacggcgttacgccaaagggggtgatcttgaagtcacgcacttgcttgcgcatagggtgagagaacggtcgagttcgcaataggcgttataggtacttgttc

SEQ ID NO: 616133 - DNA, 157 bp, Homo sapiens
atttttggatcaagttgtttccagttaaaaagtactgatcaacaaactaatacacttaaaactgccacacgcaaaaaaagaccaccaaagatggtccacacaaacattctccgtttccattctgaagagttttacagatagcattagttactcatta

SEQ ID NO: 616134 - DNA, 140 bp, Homo sapiens
ttgctcccgggctctgtgctctatatcagagtgactcaggcaaaacatactgcttattgtaacactgctgacttggaagaagagattctccgttgcaaatgtggtaggaaccaggtttaagtgtgatgtctgggaagcca

SEQ ID NO: 616135 - DNA, 418 bp, Homo sapiens
ctcggctgagtctgcactggattcacattgtgcgtataccacgataatcttgccatctagtttcaacagctgtaaatcacagtctccttcgacagcatgctccttcagttgcctcacgctgcatcttgccacaggggtggggtccagcacatggcaggtggtttccagggtgtctatttcaatctcaatgcagctctgcggaaggctcctgaggcctcacctcttgttcatcaatatggttcacggtgtgtatgtatccccaaggaaggttctaattgatgtagtctatagcctccagagctgcttcctcagtatctggatcatcgcagttcggttgtctataaatcagccctaggccatgtgggcctgagtggcagcctcagatctgagcaagacagaggagcaggaacaggcactt

SEQ ID NO: 616136 - DNA, 517 bp, Homo sapiens
ttatgtacggggctcgtcctgcattccgtcgtactcaccgccctcatcacagtccgtcatctccaggcagtgttgtaccagtgcagggcctctagccagtcttggcaccttgccaggagatacagagggaaaggtggaggttaccatggcaacagggtggcaggaggagggccttccagcaggaggggcaagtcagggatcccagcagggccaccacctatggttcacgacctatcttgtccaaggccaatacatctatgaggcaccttcatactgtgatattcattcactcattcattcattcatttttgagacagagtcttgctctgttgcccaggctggagtgcagtggcatgatcatagctcactgcagcctctaactcctgggctcaggctatcctcccacctcagcctccggagtagctgggactgcaggtgtccatcaccacacccagctttttgtgtgtttattgtattttttaatttttgtgggtacatagtaagtgtgtatatgggt

SEQ ID NO: 616137 - DNA, 108 bp, Homo sapiens
agggtcggaggtagagacagatgttctgaactcccactgtgcttgagcccagcgcatgtatgcgtggagtgtatgcgcagagtagtgtctgttggactgcttcatcca

SEQ ID NO: 616138 - DNA, 130 bp, Homo sapiens
attctgcccactgcacgccagcctcccaaagtgcaggtattacagacgtgtagcaccgggtcctgaccgagggtgtcttttttctttttttactttttaataatggccattctggctgggcgtgcagtgg

SEQ ID NO: 616139 - DNA, 317 bp, Homo sapiens
tcgtgtgtcgtgcaggaatcgtcgtggtggtggatccctggccggctgagatcgactccctgtgggagatcagcaatgcagatagaatggccatacgatttgtgctctgggtgacggggccgcctggcctgtgcagggtctgatcctgccacgtttcggcctggagctctgaggagcgggatgcagctggttagcccaagcagcatcatggccctggcatggctgcctcgttagcccacctacacgacgacgacagaattcctggctggggactcctcctagatgtctgaccctgcacggacatgcaatgccttggc

SEQ ID NO: 616140 - DNA, 294 bp, Homo sapiens
gcttggggagagccccaccgttgataactagttagttaaccattgttgtactgaaccactattacgatactgctgtcatgaactcctgtgtgtaatatgttttccctacaaacgtagcacccttcagcaggaccctataaaactttcctccagcccttgcctctttgcaggtagccccttctctgctgagctgcccactgcaacatattttcacaatttctctaataaatctgctcttctttacctacaactatcttggtaaatggctttaccacctgcaaaactgaccctagg

SEQ ID NO: 616141 - DNA, 136 bp, Homo sapiens
ccagtagttccatgccacgtgtgtgctggcagtcactatactactaagcagtaccgctacctcaacaccaccttcttcgaccccgccggagaaggagaccctattttacaccaacccctgttcggttgagcggaga

SEQ ID NO: 616142 - DNA, 439 bp, Homo sapiens
  misc_feature (12)..(12): n is a, c, g, or t
  misc_feature (24)..(24): n is a, c, g, or t
  misc_feature (41)..(41): n is a, c, g, or t
  misc_feature (59)..(59): n is a, c, g, or t
  misc_feature (169)..(169): n is a, c, g, or t
  misc_feature (198)..(198): n is a, c, g, or t
aaaaaaagcccntttttaattgtntttgggaaaatccatcnccttcactgttagccaantggtagaattacctagcccatgattacctagcagatacagaagaacaggacagcatccatcagcccaacaggactgaagccaacattgtagaatagtgcctcaacaaggnccgggtgcggtggtcccatgccctttaanccccagcactttgggaagcagaggcgggcagattgcttgaggtcaggaattcaagagtagacctggataacatggtgaaaccctgtctctactgaaaatacaaaaattagccaggcatggtggcgcatgcctgtattcccagctgcttgggaagctgaggtaggagaatcgcttgaactgggaggcgaaggttgcagtaagccaagattgtgttacaaagcttgggttacagaataagact

SEQ ID NO: 616143 - DNA, 102 bp, Homo sapiens
cctggtatcccaccctgacaaactccttctcccatcttttccaactcttcctccaaactccagctataggaatcaccttttcatgtagacttccctgatgcc

SEQ ID NO: 616144 - DNA, 893 bp, Homo sapiens
ccttcatttggggtttcggttcccccccttccccttccccgggtctgagggtgacattgcaccggcccctcgtggggtcgcgtggtgcaccccgaggcggactccccagctgtgtcgccctcccatctgccgtgtctggttcgtgcccccaccctgcttcccacctgaccagccactgcgcgtgcgaatgcgagtagctctaccaggcgtgcagctctctgtctgcgtcggcccggctcttcgcgcttttcttgatcactgtggctggggacccgctagcgcgttatcatcctgtgtcgcagtggcatttagtctggctggtctccctgctccttggactctgtggtctggttcatctttggtccttgtgaccgaccggtcagatgcccggctccagtacggctcctgatttaggtgctgcgtgtctctgtccttctacaggaggtgttccgctttgcctactacaagctgcttcacgaaggcagatgaggggttagcatcgctgcagtgaggacggaagatcacccatgtccatccgccagatggcctatgtttctggtctctcctgcggcatcatcagtgggtgtcttctctgtgcatcaatactgttggcgtgaatgcacttgggccaggtgtggtccggaatcccatggtataactcacccctaataacttcctgacttcagactttctgaatagcaggcaattatcctggtccataacgttttgggaaatgtgtactgggtgccggtgacaggcaacagtctctgggccttggccctgtggtggaaagaccacatgcttggcgcttactccgaaacccggttacgcaacctaggccataacatccagggcagggcggcccaaacggagccccaaaacaggcgtttaat

SEQ ID NO: 616145 - DNA, 391 bp, Homo sapiens
cttttggggtctttgctcatgttcttatttttgcaaaataaacatggaggacacgaacaattaagagtacatttatcatattagaaataattcattgacatatgctctccataccatatgcttctctgattgttgcaaacattgaatattagtactgaagaatttatgaattttggctgtaaaatgcagtttttctagaacgattctttctttgaacagataaaataatgcagtattcagagccttctgacttatttcggaagagtgctaagtataggatctctttaagtatagattcgcattctcaagactgcacaagaggtaaaacctgctgaaaagcactacaacatgtcacaaagttacccaaatgatgaacaggatgcttgggatg

SEQ ID NO: 616146 - DNA, 100 bp, Homo sapiens
aggatattaagaaaaactttgaacagctttaaaaaagatatgctttaagatactagagagataacaaggtattaaagaactagtgggcctgtagcttcaa

SEQ ID NO: 616147 - DNA, 526 bp, Homo sapiens
  misc_feature (23)..(23): n is a, c, g, or t
  misc_feature (55)..(55): n is a, c, g, or t
  misc_feature (68)..(68): n is a, c, g, or t
aagtttctaagttttaggaatgngtttaaaagcgccagtaaccatggatcattgnaaagaaggcactnttcagccttggtatctagctgaaccaaatgacacctttcaaaccattgccagtagttgttgaaaaagcgtctattgtcaaagtttctttctccttaaaggacggtgttccaatgaattcagtagagcccactttcctccactgtggaggaagaatccctaagagatactcaaatgattaaattaaaattggatcatcaaactcaagagaggcataaacttagacacagtcttgcatttttgtctttcctgaactcttctgccattttcctccttcactcgtcctgaaaatctgcaagttacataataaaactttagatatttgtctgacaaagtgtaattactcaactgaataaatgactgagaacaagttacaaaaggaatcatgaatcctggtaaacaataaagaagattcagacactgagggaaaaaaataaagctttttacttaaataatgaaa

SEQ ID NO: 616148 - DNA, 255 bp, Homo sapiens
taacatgtcaatctggccgttcacatgtgtgggacatggtgtttgtggccttgactgacatgaagctgttgtgtgaggttcgcttatcaagtaatgatttagtgatcaaattgtgcggtactttgtgcattctggattttaaaagttttttattgtgcattatatcaaatctcccactgtgtgagtggaaattaagactttatatagtttttgtatgttgtaatagttcctcaaataaatctctcctataatcca

SEQ ID NO: 616149 - DNA, 572 bp, Homo sapiens
actctttcttcatcttttttcttatgatttaaaacttactagttagaaacttttttgtttgcctcaccatgcttcagtgaaatttcgcttctatgatttgttagaaaaacaaacaagctaacacacagacgcacgcacacgcactgtatattcttccaccctgtagtataaagaaaacattttcatacatccgaaaatgaaatatgttcacctttttccttccaaaaggtagactgtgagtgatgtccgtgtggtgtcctttgcccccatttcttactgtcagttctatggtataaaatcctcagtatttgcttaatctttttgtcattgaggaaaactaacagtaaaatgagttagactgaaaatgccctttacagttcagcattcagagtgaggaacgaggtctatatgcagttaaggtgagaacggaaccgtagcttccgccgggcggacttgtgagcacgtcagaaagcgaatgtgcctcactagaacgcacggtggcggcaggagtggccggcagtgcccggcacgcagtcacgggaggtgggtcgagtcctggtttatgtgagtcg

SEQ ID NO: 616150 - DNA, 573 bp, Homo sapiens
agagcatacccctactctctagttcccaaacttcaaagggcaaaaaaattgttctcccctggttcacacttccctgtctcaactgggtggtggcttttgaactgggattattaaaattcccagaatcctttctatggtgaggtatcctttctggttaagcctccagaatttgctccagaggtgaggagaagggaattcccttgagctgtgcatttgggaagggagcaaggaagtcaggggttagggaaggcacttcagccattgccttgaattagtatcctatcacatagagttgaagggggaaagccaggatttggcaaggatgagcttttcaaccttggcttctcagtaaaatctctggacagtttttttttttttaaaaaaaaaaaccaaaaaccagaatttaaacaatccgtaaaaccataccccgatcttatcaccataggtgcccgtgtaattgtggtcaataaggaccccggcttcgaaaatttttaaagcttccccggtgaacattaaaatgcacgccgagtttggaaacttggcctctcaaaaagggggaatccctgttctggg

SEQ ID NO: 616151 - DNA, 187 bp, Homo sapiens
  misc_feature (115)..(115): n is a, c, g, or t
gaccggtctggtaagagcggtctggcctacaccacagtccacagcattgctggatccgagccacgtctgtgacctacaccacagctgacggcaatgacagatccttcacccactngattgaagccagggatccaaccagcatcctcatggatactaatcaggcttgttaccattgagccacaatggg

SEQ ID NO: 616152 - DNA, 1163 bp, Homo sapiens
gttcatgcctgtgctgtgcttgagtggcctcttacatgcgtcctgtcagccatcacgtgagcactttcaggcagtcctgacaggttcagcgagcggtactgacgtccaggcattcgctgtggactgatggagctagattgatgactagcttaatttcactactcgcggcaaccgttgtcatcatggcattggctcacgagtcgcaacgaatgggagccaggtgtcccttggtggtagtaagaagaaggcgatagagaagagcattgcatgtagtcttagttcagcccaagaacgtgagagccaaagtctggtcgcacgaggcagtgtgtggtgcatgagactgtcgcctcgaagaggtcctgtgtacatttccatgatcacgtcgctggactcgactcgagatggcgcatcttctgtgctgcagtctgatgggcgacgtgcgaggcatttcctgtggcccagagtgatagcgtgttaccacagttctgagcgtccacaagacgcagtcccagtgggactccgctgagcggcgcagaggagacctgaagccctaagcatgaacaacccctgtgtgccaatcatggatcgccgtcacgtgccagatagtgtccgtcaacacggggcactagcactgggcccaggaacacgacgaaagcgcttggttagacttccttagcggtaagtgacgtcctggcgtcgcaccttgtcgggccttgactaggcaaagatcaggttttcagccgtggagggcttagcacgttggcaagtgcaaggggtattgaagcgcagtgatcccggagtatagtcctatagagggcgcccagggataagtagccttccctcgaccaggttctcgttgctgatcgggcacttgccaaacgtacgactcgcactttggccctaaaaaagaaggttggtataaagaaggctttggtcaaggacactggttccaagctcctttgctccagcgaattctcttcacaagcaggagctccaccgaccccgggaattcagttctggttcccttagtgtcaccccttggggacttgtttgctttcccaggcgaaaccggggggctctgggccttcctgtcttggcgcccaggctgtggtagcgcccactgcgatttcaacgcaagtcgggtgccggtacttccttggccg

SEQ ID NO: 616153 - DNA, 2102 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaa

SEQ ID NO: 616154 - DNA, 1953 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggaggctatggacgccaccttccgtcgacgcggccgcgaat

SEQ ID NO: 616155 - DNA, 392 bp, Homo sapiens
tggatacggcatgcgcacatgctggctactttaagagtaagatcttttaaaacagactgtggtgctaagctcaaacgtgtttttggttgtttccttaaaaaagaaaacagtgatagtgcccaacactatgaatgtatttaacaccattgaattgtactcttaaaagtgattaagatggtaaattttatgtgtatttaccacagtaaaagtgggggaaaatgcaaaaaagaaagtgaagaacttatttccatattagtcttgtgtttaaaatgtaaattggatagaacttataaaagtcatcggggttttaaatgtaacttactttaagtggctatttaaaagctagtgtgcattttaataggtgttggggatagaataggctagtgtcatga

SEQ ID NO: 616156 - DNA, 735 bp, Homo sapiens
agcggtctggctggcctgaactcctgacctcaggtgatccacctgcctcagcctcccaaagtgctgcgattacaggcgtgagccactgtactcggcctgctgtaggctttatatacactgtgcacttaggctacataaacttataaaaaactttcttcaataataaattaactttagcttcctgtaacttttttaccttataaacgttttaattttttaaactgtataacccttttatcataacacttaccttaaaacacaaatacatgtacaactgtacacaaatattttatattttcataagcttttttctatttccacaatttttaattttttaatttctttttttacttcttaagtttttttgttaaaaactaagacacaaacacattagcctccatctacactgtcttccacctccacagcttgtcccactgcaagggccttcaggggcaataacaggcatggagttgccatctcctatgagagcaacaccttcttgtgcaataccttctggaggacctgcctgaggctgttcacagtcaactttttctttaagtagaaggagtacactctaaaataaaaagtgtagtaaagccataaaccgtagtcattattatcaagtattatgaactgtacataattgtatgtgctatacctttatatgactgacagcacagtaggtttgtttacaccagcatcaccacaaacacgtgagtaatgcattgcactgtg

SEQ ID NO: 616157 - DNA, 2182 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaa

SEQ ID NO: 616158 - DNA, 175 bp, Homo sapiens
  misc_feature (57)..(57): n is a, c, g, or t
tcctctggcagctgcatgagtagcgactttgtgtctcctccaggctgttctccaggnatgctttcatgctgagctgggactgcagctcaatctccaggttctgcgtgtgcgccggagtccgagatctcgctcttgccgctctgaaccagctcgctgttggtggccacctcgcggt

SEQ ID NO: 616159 - DNA, 2092 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616160 - DNA, 2429 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaaaaaaaaaaaaacaaaaacaaaaaaaaaaaaaaaaaaacacaacaaaaacacaacaaaacaaaacaaaaaaaaaaccacggggagcccccagcggggggggcacacagcgctacacgggcgccgacgcggtaaaacagtggtctcagaagaccacctttgtgtacgaacgagtggatatagcggggtcccaaaaagggggacaacatatgtcagaaagcgcagaccgctatagcccacagcaaaaggt

SEQ ID NO: 616161 - DNA, 89 bp, Homo sapiens
gaaccctcttttcatagccttccctggctctaattttcagattttttttttaataaacatgaatccattttgaatctgaaaaaaaaaaa

SEQ ID NO: 616162 - DNA, 2084 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtggctcccaagatccctccagacataaagtcccacagccccaaatgcccttctactgtcacgggttgctatatgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616163 - DNA, 518 bp, Homo sapiens
atccctgagcttagccgcacctggagagcaacgcgataggcagacgtaaagcgagaatcgcgagaaaggaggtgctaggcccagaggcaccagccagcgcaggccaacgggagatagtagcaaggggtgaggggatctgtatctaggcctgtcagtgatacgcagtgccagagtgcatggaacaggaagctcaaatcaaggagaggttaaatgacttaagtcacacaaatctcagtcacgggcagcttaggcaaataaatgcaaatatcttctggtcagtgttttttctactaatcacaactgctctcacatgcttactggctctaacacattcaatcatatatgcagacctgtctctcatctctccagcaatccaagagcattccctaacatgcttgaactaaagacacctaaagctagcaatttcacatcagagctgaaacattccacacagtccttagcataaacaaatatttgactatcttctattttacagacttgctatacttttaaattta

SEQ ID NO: 616164 - DNA, 2002 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgcttgtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616165 - DNA, 534 bp, Homo sapiens
tggattcgtaatttaattccccacccccaagacgggccaccggggattacctgaaaattggaacacctattggctggaatacaaatgcaccaaatgaggatttaaaaactttccgcgcgaaaggtataccacaacgaaaaaagaatttcctagcattttcccccaaggtttaaatttcccgccacacacactttccaaaggaccgttacaaatccaactttatgtcagtttcttggctttggtggagagggaatccactactttgctcatgttctgaattgtttccaaagcagcttcgtaagttttatttactgggggttcatcgaaaataatcaggacaccctccccctggcccaaaatcccatgaaaatttttgtaaagaatcattggggaaaatttctttccacgtcggccttggagagtttgaagaaataaaatatgggtcaaccggcctttggaaaaaggctcaatggctctggacaaaattttgttcaataagatattatacaacttggcccaagggggggttgtaag

SEQ ID NO: 616166 - DNA, 1933 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgcttgtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616167 - DNA, 716 bp, Homo sapiens
  misc_feature (2)..(2): n is a, c, g, or t
  misc_feature (65)..(65): n is a, c, g, or t
  misc_feature (102)..(102): n is a, c, g, or t
  misc_feature (115)..(115): n is a, c, g, or t
  misc_feature (122)..(122): n is a, c, g, or t
  misc_feature (124)..(124): n is a, c, g, or t
  misc_feature (134)..(134): n is a, c, g, or t
  misc_feature (138)..(138): n is a, c, g, or t
  misc_feature (142)..(142): n is a, c, g, or t
  misc_feature (154)..(154): n is a, c, g, or t
  misc_feature (162)..(166): n is a, c, g, or t
  misc_feature (200)..(200): n is a, c, g, or t
  misc_feature (233)..(233): n is a, c, g, or t
  misc_feature (276)..(277): n is a, c, g, or t
  misc_feature (279)..(280): n is a, c, g, or t
  misc_feature (290)..(290): n is a, c, g, or t
  misc_feature (303)..(303): n is a, c, g, or t
  misc_feature (311)..(313): n is a, c, g, or t
  misc_feature (327)..(327): n is a, c, g, or t
  misc_feature (333)..(333): n is a, c, g, or t
  misc_feature (346)..(346): n is a, c, g, or t
anaaaaacttgaagagaggagaagaaagaagtcaccgaagaggagaaaaccaaggaggagaagcnagaagccaaaggggtcaaggaggaggtcaagttggcntgaatggacatcnccagatntngaaaaaagangagnacancacgtatcttcnccaacccnnnnnattttatattttctatttctctgtgtatttatanaaaaatttattaaatataaatatccccaggganagaaaccaaggccccgagctcagggcagctgtgctgggtgagnncnnccaggagccnccttgccacccantcttcccnnncttaactttgaacnaaaaanggaacaaaaaaanggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttttccaaattcgccaggggagggtggcaaggaaaatttcccctttttgaaaaaactatttcacatttttgtgaagcctctttggaaataaaatggggccactttctaatatccctcccttgaaaaaaaaa

SEQ ID NO: 616168 - DNA, 896 bp, Homo sapiens
taaaccaggtggtcctttgaaaggtaaagacaaaaagtgcttttggtgtgtgtcatgggtttaggcacagtttctgtttaaaagccggcaaaagggataatttggtgacttggaggttgtacgctggctattttggtggacaagggaatgttcaaggtggcttccatggctggattttcccttattgtaatccagtattttaaagtcaagagagtcagtggtcattttaacaagtcttgagccaccctactgttgtaaccatctctatttattatcaagggcttataattaagagtctaaaaagagaagttttctaaaggccggttcatggggacaaaactcttctcagaaagcttttgcaatgggacaggaggataagggtcagcaagggtccttggggaaactaaaaggtggctcgattttttgttttcaccatgttctggtgtatctcaataagggttcccaaaaacaaaaccaacacaacaacactacacacaacaatattttttgtgggggcggctcttcggcgcctcagaaaaaaactgtttttgtaaaaccaacttgtggtgtgggggcgcgcgggggcccccaatttgtgcgttattggacaacactgtcacacaaacagtgtggtttcccccacaaagaggaacacaccctggcgggcgccgagaagagacaacatcgggcggctgggggggcttctctccaccacaagaaattaaaaaaacacgcgccgcgggcggcgcacacacagcagggcttcgctgacaaaacaaccctcccaacacaggggggcggctcctcgacggaggacgcgcaacactaaggggggcgcctatcaacagcagagggggggtcctaacagcgaggccgctccagcattcaacaatacg

SEQ ID NO: 616169 - DNA, 283 bp, Homo sapiens
  misc_feature (7)..(7): n is a, c, g, or t
  misc_feature (9)..(9): n is a, c, g, or t
  misc_feature (39)..(39): n is a, c, g, or t
  misc_feature (65)..(65): n is a, c, g, or t
  misc_feature (201)..(201): n is a, c, g, or t
cagtctngnacgttcacactgttgtgtaccccgttcggntatgcggtacagctggggacccgggnctagttgactttagccactggctggtttgcctggctggctccctgacaggctgccacactttcctgcactgctctagaaaatttgaacagaagcaagacaggcgacgtagaatccaggctctctgcctcctggggnctgtaaccgcataccgacgggatccgtgcacgttaacgattactaggactatgcagaaaccagtccgacgaaaatctcaggc

SEQ ID NO: 616170 - DNA, 794 bp, Homo sapiens
ccctgacagaggccacatgaagtcctagttggcacttggcagtggcacatgctttatgttaggcgtcccgttgtgatggctgagaatcatgaaacgacagatcctcgcgctagcctctgtggctcaagtttctggacaccaagtctctgggaactagtggttgtgattatctaaatgtgcactgtggcaccttaccgttgtctctcacgtgacgttagagaaacgctaaaagcgcatgttaaaaaagttacgcaacgagttttgctatcagtacctttcccgataactgggcgttgccatgccgttgctctgaatgaaatcatctatactctgacttgggcgcaacgaactgcactttctttgtgacattctgaatccagtgtattgtgcgtttctctggcccgtgaacacctcggcgaattctgttagggatagcggatgagtgggacgagaagcccatttgagaaggagggagccaggccctgtcatgcgcaggttttccactcatctgaggaagagccagggctctgaattctagcctaacactcatctctggactgtggagcttgggaagaaatgaccatgatttacagatatgtatcttggtacatactatgtgtgatacttgaaaagataaaagggactgccagcccctaactgaaatatgaagctgttttatcgctatttttcctacgtcctgtctcctcccttccacctttctcctagcattgtgatgatctagtaggacgtctgtcaacagacacatgcctcctaaacataaggtctaatagttg

SEQ ID NO: 616171 - DNA, 149 bp, Homo sapiens
atgcttcgtgaagatcggcgatattggactggacgctcggcgtgtgcagtatggttcttcggcgtgtgcatgcacacgccgagtatccatactgcacacgccgaagatccacactaggacaggtcagtccgtaatcgccgatcttcacg

SEQ ID NO: 616172 - DNA, 2152 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616173 - DNA, 378 bp, Homo sapiens
tgtgaattctcgtgggcgtgcaaaggacccacagctgccgaaacactggggaggagtgaagctgaatggcagcaggtcctgggtgcaagaatcacaaaaccacagtcatggggccacgtggcgttggctttccgaccgatgagcagaaccagagcgtccagaaacaggcgcccacacgcggaccactgacttgatgaaggctcaaagaccatttaatggcatcttttaataaggatactgtaaatgataggatcactcatacaccagaaagtgaacttggagtcaaaaaaattaaccccagatgcgtcagggatctgaaggtaaagcccagaaccgcagagctagggcgaagcctttgtgacagtgggccgggccaca

SEQ ID NO: 616174 - DNA, 1690 bp, Homo sapiens
  misc_feature (1564)..(1564): n is a, c, g, or t
  misc_feature (1574)..(1574): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgcttggtgttccggtcattgctgatggggaatccaaatgtggtcaattgcgaaacctggcctgggctccagcagtggcttcggtgnccctgggccngggatttttcggggcggggaaatggggggtttccgccgggccccccaatttttggacagcgcgcgggggtggggcgcaccctttgttcctgcgggccctctgttgttatctcgtac

SEQ ID NO: 616175 - DNA, 596 bp, Homo sapiens
cggtgtcaaaataactaattgggtgatgggccacatagttttgaagaacgtagagtctagcccatagagtgactggaatattcagttcacttaccaccataccagcagatatagcagagcaatttcaatttggcagtaaaccagggtaaatcatacccagacttgtttgatagcaaaagactaaaataactcaagtgccataccaacagtggacaggttcacttaacatataatgcatttgcttaactgcagtccatgcaagtgtgtcacgaggaggctctgtatgtgctcgatagggaaagttctccaagatagattgtcatgaaaagggcaagtgcagaaaagtctacacagtctgctaccttgcacaggaatgaaaaacaagtgaagaaaacgcgtttcattcattatagactgatcatccagcaggactgagtacgtgggcagatccacaagaaaaggaacatagtgcaccgacctggatcagtcgcagggatggatctctttatatataatctctttacttcacatagtttgaaccctgtgcttgttctacttatttgaaaaattaaacagatttggtattcagaagaact

SEQ ID NO: 616176 - DNA, 842 bp, Homo sapiens
ggctagagttagtggtttggctccagtttgtgccttcagctacttcactgcttccctaacctggccttgtcagtcagcctcagtctaccatctacccaggtctgcataccccgcaaaacagtatacactttgacgcttttctgcaagcacaattaccttttgggggagcccttctcttaaagcagagtaggttaatgtttgtgaatgaaacggaactttggcaggctgaggtgtctcaggtcatcagcttacgttgtctactgtgtgactaattgaggcaaaagatgtcctttttaatagtattttctcatcacttttgcctgggtgccctttaggaatgttatttttggcatacaacttgagtttcacttaaatttataattctttctgttcattcctactgctctgttgcccagatgtggattttgctttgtctcacaagcgttgctgaaacactggtagaaaggtggacgacggattggttgtgattagtttgatcttcacagtacagaaattcaaaaggtcaataagctcaacaagattgctgtctcactgatgatcagagttgccattaaaatcgtatttcccgcacatcaggctggaaaaaagaataaacatgatcattttagttgtcctcaaaggagaagaggacaggtattctgtaatcaggtgttgtgagtgtaactagttaaactctttgggaggtgggcagttttaccttggcaatatctatcaatgcattgcctgtcatcatataattccatttccaattcaatttatcctgtgggggtagaggcccaagtgagcagaggatgttctttccagcattgtttataatcgca

SEQ ID NO: 616177 - DNA, 405 bp, Homo sapiens
gctggtttttcctaggttataattgtagaacaaagattattataatattggaatagagttatgctataaactaatgattagtaatatatataatcatagctataatctatttctagtataactattcttattctatgtattttctttattatactggaacagcttgtgcccatcggtctcttgccttgtgcagctggtatggcttgtcctcccacatggacactgctgggacattagtctgttaatacttgaactcattgttttaagacttattttcactaagagcttcacctatttttaactcgcactagtggccatgacgctctgccgagaagctgacttgattcgtgtaatctcctccagttataacagtgcaaggagactatcttatcagcattactagag

SEQ ID NO: 616178 - DNA, 164 bp, Homo sapiens
atcagatttgctatatagaaacagaatgaataaatgaactttttactttttgcttttttttgcatgaggtaagttaaagagattcaatttgatacttctagaggggggaaaaaggatgttgaaagtaggtcttcattttgcagtcatcatctgtacgaattctt

SEQ ID NO: 616179 - DNA, 197 bp, Homo sapiens
  misc_feature (111)..(111): n is a, c, g, or t
cccctttgggggccccggcccaagggcccctttccccccccccgggggggcgggggggtaaacccggggggggggggggttccccccccccccccccctttttttttttcnaacccccttttttgggaaaaaaaggggggggggggtttgttttttttttttttttttttccccccaaaagggggattttaagggga

SEQ ID NO: 616180 - DNA, 1332 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgtaaaaaaaaaaaaggggggcgtaaagatatccaaggggcaaattgaggtacaagttttttacaagggcccaggggggaataaa

SEQ ID NO: 616181 - DNA, 188 bp, Homo sapiens
  misc_feature (109)..(109): n is a, c, g, or t
ctgagatattttctacaatattgtggcaattcagtgggtcaaaattgagttgtcctttctgcttcattagtttaagctgtataattcctttcccttcctacattctgtnttcatttttcggaggaagaggagttgctagtactggcattggttttcctttctcttttttttttttttttttccaggag

SEQ ID NO: 616182 - DNA, 222 bp, Homo sapiens
ccgagattgcgccactacattccagcctgggtaacagaggaagattccgactcaaaaaaaaaaaaaccctccccgggccaggtgcggtgtctcatgcctgtaatcccagcttttggggaaaccagggtgggcggatcacttgaggttcgggagttacagacccagccctgaccaacagtgagaacccccattcactactcacaattacaaaaaaaaaaaatt

SEQ ID NO: 616183 - DNA, 271 bp, Homo sapiens
ccatcctatgaaaaagcatgacggcgggatggcacacacaggcaggggacatgtggagcttgtatagtgcaggtctggagcagaaaagcagctagctgttggttctcgaccctgggccggctctctggcgaagcaagcgagggagcagaaagctaacccgaccaggttccccacccaggactagaccgagtgctcttccgtgactactactttattagtctttattgtctcaaggcagcagtctgttgaacaagccctccccagcaaggaa

SEQ ID NO: 616184 - DNA, 646 bp, Homo sapiens
acccccgtaaggtgccaaataggggaaaattaacccttaaaatattccgcattaaaaaacttttctggctgatgtcgaaaccttcatctcaaattcaactttattctgtagactaccagaataatattttctgattctatctaaaaacttcttctcctgttcaaaatccttcggagaataattactaaaaagaaatgcttcaatgaaaatttaaccctttagaaagactgtagttagatgtggctactaggctaaaattcaaacccattcacattatttcaagttatttgggccctttttatggcagttttcatgatatgatcaatacgaccaatataaaaccaaattttcagaagccctcccttgcagtcttcttgaccaaatgtaatcccaagcaactttagaaaaacagagaactgctgggtaaaatattacatttgcagatcagactctcatagcaggaaaggaataaaagaaaaatgtatcatggcaagaaaggaaaaaagaaacatgtgttcgcagttgcaaaaccatgttaagtttcgagatatttgaaatgactttcgagaaatgagactgtgttcaacaaatatttatatgcatggcacatgaggatgtaacaaagcttcacatgtactgccaaacc

SEQ ID NO: 616185 - DNA, 213 bp, Homo sapiens
gtacctcccggggtagagtcttatacagctgagcagataccagtggctacgggcctcccccggcagtagtataacagcacaaaaattcaatgggaccattaaacgggtaggtcaataaaagtggaatgtaggaataaatgatgacattagcttaggctgagtgcagtggctcacccctgtaatcccaacatttggggaggtcaaggggagagg

SEQ ID NO: 616186 - DNA, 910 bp, Homo sapiens
  misc_feature (6)..(7): n is a, c, g, or t
  misc_feature (13)..(16): n is a, c, g, or t
  misc_feature (24)..(24): n is a, c, g, or t
  misc_feature (26)..(26): n is a, c, g, or t
  misc_feature (78)..(78): n is a, c, g, or t
  misc_feature (109)..(109): n is a, c, g, or t
  misc_feature (705)..(705): n is a, c, g, or t
  misc_feature (750)..(750): n is a, c, g, or t
  misc_feature (780)..(780): n is a, c, g, or t
  misc_feature (787)..(787): n is a, c, g, or t
cgagcnntccggnnnnaagtttcngnatatcgtcgacagaccgttcatcccttcatcgacgaccggcgtagtcacgantattcctgataggactggctatgggatcggngtctttcagactgttcgccatcataaacccgcgatcttgaataaatgctggagttgactggctctttcaggcgcgaaagaatggaaaaacgtgacagtgtttcgagcgtgccaggggcgcatggggcgtgagtcaattcactgtgattaagcaatttctcgtagattttgatctcttcggaaatgcgcaagcaatacggcaccttcacgatgtaaacacgatcgaggaaggcttcgttgttgttgttattacggaaagtgacccattcggactcgttcgagtgtgcgagaataatcccgttgaacggcagggcggagataccttccgtcccgttgtagttaccttcctgagtggcggttaacaagggatgcagcactttaatcggtgctttaaacatctcaacgaattccatgatcccctgattggcgcggcacagcgcaccggaatagccgtaggcgtccgggtcattctgcgcgtagtgttcgagtttacgaatatcggatttcccaaccagcgcggagatgtcctggttgttctcatcgccgggttccgttttggcgatagcaattgtggcagaattgacggcagaccttcantacccggaacttagtgatatcggcaccaaatcatgcaggcggttngccgccaaggagacatgaggtgcgagaaancgggagnatggcctagtccttcagaacctggcattacctgggatggaaggagacggataacgggaaggaaagcacgacggcaaaataacggcagcgaaagaagaggccaaggaagtcacacaagcaatag

SEQ ID NO: 616187 - DNA, 825 bp, Homo sapiens
  misc_feature (74)..(74): n is a, c, g, or t
  misc_feature (76)..(76): n is a, c, g, or t
  misc_feature (620)..(620): n is a, c, g, or t
  misc_feature (665)..(665): n is a, c, g, or t
  misc_feature (695)..(695): n is a, c, g, or t
  misc_feature (702)..(702): n is a, c, g, or t
cgctgcggaactgtttatttctgccgatcagaaatggatggattatgcggttgataaaaaagcgatcgaatacnantacgcgtcagacactgctcggcaatagcctggtcgttgtagcaccgaaagccagcgtgccaggggcgcatggggcgtgagtcaattcactgtgattaagcaatttctcgtagattttgatctcttcggaaatgcgcaagcaatacggcaccttcacgatgtaaacacgatcgaggaaggcttcgttgttgttgttattacggaaagtgacccattcggactcgttcgagtgtgcgagaataatcccgttgaacggcagggcggagataccttccgtcccgttgtagttaccttcctgagtggcggttaacaagggatgcagcactttaatcggtgctttaaacatctcaacgaattccatgatcccctgattggcgcggcacagcgcaccggaatagccgtaggcgtccgggtcattctgcgcgtagtgttcgagtttacgaatatcggatttcccaaccagcgcggagatgtcctggttgttctcatcgccgggttccgttttggcgatagcaattgtggcagaattgacggcagaccttcantacccggaacttagtgatatcggcaccaaatcatgcaggcggttngccgccaaggagacatgaggtgcgagaaancgggagnatggcctagtccttcagaacctggcattacctgggatggaaggagacggataacgggaaggaaagcacgacggcaaaataacggcagcgaaagaagaggccaaggaagtcacacaagcaatag

SEQ ID NO: 616188 - DNA, 527 bp, Homo sapiens
  misc_feature (4)..(4): n is a, c, g, or t
  misc_feature (27)..(27): n is a, c, g, or t
tgtngtggggaaggattgtttttgttngtggggatggtggtaagtaagatgattaaagatgtgtagaggagagtagtgattaattaaaagttgatagaaattggagaaagagaatgttttaaagagttgttgagagttaaattaattgaatgtggttggaaggattagttgaaggtatattgtaaagaggtaattaaagaaaaaggattagaatatgttattgttgatgatttggtggttgaaattattttaaaagtagagttttggtatttgatagtgtaaagaaggagtttttataaagaataagaatattttttgtttagtatgttagtttttaagattgaattagattgtgttgttgtggttttatttttgaaagtaaaatttgttataaattagaaaataattttttaaaataaaatttttttttgtatgatggtatatagtttttagtaatgatgtatatattgtattgatttttttttttaaatgtgttattttaataaatattttatgaatgagtttga

SEQ ID NO: 616189 - DNA, 407 bp, Homo sapiens
ggagtcaaatattttaaccaatctgcttatcttaaatacttttgatttcctgaacatgagctcatttttagcattagtcacacttaataaacattcattattttcatcagtaaaaacccatttctggctgtacatggtggctcacacctgtaatccaagcactttgggagacgaggcggggccgatcacttgaggtcgggagtttgagaccagttttccgacattgtgaaccccattttttctaaaaattccaaaatttgcccggcattgttgttaaccattgttattccttgcaattccggagcttaagccaggggatttgcttaacctctggggcttaagtttccattgagttgagattgtcacattcaattccggcttgggcaacggggcaggattctttctca

SEQ ID NO: 616190 - DNA, 2184 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccctgcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616191 - DNA, 401 bp, Homo sapiens
  misc_feature (54)..(54): n is a, c, g, or t
  misc_feature (81)..(81): n is a, c, g, or t
  misc_feature (127)..(127): n is a, c, g, or t
  misc_feature (168)..(168): n is a, c, g, or t
  misc_feature (221)..(221): n is a, c, g, or t
  misc_feature (226)..(226): n is a, c, g, or t
  misc_feature (289)..(289): n is a, c, g, or t
  misc_feature (301)..(301): n is a, c, g, or t
  misc_feature (318)..(318): n is a, c, g, or t
  misc_feature (337)..(337): n is a, c, g, or t
  misc_feature (383)..(383): n is a, c, g, or t
tccttcaagacagtctctcgctctgttgcctgttgtccatgcctgttgtgtganatcggctcattgcagcctttgcctccnaagctcaagggattctcctgcctcatcctcccgagtagctggaatnacaggcatgtgccaccatgcctgactgatttttgtattttnagtagagacatggttttaccatttggccaggctggtcttaaacgcctgatctnaagtnatcctcccacctcggcctcccaaagtgttgggattgcaggcgtaagcacttgcgcccagcctntaagaccttttnaacatacatggctgggnattctggcagtatgttgancttttataatttcaattttgtgtaggctttttgcccctaaattttnttggaaattcttatttaa

SEQ ID NO: 616192 - DNA, 169 bp, Homo sapiens
catatggtaagtgtttggtagtaaatgatgatgatggtgatagtgatggacatagtgagatgaggacagccccgtggatatgcttgaaggtgcaatcaatagcagtatatgacggatcgtatgtggtatgtgagagaagagtcaaggatgccctcagttgattttggtc

SEQ ID NO: 616193 - DNA, 2189 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacaggtgaggcccagtacccgtgaaggccagtgggaccccctccctagtgctgcttaggctctaacccaagcactccatctgtccgcagtcatgatgggctctctcctggctgccaccactgaggccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccctgcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616194 - DNA, 402 bp, Homo sapiens
  misc_feature (263)..(264): n is a, c, g, or t
  misc_feature (268)..(268): n is a, c, g, or t
  misc_feature (282)..(282): n is a, c, g, or t
  misc_feature (302)..(302): n is a, c, g, or t
  misc_feature (305)..(307): n is a, c, g, or t
  misc_feature (324)..(324): n is a, c, g, or t
  misc_feature (383)..(383): n is a, c, g, or t
gctctatgtagatgcgctgcatgccaactaacggaaagtttgtttatgcattgaatctctgtaggctctatgaacaggaatagcatgagtgtgctgttcgaatcagatgttactgctagaattaacatgtcgtgactggaatagcgctgacgaccattaaatcattcacaataataatactatttttattagagaatgtatacttttaggaaagctgtctccttatttaaataaaatagtgtttgtctgtagttcagtgttgnngcantcttgggggggatncttctctaatcttcagaaanttnnnctgcgaacactctttantggaccagatcaggatttgagcggaagaacgaatgtaactttaaggcatgaaagccctngacatgaagggtaccgagc

SEQ ID NO: 616195 - DNA, 255 bp, Homo sapiens
ccagggccatggaaggacccttaggagtttgatgaaaaagaccatgaggccattggggtttccccctcccaggcctcctgggggtcatccccttactttaatttttgggcctccaaaaagtgtcccaaaggggtttggccaggcccccctgctgcggatgtggtttgtgggggggggtgggcacaggggtgagggtgtgagtgacagttaccccatttcagtcatttcctggtgcaaataagtcagcaacccagt

SEQ ID NO: 616196 - DNA, 2089 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggtgagctgctacacaggtgggttggggcaataggggcagctgccacatcacagtctgagacttacttcttgtcctaggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616197 - DNA, 1561 bp, Homo sapiens
  misc_feature (1429)..(1429): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgtgccgtggngcccacaaggcgggacagtgccagcagccgggcggggcgcatggggggacaaggggaatggaacggctggccacgcagtggccgggccaagccgggaaatgcggcgcaaacgggggtccggaacccacatag

SEQ ID NO: 616198 - DNA, 146 bp, Homo sapiens
agacatgatgagagtgaggaggacgaggaggagagatgaggttatctgtggaatggggaaaggacataagtgagttcaagaagtagaatggatagttcttgttgggctaggtgggttcgctggtcaagcaaagattcagtaccaga

SEQ ID NO: 616199 - DNA, 107 bp, Homo sapiens
gctcggcccccccacctcgacgttgcccccgagattgacgaccaccaggtccagggcgtcaagctcctgcaaacacgagacgtcgtcgtcacgaacctcgacgcgat

SEQ ID NO: 616200 - DNA, 658 bp, Homo sapiens
gcggcggtggagtgcagtagctggggcggtcgcagcattagtggaccttacagaggcggctatggcggtggggggtggctatggaggcagctccttctacaagaaaattcaaaatgcctgggagtggctctaggggtagctctttccaccagcccaagtggggtcaactcctaagccccaccccctcacacattaccgacttccctgtattgcccttgggggagccacttctaaggctgcttacccttgtggggtgtcctctattttgcctgccacctctcgttgtctctccctctgaatgatggactcggcccacatacacatttttgtgtcacagtcattgatggactctatttttcttattattactttggagctatggccgtattttatactagcaaaatgtcttgttttcactctgtgtccatggggcggaggggaggcgacgtgaactttgctgattctgtagcaaaacctgggtgggggtggggtggggggtagtttacttcgttgtacggacttgataacctggctacagcgtttctatgaaatccaacttggattcccaatggccttgaaaatttggagagccattagtgttgccaccggtccatttgacggtcgcactcggaagtaacatcagtggggtgagaccgta

SEQ ID NO: 616201 - DNA, 2010 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccagctggtgtggatgtagtggtttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616202 - DNA, 1440 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgagggccatgagctcatcatcttcatttacaaggggcaacgttgcctttttggctgcgcagcacaatttcgtaggcctcctccagggtgctgcctgagggtgggtacttgggtaccgag

SEQ ID NO: 616203 - DNA, 121 bp, Homo sapiens
  misc_feature (102)..(102): n is a, c, g, or t
catcagagcattaaaggactggtgggaggccggggtgtattgtgggaagtcataacccacagatgatcaacctaagaatcctggcccttctccactctccancatgcgtggattgccagga

SEQ ID NO: 616204 - DNA, 2100 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaatacctcctaatctccgaacgatcattggagggcagagtgtggagttcactttgcgtgccccacggcctaacgtaacccgtcgattgatgcatggtagtggcatgccctgctgggatgggcatgtggaagtggcctccaatctgccattacgtcaggactgtgctggtgctgtggtgcgcgacccagacgctaaggatcagctgtacaaggttgtcgacagtatgctacgtgcgcgtaatggatgtcctcaggtcatttgcgtggatgtgagtgaatacctagaaatgtggcgtcactattgcgataagaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagacagcgggctttatctggaaaggggatccaggacaacctcctcggtatatttttcaataacaagttacgaaggaaaaatcgaccagacaaacgc

SEQ ID NO: 616205 - DNA, 407 bp, Homo sapiens
tttccccttttttcccccaggttgaaattccccccccaaaaagggaaaaaaagggggggccccccccgggggggggcccttttaaaaaaaggggttcccccgggggggaggaatttgggcaaaaaccctttttcccccggccttgggttttttgggccttttttttccccccttttttctttgaaaccccccccccaaaggggggcccctcccccggggccccctcaaatttttccgggggccctgggccccgggttttaaaacccattttccaaaggcaaaaaccttttttccccctggggggggggggaaacaaaaaactttggcccttttttggggggggaaaaaaaattgaaagggtttttaattttttggatgggggaaaaaagcctggggaaaacccccca

SEQ ID NO: 616206 - DNA, 441 bp, Homo sapiens
tgggcggcgctaaacgggtcgaggtcaggttaatatatagtggggcagatctggaagggtcacaagggaacaaacagtctcactccagtccgtttccttctttctatggtaaatttctgactgtaagtgatgctcacggaaccttggttttcttgcttccttttcaatccttctgtctgtgccacttactagcatcacaactgctctatagaaattgctttttaaaagtcatgaagttgcagatcacagaatccaagtaaagccatctccttaaagctggtctttactcccactgtgcttgggataactggtatactgaatccctgattcctgacctatgatttatggggtgtgtgtgtgtgtgtgtgtgtgtgtgttgtgtgagtgaagatctaaataagttcatgtactgtctagaggaccgagatctttctactcaat

SEQ ID NO: 616207 - DNA, 990 bp, Homo sapiens
tgatggtgtcccggctacttaaatgtctacttccaacatccttggaattctgctaagtgaagtgacaacaatctctgaaagacgtgtggaaaggctgtgactggtgccgtttggtgagctaggtcgagtatcgttcgtagactcgaaactgcttagcgtgtaacgatgcaccgttccctaatggtttccaatgcgtatgctaagcaagatacctaaaatccttccacgtgtgttacaacgcacagatgtccaacagccacaccccaccaacctcctgtactccacaaacactactctcctgccacccccccactaaccctaacagactctcttctgaaacctcacctattcgcgcaccgcgagcgcactgctgggcgtctacttcaaaagagccgtcgagccacttcttcccgcaaagaaggacccgcagggcagaagcgacgagggcatacgaatccgctcccacatgaaaaatgccacccgcgcaggcgccgaacggacagcgctacatcacaccagagaaaatggagtacgcccagcactacacccaacggggtgcagcacccaacgcgcaatcacccagacgacccccatgcccacggcacggccccaccgtgtggacgcaacacgcccccaccaggactcccatgacccgggtccttcctgcccccaccggaaccccagcaccaaccgctgacccacacacgtacggcaccaccattccctaggaatcgacgactcaccaacacacacgaagaacggcagaccacccgcacccactaccaccagagcagcaccgcaggcggctcggcaccaccccgaacgcaccacacgccacacaaaccccactccatccttacgggcctgccccgacggcccacacacgcacccgcccgcataacacaaccgcacagaacatccaaacacaaaaataccccccacacaacgcccacagaaaaaacacaacatcaacaacaccaaccaaacaca

SEQ ID NO: 616208 - DNA, 1447 bp, Homo sapiens
  misc_feature (199)..(199): n is a, c, g, or t
gcgaacacgtgagcacgttggtcagagcggtccaacactgccaggatggtcctacgggaagacagggagatgaaggaggaggagattcaatcggacaacttccatcgcatatacagaactccggcagcgtattacacgcaactctctcacggctgtcgcacgcaggaacgactggcgcatatactgccgtgtgaacagnactctatacaattgtacacgtccgcgcagagtgagtacagcatcacgcacgtgtagccccaagtagatgcgtatttcgtaacactatcggtcagtggacttccaaatgcgcaattctagatgctagaataccccgaccgtggacaacgcttagcttggtaccgccttcgtgtgggcccccatttgtgagcccgaaaggattggatgttggacagtattacgccaatctttgagggttgaggtttggtattccgcattcgtaagtttgggtttggcgttttgtgccgaaggttttccggctaggtaggccaaattgaatggttaatgagacccgccaacttaggacgcccaaaaagtgctgccaagcggacacaatgagccacctttaatggacaactgaagcccttataagagcggccccgggtttgtggaacatgaggaaatatgagcaacagaggcgtttacacccacaatttttggggcgcactttaggggggggaccaacctttgaggaaccccatggtgggcgggcgttcatacggatgggccgccctttgaagaaggtgttccagggccacgcacaaccccgccaactagatgaaccttattcggggggaacctcttaggggtcaatatgaagcgccaacggcaaaggtatatggaggaacaacaacggatggttcgcaccgtttagttgttgctcacttaatcgcggaaaaaaaccttctgggttggcgcaagatggcgcgggcgttgaaacacggttccatattcgtggggaaggcacttgtgaagctttccgaataggtgaaaggcccacgaatatataggggccttcacatagggggtggccccgccgacacactgggagtgatgtgtaacaaactagctagtcagacgctaaacctcctgacggtataatttagtagtatgtcatagctcacccgcagcacctcgatacatttgggagggtaacagtgagactaggcaacaaaaggagagtgttctacgctcgtttaacacgcctttatttgaggccggtggacaacatcttgcacgccgtcgttttgggtggcgtctaagacaggggcagccaaaacaacgttttttctcgcccccccgcgatttttgaacaacgcggtgaacatctatgggtagtaggccaagaaacgcccacccttcatgtaggggacgagagcagaaacctattagtgggtgagactacgacgcacacccccatcttgttgca

SEQ ID NO: 616209 - DNA, 415 bp, Homo sapiens
cacgaggaggacacacccattaaaggactcaggacggacaagcacagtcttcgggtagagagacacaatcagtgataaaacgggcagaacaggctcttatagggccatggaggcagcctcctcgctcatgagacattgattatcgaaaactctgtctgatgcatgtaaaccactgaagaagcgattatcgggcttccacggaagcatcttcagcgtcttgggtttagcaaaagttcatctccttctgcatccttatctgagaatgaggtctcggacagcccgggagacgagccctcggagtctccatcagatagtgcagacgatccacaaactgatgtaactgtctcatccaaatggtctgagcgaggagtgactgccatgaaggagtatgtgtgccagctgttgtagaagacgg

SEQ ID NO: 616210 - DNA, 1354 bp, Homo sapiens
  misc_feature (1301)..(1302): n is a, c, g, or t
  misc_feature (1304)..(1304): n is a, c, g, or t
  misc_feature (1307)..(1309): n is a, c, g, or t
  misc_feature (1319)..(1319): n is a, c, g, or t
  misc_feature (1321)..(1321): n is a, c, g, or t
  misc_feature (1326)..(1328): n is a, c, g, or t
  misc_feature (1333)..(1333): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccagctgtgtggctgtcggggttggctcttcccaggaaatccctcttcccgatcaattgttcacagttcttcaaacaaatcccattccaatttgggcnntnggnnnggtgccggcnanccttnnnggggngccccgggcgggagggcccct

SEQ ID NO: 616211 - DNA, 714 bp, Homo sapiens
aggactaagcaaaggtcaatatccaacacagacaacctaccctgagcagcctcctgggaatccagtataccctaagaccttgcatcttcctcaggctacaccctataccgatgctacaactgactactcagagctctatcgttcgagctttgtgcacccaggggctgccacagaccccaccatgtcagacgcatttcctggagcctctatgcatcttcccatggtccagactgtggctgttgggcctttaaggtccacaattcccatggcttattatccagccggtcccatgtatccacctggcatcacagtgctgagggaaggagggcatgatgcaggtgccagatttggagctggggctactgctggcaacattcctgctccacctcctggatgccctcccaatgctgatcagctcgcacgcatgcagggagccaacgtcctcgtaactcatcggaaggcgaacttcttcatgcggggctcagatggcggctacaccatctgcagaggaaccaaggccacctttgtgaccggaaagacatcacataccttcagcacttctgacaatgtaactgctataggcatattaacctgaagtcgcagcttagaacatgctgttgggtagactttatgttgcccatactttaagcacttatcttaataaggaacctgtaacggtactagtacatcctaagccttctgggcgagggttct

SEQ ID NO: 616212 - DNA, 1375 bp, Homo sapiens
  misc_feature (1250)..(1250): n is a, c, g, or t
  misc_feature (1284)..(1284): n is a, c, g, or t
  misc_feature (1297)..(1297): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccagctgtgtggctgtcggggttggctcttcccaggaaatccatctncgatcaatgtcagtctcaagaaatacctattcanttgggcggggtgngccggcaaccttgtggggggcccgggggggaggcccctcacagtggtggccccacaggtccgggtctgaagttacttc

SEQ ID NO: 616213 - DNA, 2047 bp, Homo sapiens
  misc_feature (1121)..(1121): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggaggcaaatgaaattntgcagcgcacaagaagggaaagttgcccattgtaaatgaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 616214 - DNA, 184 bp, Homo sapiens
  misc_feature (89)..(89): n is a, c, g, or t
  misc_feature (137)..(137): n is a, c, g, or t
  misc_feature (164)..(164): n is a, c, g, or t
ggggtccgggtgggtttgatgtacacactcaccactcactcttttgatatcagatcaacattatctttccattctccatcatctatcancatccatcttccatccatccattctccatctgtccatccatccatatncatacatccatccatcctccattcagncatcctccatctgtccttca

SEQ ID NO: 616215 - DNA, 452 bp, Homo sapiens
acagcctgccaagtagctgggactataggcctgtgccaccatacctggctaatttttgtatttttgttagagacggggtttcgccatgttggccaggctggtctcaaactcctgacctcaagtgatccacccctgtcggcctctgaaagtgctgggattacaggcctgagccagcatacccagccaacatctggttcttacgtacaattttcctcccccattccctactaaggagtgtgtaactatgctgtgctgcagggtgctttgtacatttgccgatgactgcatatatgacattgcatgcttctggttttttggttttcaaatggtagtgtgtcatatgaatatgtgaacagctcatcttcctgccagccaaaaggagagtgaaagaataaaatcattttggttattcccactgacacgattttggaatatagcaaggcctccttatt

SEQ ID NO: 616216 - DNA, 113 bp, Homo sapiens
tattctcttgatttgagcccctcagtgtatcactgcaagataaagaggtagaaaagacaaacagaccacaaaagacaagaacccagacctattgacagacgcaccttttgcac

SEQ ID NO: 616217 - DNA, 201 bp, Homo sapiens
  misc_feature (48)..(48): n is a, c, g, or t
  misc_feature (63)..(63): n is a, c, g, or t
  misc_feature (147)..(147): n is a, c, g, or t
cgagaagacacagaaggggaaggaggagaaactgagacggtccggaangagccgaaagcggtntccgggtgggtggcaggaggtggaaacagcctaaagaaaagcagccagggtaatgcgaaagagaatgagctgaacgggcggggntgaaggggagaataaacgaccaggaattcgccggagagcaagagggaaaaaccg

SEQ ID NO: 616218 - DNA, 105 bp, Homo sapiens
agcggggcgcgcctgggggcctgggtgccctgggcaggagcgatggcactagtaccttgataaagttcttacggcaccagaagagaataaagtaactctccttcc

SEQ ID NO: 616219 - DNA, 179 bp, Homo sapiens
tagaggatccccgcatttgctcccatcagtataaggtaattctctacgctttattttttcaggctttacaagtgctaagttacttaacctggccgggcgactgatccagaacgtgggctaagatactgtttctcatttctgcttccctgtgctttgcttcctgatgggagcaagactgg

SEQ ID NO: 616220 - DNA, 133 bp, Homo sapiens
  misc_feature (81)..(81): n is a, c, g, or t
tcgaattcacaggcttcttaacgcatgtacggggacactgaggtttgagggctgcacgtgagcgtatcattatagccgctngtattccacgcctgagtgacagagcaagatcctatctctaaaaaagaaaaaa

SEQ ID NO: 616221 - DNA, 653 bp, Homo sapiens
tcgcggcacatcatgttgccggggtggcagtcgccgtgcatgcggatgttctggtgcggggtctcggcgtagacctgttgcacccgtttgagcaggtcgcgggccacggattcgtaggccggcagcaggctgcggggaatgaagttgccttccagcagggtggtcagcgagtcttcgccgaagttcttcacaccgagggcttcgcggtgttcgaacggacgggtggcgcccacggcgtgcaggcggccgagcagttgtccgaggcgatagagctggtcgagattgcccggttccggggcccggccgccacgccgggggaacagggtgaagcgaaaaccggcgtgttcgaacaggctttcgccgttgtggatcatcggcgcgacgaccgggacgtcgcagtcggccagttcgaaggtgaagcggtgttcttcgaggatggcctcgttggtccagcgctgagggcggtagaacttggcgatcaggggttcgctgtcttcgatgcccacctgatagacacggttttcgtagctgttgagcgccaggacccgggcgtcactgagaaagccgatgctttccacggcgtcgagcaccaggtcgggggtgagtgtttcaaacgggtgggacatgctgactcctgcgggcggcaggcggcc

SEQ ID NO: 616222 - DNA, 212 bp, Homo sapiens
tataaatctcttggtcttcatacctgtggtgctccccatcaggggtaccccagcagccattatgggatgaagatgaacaatgtgataggggttgggaccaaaagaggaaaaggaatggggcattccaagtagaaggcacagcatgaaataacgcacggggtgaataattacgaggggacagtatacagacagatctggttagggactgctgt

SEQ ID NO: 616223 - DNA, 182 bp, Homo sapiens
ccaaggtcccttaagcctatctgtaagtattttttaagattggttctttttgggaggcttaggcaggcagatcacttgaggtcaagagtttgagacctgcctgggcaacatggtaaaacccaatctctattaaaaatacaaaaactagctgggtgcagtggctcatgcctgtaatcccagca

SEQ ID NO: 616224 - DNA, 126 bp, Homo sapiens
  misc_feature (96)..(96): n is a, c, g, or t
  misc_feature (121)..(121): n is a, c, g, or t
agggtatcccgccaaacacactgaatgaataatgaaagatgttataaagccaaattatgaaaagggcatcagttattaaacacttgtacagatgtnttacacaccatcttatgtatgcctncataa

SEQ ID NO: 616225 - DNA, 212 bp, Homo sapiens
  misc_feature (35)..(35): n is a, c, g, or t
cggcacgaggggctggcacggtggggccccgtctntactaaaaaaaaaaaaaatgcagaggattggcctggctcagtggcgggcgcctgtggtcccagctgctcgggaggctggggcaggggagtggcgtgggcccgggaggcggagctttcagtgggccgggatggcgccactgcggtccggcctgggcgagggagcgagactccgtctca

SEQ ID NO: 616226 - DNA, 179 bp, Homo sapiens
  misc_feature (66)..(66): n is a, c, g, or t
tccgttatcaccttttgccgcagagtatctgtcccgacggtcatccttcatgcctcctctaccccntgtgaaacgacctgaaccctctgtcttcgacaactgaagcaacttgggattaatatgcttgattagcttcacggaaaggcgccaggacgactaaggtcgctcacttgctttat

SEQ ID NO: 616227 - DNA, 267 bp, Homo sapiens
  misc_feature (30)..(30): n is a, c, g, or t
  misc_feature (97)..(97): n is a, c, g, or t
  misc_feature (118)..(118): n is a, c, g, or t
aataagtctcacgaggcctgatggtttttnagggtggagttcccctgcatatgctctctattgcctgctgtcatgtaagacatatgttgctttgccntcaccttctgccatgactgtngggcctccccagcaatgtggaactgtgagtcaattaaacctcttttctttacaaattacccagtctctgatttgtctttattagcagcatgagaacaggctaatagacacaggctcctaaaagttggatataattttccatggtaagaa

SEQ ID NO: 616228 - DNA, 110 bp, Homo sapiens
gcgcggcggcgccgggagggcgttcgagtgtttcgttcgcccgctttttgccaagcagccagcagccttgcagccaagtaactttccgccgcggccaagcagccaaccaa

SEQ ID NO: 616229 - DNA, 101 bp, Homo sapiens
atatagactgagctggtaccctcgcgacgtgtatcctgctagagacagcacaaatcactctgccaacaaaatttctgttatttcaactcctggccactttc

SEQ ID NO: 616230 - DNA, 629 bp, Homo sapiens
ggtatgaagtgtaacagaacagacttgtaccacctgaaactgctgctgcaagttcagatcaggcaaggaacaaacctcgtaacaattaagcaagaccaaagaagagtacacttaagttgaagacacaacacatggattcttgaaactagagaagtatggtgctcatacatcgaagcagcttggaaatgagcgacgttccaagaggcggctagtagtctttgtgttgtcttcagtgctgtacttggtgagtatttgcccggtgacagcagcagttgtatgtctttattaagcatgtggtaagatcgatgttctctcgatcttttttttaatactgagcaatgtttcatccttggaaacgggtgcggaagataagatagaagtcagcaaatactacgtgaaagtgcagatatttgagtatcactgcgagatgagcttgtgatccaagacttctccacaacaatggacataatgggtaccctaatggtacttcagcagcacgtggtgaaactgggggttattgaaaaaatgttaacctcttacggatttattcagtgttcagaagtcaagctagactttttcttccactgttcacagatttattggggaactggaaaggattaagtggaata

SEQ ID NO: 616231 - DNA, 160 bp, Homo sapiens
gttatgatgccgaggccagtcagagcatgtgtgctgcaggccgaacttctccatgcatgtccaagccactggcaggagcagagtgtgatgtaagtcagcatgtagcacatggacagccggtcaatggcaaaggcactgacaccgtagaagtgcatgaaga

SEQ ID NO: 616232 - DNA, 861 bp, Homo sapiens
tgtgaagtatttgttccggcgccgtgtgtgacgggggtcttccatccatatgccgccgccgaggggtgctcttctcgcccatgttggacgtcgtcctacactctgtgtcagtcggcggagtcccccctcccttgcgacgaattgtctcccagcccccggggtaccccaacacgggtgttgctctgcctctatcaagggcggccccgtgtccataagcgagacaaaacttctgtggggccacccctaaataaaggactggcgagtcatcctgtttgtcaccgctcggtgtcatgggagccaatcgcttcactgaccacaaggcgaacacttccacacggtcgtgaacacggttgtccaaaccccacagtgggagcaaatgtgggacggggagaccccccgaggtaaagagggggccccgctgatttcagggagaagtcctccaccttgtaccctcccagccccgaatttgtggagtacgcgtcccccaacatgtgatttgcttcaaggtacagaggcagcaccaaatttgcaggcgccccatcgagggagcaacggagtggcgtttctattatttgtttttcggccattatacagcttctttgatagctcttgaactacttactatagaaccccccttgtcaagatgaatactcccatcctacctcacacgttttataggcaccacatcttggtggacaagtgcccacacaacaaacctaactttttggagatcaacatgaacacactgatgcaccgctctgaagtacttcacaccacatcatgacacccactctcgctggacccaaaatatagaaagaaaaaaataacaaaataaagaaaaaaacgaaaacccacatgaca

SEQ ID NO: 616233 - DNA, 292 bp, Homo sapiens
gggcgtggaacgcatgatcctccaacagctgtgtgcacggcagacctgggtccggtggtggtgacggttatttgtctcacaaagcaaggacacaaaaaaaacacaaagtcaccattaggcaaataccaataactgctgattcgtcgacggaaactaacgttagtgggttcttgagaggatattctcatggtgtccccgcaagatactcattacaccaaagaaaacagtaactctacagggaagagacctggtagacaccacctacatcctggagcagcaggcaaagacagga

SEQ ID NO: 616234 - DNA, 534 bp, Homo sapiens
acgcgcactagttcaaagttagaacgggaagaatgggtggcaaggtggctcctggacaagctcacccagcacatgttgccctgaagctcggggccttggtttctgtccctggcgatatctatatttaataaatttttatataactacacagagaaatagaaaatataaaatctgaggggtcggggaagaaacgtgaggaactcaagcaggaagccagagctgacgaggtacattcaggccaaattgacctcctccttgacccctttggcttctggcttctcctcctttggttctctcctcttcggtgacttctttcttctcctctgggccttacgcttttacatcctctgtttggactctcctggcttttttgaagttggaagagtttcttgcggcccccctctccctcctcttcaggatcggagaactcttcctcacaggcaattcgtttgtcagaggagccgatcgagatgcgctatccagggtcagtctacgtcctcatcgccaatctcctcaaggattgcgtactcagga

SEQ ID NO: 616235 - DNA, 747 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616236 - DNA, 801 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616237 - DNA, 154 bp, Homo sapiens
  misc_feature (120)..(120): n is a, c, g, or t
aatagccatgactctcaagatgtatgctgttttgactggggtatgatgggtccaccccttttcgtgttgttcgggctgtctgtttcagttcaggagtgctaggtatagtccttcccaagnctggtctccttccagcttttgatataggatgtga

SEQ ID NO: 616238 - DNA, 211 bp, Homo sapiens
  misc_feature (15)..(15): n is a, c, g, or t
  misc_feature (41)..(41): n is a, c, g, or t
  misc_feature (50)..(50): n is a, c, g, or t
  misc_feature (173)..(173): n is a, c, g, or t
  misc_feature (193)..(193): n is a, c, g, or t
  misc_feature (208)..(208): n is a, c, g, or t
ggagtggctggcggnggggcctgggtgtccgcccagtgccngaggacgcnggctttggcaccgaagcccggcatcagaggcaaccccgcggcttctgccaacggtcggggccctcggggaccagcccttcgtggggttgctgccaaaaaacctcagtcgggaggagctggttnatgcgctgcgggcagccgtngtggtccggaaaggncct

SEQ ID NO: 616239 - DNA, 190 bp, Homo sapiens
  misc_feature (174)..(174): n is a, c, g, or t
aacaaccgtgacaaatgctttctgataacgcaattgaaggcggcatgctagagacagcacaaaaaaccaatgttctgttaggtgatctcggtgcaatgcagggtgcgatgctaatgacgatgaaagccaacaccgaggtgacatctgccaaccaggttttgaaaaataatgaanatgcttccaagtctga

SEQ ID NO: 616240 - DNA, 184 bp, Homo sapiens
taccggaccatcagtgcgggagcacacaccggctagccatttctattgggttgtctttctactgttgaattataagagttccttatatattctggatataaattcctttatcagatacatggtttgcaaatattttcttccattttatttctttcaattctgtgggttgttttttcactctctt

SEQ ID NO: 616241 - DNA, 669 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaacttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616242 - DNA, 857 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaactccgagcgctttttggcgggccgcaaaaagggttcggaaggcccggggcagtgtccgggcccttttgtaagggaaatcccggcccaaagggggtaattaaaccggacgg

SEQ ID NO: 616243 - DNA, 1286 bp, Homo sapiens
  misc_feature (1196)..(1196): n is a, c, g, or t
  misc_feature (1225)..(1225): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaaaggtgttgtgtggggcagccttgggctcctgagggtgaccagttagggtggattggtngcccaggtgggtgcgttctggttgggccncccgggaatccctttccaaattgggcggtttagaaaacccattccatttgggcagggcccg

SEQ ID NO: 616244 - DNA, 937 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggtgagggccggagggcaggggctaggcaggcgcggacgctccgtcccgacctcacgcgtgacactgtgagggccagacgccagcccccgcgccgccccctgtgcctttgaggttgggcccgttctcagactccatctccggccgggccgcgcgccccgcgccctcgtgggctggtgtctcgcagctggaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616245 - DNA, 1289 bp, Homo sapiens
  misc_feature (1143)..(1143): n is a, c, g, or t
  misc_feature (1179)..(1179): n is a, c, g, or t
  misc_feature (1186)..(1186): n is a, c, g, or t
  misc_feature (1199)..(1199): n is a, c, g, or t
  misc_feature (1203)..(1203): n is a, c, g, or t
  misc_feature (1206)..(1207): n is a, c, g, or t
  misc_feature (1219)..(1219): n is a, c, g, or t
  misc_feature (1228)..(1228): n is a, c, g, or t
  misc_feature (1236)..(1236): n is a, c, g, or t
  misc_feature (1238)..(1238): n is a, c, g, or t
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcggataccactagctccaagatgccaagaaacagctgctgngtgggggaggcattggcctctgcggatgaacagttnggctggnttgtcccccaggngggntgnngtgggtgggacncccgggaanctctccananattgacagaatcaagagagactatcacagtgggacgaggtaatggcagcaa

SEQ ID NO: 616246 - DNA, 991 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggtgagggccggagggcaggggctaggcaggcgcggacgctccgtcccgacctcacgcgtgacactgtgagggccagacgccagcccccgcgccgccccctgtgcctttgaggttgggcccgttctcagactccatctccggccgggccgcgcgccccgcgccctcgtgggctggtgtctcgcagctggaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616247 - DNA, 432 bp, Homo sapiens
  misc_feature (393)..(393): n is a, c, g, or t
gagcccagaccctctcctaagagcccccaccaaaatcctctctaggggcaggggatagagcaagacatgtcccccacccagagcaggggctgcggtcagggagctcaggggactcagccactccatggcagagcctgtttaatacaacttgtgtctgggatggcctggatcagagaccctatctaaggagcatgttcagaaaccatgttgctgggatcagacagcagggtccaactgcaggcctgtggtgcaggagctgtgtgaccatggggctgtcaccagggcctctctgtgctgggttcctccagtatagaggagaggcagtatagaggagagggccgcgtcctcacagtgcattcttgtgttccagcatccccgaccagccccaaggtntttcccgttgagcctttgcagcacccagccagatgggga

SEQ ID NO: 616248 - DNA, 1121 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggtgagggccggagggcaggggctaggcaggcgcggacgctccgtcccgacctcacgcgtgacactgtgagggccagacgccagcccccgcgccgccccctgtgcctttgaggttgggcccgttctcagactccatctccggccgggccgcgcgccccgcgccctcgtgggctggtgtctcgcagctggaggagctggtgagcaggctgctgcacctgcacttcaaggatgacaagaccaaagtgagcggggacgcgctgcagctcatggtggagttgctgaaggtcttcgttgtgggtgagcccaggcccacgctccctccgggcacagcatccggaattttgcgtttttccagcgggaaaaccaagacgtgttttcccgtttcccacaagggcctaaacttgggtctcctgagcctgtttgtcagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616249 - DNA, 931 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtgggtgagcccaggcccacgctccctccgggcacagcatccggaattttgcgtttttccagcgggaaaaccaagacgtgttttcccgtttcccacaagggcctaaacttgggtctcctgagcctgtttgtcagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616250 - DNA, 324 bp, Homo sapiens
  misc_feature (15)..(16): n is a, c, g, or t
  misc_feature (72)..(72): n is a, c, g, or t
  misc_feature (88)..(88): n is a, c, g, or t
  misc_feature (95)..(95): n is a, c, g, or t
  misc_feature (121)..(121): n is a, c, g, or t
  misc_feature (140)..(140): n is a, c, g, or t
  misc_feature (151)..(151): n is a, c, g, or t
  misc_feature (154)..(154): n is a, c, g, or t
  misc_feature (162)..(162): n is a, c, g, or t
  misc_feature (167)..(167): n is a, c, g, or t
  misc_feature (173)..(173): n is a, c, g, or t
  misc_feature (179)..(179): n is a, c, g, or t
  misc_feature (200)..(200): n is a, c, g, or t
  misc_feature (243)..(243): n is a, c, g, or t
  misc_feature (265)..(268): n is a, c, g, or t
  misc_feature (277)..(277): n is a, c, g, or t
  misc_feature (314)..(314): n is a, c, g, or t
  misc_feature (318)..(318): n is a, c, g, or t
  misc_feature (322)..(322): n is a, c, g, or t
gaacttcaggcacanngtgctgatgagttattaaagcgggtgtacgggagtttctccgtaaatccagaatcngatacaatgtctcttngctatangaccttgaaaatcttccggcatccanggattccattgtgcatcangctggcatgtngangcgaaatngtttngcctcngtcttngaaaaatacttccaattccangacgcgggcaaggaaggagagaacagggcagttatccattatngggatgatgagaccatgtatgnnnngtctaaaanggacagagtcacagtagtcttcagcacagtgtttacngatnacgncg

SEQ ID NO: 616251 - DNA, 401 bp, Homo sapiens
atcatttaatgtgggaaaggataatcttttcaacaaatggtgctgagaaaactggatatccacaggcaaaagaatggagttggatccttaccttataccatatacaaaaattaactcaaaatagatcaaagagggccaggcgtggtgtaatcccagcactttgggaggccaaggtaggaggagtgctcgagcccaggagttcaagaccagcctgggcaacatagggaaaccctgtctctacaacaagtaaccaaaattagctgggcacagtggcacacgcctgtggtcccagctactagggaggctgaggcgggcagatcacttgagcccaggaggccaaggcacagtgagccatgactataccaccacactgcagctggcatcagaagtcttgtgtcaaa

SEQ ID NO: 616252 - DNA, 1225 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaaaggtgcgggtgggggtgcgggcgggaggtgggtccccgtgtctgtcctcagggaccctttcctgcaactctgcagggccaaggcctcgggagggcgggggtatgtctggagcacccagccagagcggtgggtgagggtcccgcataacctccccctgccttgcagtgagcggggacgcgctgcagctcatggtggagttgctgaaggtcttcgttgtgggtgagcccaggcccacgctccctccgggcacagcatccggaattttgcgtttttccagcgggaaaaccaagacgtgttttcccgtttcccacaagggcctaaacttgggtctcctgagcctgtttgtcacaggtgctgtggcctggttctgggggctgcccgtgggtgttggggggggcaccggcccaggctgaggccctcactgggctcgggtttaagatccccccagcatcccccacctctcgcgtttctcaccgcagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616253 - DNA, 206 bp, Homo sapiens
ggatactggtcatgttccggcacttgtgtgcacaggccttgagcaccagtttgctggctaagtagaaaagggcgacaacctggccccagttgaatgttgcctgtcaagaaaacatgtcagctagccactctggacaaaagacctctacgggagggagtctagtgtccactggctggcaagtcatcctactgcatgcatccatgtta

SEQ ID NO: 616254 - DNA, 662 bp, Homo sapiens
attaggcgcgttctgcgtggacgtggaccagctggagaaggtgcctccgcagctggtgcgtgagcgtgggtcggggcgcaagtgggggtgcccggctggctggccctaagtgcttctcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 616255 - DNA, 568 bp, Homo sapiens
agttcgacggagactctacttttgcccattaaaataaaaaaaaacaaaacaaaaccagaggccgggcacggtggctcgcacctgtaatcccagcactttggaaggccgaggcgggtggatcacctgaggtctgggaattcaagaccagcctggccaacatggtgaaacccatctctacggaaaatacaaaaaattagccgggcatgctcgtgggtgccggtaatcccagctacttgggaggctgagggaggagaatcacttgaacctggagggcagaggttgcagtgagttgagatctcaccattgcattccagccggggcaacaagagcgaaactccacctcataaaaaataaggtatcttaaaagattctagcgccgtgcaaaggagaaaaaaatacttcatggctaagaacggatctgcagctgtggtcatatagggggtgcttgggggaatgggtcgggtaagaaattttcttctacaagctaaaatgaggtgtggggtccacttctctgtcatctttttcccctccacatccttccctagttgggcccccggggattagagga

SEQ ID NO: 616256 - DNA, 272 bp, Homo sapiens
acaaatctaattattattaacatttcatacacttatgaaatataaaccgctttaactatcctgcacgccataatcctattactaatagccctccaatccatacaaattctttacataacagactaggttaaaaatccctcccttactatctaatcaattggcttcccacggtactgaacctactagtacagcgactacgggggactcatgttcaactcctacattcttgccccattattcatagaaccaggcgaactgcaactccttgacgt

SEQ ID NO: 616257 - DNA, 285 bp, Homo sapiens
ccgatttagactaacacacaggaaaacactatggatatgttaaaaatgctcatcgatgggccattaccttaaagagccaaaaaataaaaaacaaacaaaaaaaaaaaattaccaggccagattttattcccggtggaatatttacaccttggaacagcaaacctgtgctcacgataaagtatgaaaacagatacaataaaccatgtgctgtgaaacaatgaccagagatatgccccggctagttactaggttctaccggggtttaggctctaccgtgggcgggat

SEQ ID NO: 616258 - DNA, 714 bp, Homo sapiens
  misc_feature (12)..(12): n is a, c, g, or t
  misc_feature (15)..(15): n is a, c, g, or t
  misc_feature (23)..(23): n is a, c, g, or t
tcttttggtccnccncgagttanttatatcgtcgatccaggcgcgtcgagattataaggagcgcgcagcggcatctataagagaaaagacgtgcctgtgccatcaataaggtgttgatgcggcaggtggtgcctgacagaggtgtgtagacccaatgaaatctgaacctccaccccagagatgccaccgtgtgcagaacgagtgcaatgatggcccccagcagcaaacagtgagtgcctgatggaggagggacgagcgtgggctatgaacattcctcatacggagcgacgaggaggtcatgaacacatgaggcgtggagagtgtggacgtggtggctatgaccatggtggaccgaggtgacggcacgcgacagcagcgaacactaagacatcaacggaagcgctggcacaagatgagagcggagatggctgggacaggagcgtggcatacccaaagcactggtggtataatcgggagaattcaaggtttatccacgccccagggtgcgcctaatcatggatgcgacccaacaagccaagtgggatagggacctaatcaaagggaccggaccgcttactggcatggacctacccaaaaacgatcctatccttcaatataccagggaaggctgtgactacccagggctggcgggactaaacaagacaggaaaccaaaatagcatacccaagaatggatggataaaccattggagaa

SEQ ID NO: 616259 - DNA, 1819 bp, Homo sapiens
gcccacctgcctggtggctccctcccctcccccatccgcatacctcctcctcctgtccccatctatcctctctgtccctacaccaagaccatcccctcatttgccatcatcccacataccactcgactggacatgatccatgcatccacactatctacccaatcctacacaataaaaaagaaaaacaagaaaaaaaacagaaaaacgagcgagcagagagaagagcagcagagaagcgcgacgcggacgacccacagacagaacaacaagagacggaggcgacgagcgaagacgagacgggagaagagagagaaggggagagagcaaaccgaaaaaacaaagacagacaccccacacacacacagaagagagaaaaagagaaagaacgacaaagcagaggagcggaagagccacaccggacggagaccagacgcagagaaggacgaagccaggacacgcgacacgagccgaccgacgagcaagcagaggcgacggaagagacagagagaaccgacgcagggagggaggcagaccgagagcagggagcagaacgagccgagcgagccgaccgcggaggacggcggcgagagcgggagaggcgggagaggcgaggagcgacacccggcagcgcgagagcaagaagagaggcgccgacagagacggcgagtgcagcacacgcagcggacggacggacgacgagaggagagagggggagcacgacggaacaggagaccgaggagcgcgggcgaggaggagaggcgaagacagaagaagaagcggtgcgacgagccggggagggcgagagaggagggagaggcgcgcagacagcgagcgcggaccgccgcgaaggggaggaccgcgaggggaagaggagggcgcggagcgagcgagacaggcggagagagcgagggcgagagcacgggagcaggaggcgaggcgagagaggagggcagcaggagcagaggaagggggaaggcgagagaaggaggggacagaaaggagaggggagagagagggacgcacagagggaacagagagcaagcgcggcggaggccgcgagggcgagaggagcgagcgggggcgagcgccgagcagcccgcaggagcggacggcggcggcgagagggcaggcgcgggagaggcgagcgcgcggcgcaggggcaggcgggggagaagcaagagcgcggcgaagggggagccgccagagaggcgcgggcagggcggagcgcggggcgaaaggcggccgagccgccgaagcgagagcgcaaagcagcgcgcagggcgcgggagagcgccaaggggagcgcaggggcgccagagggaggggcggcacgacacagcgacgcagcgcacagcgcgaagcgcccgggcagagacccgaaggcgagcccagccgccacacgagagcacgacagaagcagaccaacgcggcacagcgaggacgacgcgcggacgccgccgcgagcagacagaccagcccagcacgcgagcacacggagaggccgagccacagagcccgacacgacacagcacgccctccgggggccccttgccacagacgacacgcagacagaggcgcaaacggccgagacccgacctgcccagccgaccacggaagcacgacagaggagcgctagacgagacgcggcccgcacacgcagaagccgaggatcgcaagcacggaagcaggctgagagcctccgagcccacgcccgcccagcaccggccgcacgcacagagtcgcagcgaacctgcccacccggacgcgcagacacaagagaacgcagagaagacaagggagcagacccagagaaagcgcg

SEQ ID NO: 616260 - DNA, 1261 bp, Homo sapiens
  misc_feature (393)..(393): n is a, c, g, or t
tctcatttaactttttaaagggggtcctcaaaattcctgtggtgacaaattttgtgggctcaagttgggttctccatgtaaaagagttagcgtgattttataaacaacttaattacacgtataaaagcgtgcacacagcgccaaaaagagaaacaccaagaggtggctccaacaaaagatttcctcctgtactccttcttgtggagagggttatcacgaggacgtcgcgtgtgggtatttctagtatacaccagagtgtctttatatactatactataacacttatagcatgtggcgcaaaatgtgtggagacaccaaagacagagttgtctgtgagagacaccgggtgttctgttcgcacacacacagcgtgttataacagagagagtgcgncggtgtgcgcagagagttatatcagagcggactatacatatatatctcatatatgaagacgcctctctctgtgagaggctatatacactgtggggggacagcagaaactgtgtgtgtgtcgacacctgtgtgggccagaagcctctctcaggagacagaggcgctctctctgtgtgggtcccaccagcgtgggctctgtgtgagaaggaggacacacaacccgccacacggcgggaaaaagtgggggtgctgtgggtccactccaaattcactcctgcagcggaaacagcagagcccaaaagaggggagaaaacccccaaaaagagggggggggacaataagactctgtgggaagaaagaagctctcctctcaaagaccacacaccaccgagggggggtcttgtgcgccccgagtgagaaacgccatatttattctaacacgaaaaggggggcccagtcattattcacaccccgaagacagtgtctccagagaaaatatctacgaggggcgccgccaactctgtatcccgaagactatattttatcatcaccccgacaaaaaggggggcgacaactacaaactccttatatcccctctagatcaagcctttccacaagccacaacactactcgtgccaatacgacaacatgtggtagaaccgcgccggatggtcggcgcggcaacacccccccacatctcacacaaggggggggcaaataacgccccggcgggcggcaaaaaaatatgcgggcgcagcgggaatgtgggtacccacggagaatagaactcacccctagaagcacatggttagaaaccgcccaggcgggctcccccaacgggggggggggcaccaacacgtgggcaggg

SEQ ID NO: 616261 - DNA, 140 bp, Homo sapiens
aggaactgggaagaggggatcactactggtcaaaggagggggcagaaaacatatgggaaaaggctaagtatatgcgaggagaggaagttttgacagcagcatggaatacctgagaagggcaagcaacaggccaggaagct

SEQ ID NO: 616262 - DNA, 148 bp, Homo sapiens
  misc_feature (45)..(45): n is a, c, g, or t
  misc_feature (69)..(69): n is a, c, g, or t
gtaagaacttttggtatggatatagaaaagtttgccatctgtagnggggaaaacagtatatcacattgnggtagagtggacgggactcatgtaaggactcaatttggggaagagcattcagtggcatgctgttaggaggactaggtgt

SEQ ID NO: 616263 - DNA, 154 bp, Homo sapiens
agactctgtgctcagtgatctcccaccttgtagtttggatacagctcacatgaaccttgctaaaattttttttttgttgagacggattctctatggtggccaggctggtctcaggctcctgggctcagatggtcctcctgcctcagttccaaag

SEQ ID NO: 616264 - DNA, 193 bp, Homo sapiens
aaggtgaatagattatatccaccaacactcatcttaaccagattcagaaatatcaccatgcttttttgtgtcatcccctctaaacaacaagagtaaagactgtgttgtcttcccaacaaaagcctatattatttaagtaatagtgattgtcctttaaaaaaaatataaattttttcataagtccttactgaag

SEQ ID NO: 616265 - DNA, 144 bp, Homo sapiens
  misc_feature (58)..(58): n is a, c, g, or t
tcaagagggaagcaattaataaaggtgggtggcaggaggggaacagggtgccacctgnctggacaatccacacgaaaggcaggcgggctgtgtactggggccctgactgtgcgtccactgcttgtcttccccacctcaccaggc

SEQ ID NO: 616266 - DNA, 427 bp, Homo sapiens
aacacttccatattgcattctcaaggagctaaagttacggttctgcatctctgacagaccatggttatgatgaatctcgtttcttcactgcctcttgtaatctttcaagaaaatgtgcacagggtctacctgctacccttgcgtgatatgtaaataggattgtactggaaccccttcctctggaattgtggcccatgcacatttagcagccagtgcacactgcttattagcagcgtctgggattgccatttgatgttccaggtctgaataagggccattactccatcagcatatcctctgtagtgttctatgtccagtagcatgattctgtctagcctggtctgcacacatttcttcccaatttaaattccgtgttaggtatgcgctagcagacaaacaaatctgagccaaatgctttacatcaaag

SEQ ID NO: 616267 - DNA, 263 bp, Homo sapiens
  misc_feature (84)..(84): n is a, c, g, or t
ttcggcacgagggtctcactctgtcgcccaggctggagttcagtggcaccatctcggctccctgcaaactccacctccacctcncaggttccggtgattctcctgcctcagccccccaagtaactaggattacaagcgtgcgccaccacacctggctaatttttgcatttttagtagagaaggggcttcaccgtttggcctgctgggcttggctcggcgcccccacccctggctaccttgtgggaataaacagacaaattaga

SEQ ID NO: 616268 - DNA, 875 bp, Homo sapiens
  misc_feature (46)..(46): n is a, c, g, or t
  misc_feature (69)..(69): n is a, c, g, or t
  misc_feature (76)..(77): n is a, c, g, or t
  misc_feature (79)..(79): n is a, c, g, or t
  misc_feature (102)..(102): n is a, c, g, or t
  misc_feature (117)..(117): n is a, c, g, or t
  misc_feature (119)..(119): n is a, c, g, or t
  misc_feature (125)..(125): n is a, c, g, or t
  misc_feature (153)..(154): n is a, c, g, or t
  misc_feature (159)..(159): n is a, c, g, or t
  misc_feature (196)..(196): n is a, c, g, or t
  misc_feature (209)..(209): n is a, c, g, or t
  misc_feature (259)..(259): n is a, c, g, or t
  misc_feature (269)..(270): n is a, c, g, or t
  misc_feature (280)..(280): n is a, c, g, or t
  misc_feature (283)..(284): n is a, c, g, or t
  misc_feature (287)..(287): n is a, c, g, or t
  misc_feature (296)..(296): n is a, c, g, or t
  misc_feature (304)..(304): n is a, c, g, or t
  misc_feature (309)..(309): n is a, c, g, or t
  misc_feature (333)..(333): n is a, c, g, or t
  misc_feature (368)..(368): n is a, c, g, or t
  misc_feature (375)..(375): n is a, c, g, or t
  misc_feature (381)..(381): n is a, c, g, or t
  misc_feature (386)..(386): n is a, c, g, or t
  misc_feature (431)..(431): n is a, c, g, or t
  misc_feature (509)..(509): n is a, c, g, or t
  misc_feature (671)..(671): n is a, c, g, or t
  misc_feature (856)..(856): n is a, c, g, or t
ccgcacactcgctgcggcgcttctggctccagaccgccctccggancggacactgcgaatggttttggntatatcnncnagaagggcttcaacaacagagantcaacacagaatcangnacattntgtgtcatggactccggataactcaacnntcagnactttgtgctcagaacaggaacagagacatggatatntcctcttcctcangcgaaatgcccctggtggctgtgtgccaagtaaaaacgaagcaaaaaaanaaaaaaaaannaaaaaaaaangcnnaantggttcganaagatgcnaaaangggtgcatgaatggctttcatgcntgaagcatttgaattcattgcacgggaacatgaanaaaaganaaaaangtctnaacaaaagggtgggaaacttttggaagaataaaacacagattgcnaagaaatgtggactctggctgtccttgggtggtttccatgagcgtggccaagactgggagcagactcagaaaatctanaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaanattggtctagctgtctgctatgacatgcggttccctgaactctctctggcattggctcaagctggagcagagatacttacctatccttcagcttttggatccattacaggcccagcccactgggagcccgtctcctcttgagggtgacgtagggcagcaggtcgtggcgagtgatgatgcgcaanctagcagcacctggcgaaa

SEQ ID NO: 616269 - DNA, 246 bp, Homo sapiens
gagatcttagtcgacttctgctctggcgacttttgctctggtcgacttctgctctgccctttcactcctttcgtccccagtctactactccactccctcattcatggtttgctcatgccctttccctgccccagatgagtgagcgtttgccaggtacattgaccaacagatccagggtgggctgattggtggagccctggagtggaaatgctgggggagctacacgcggggccctggaacccctta

SEQ ID NO: 616270 - DNA, 245 bp, Homo sapiens
cgttaatctagcatattgggaggctgagcaggtggatcacctgaggtcaggagttcgagacaccctggcaacatgtaaacccatctctacaaaaattagctggacatggtagtgagtgctgtaattccagctactctgaaggctgaggtgagagaaatccccttgtgcccaggaggtcgaggctgcagtgagcgatagtcatgccactgcactccagccttggtgatagagcaagaccctgtctc

SEQ ID NO: 616271 - DNA, 331 bp, Homo sapiens
ccaagatagcgccactgccctccagcttgggtgagagtgtgacagtccccctcccccgccaaaaaaaaaaaaagaaaaagggaaaaaaaagttgctcagagaagacttcttggaggagatggctttggagcaaagacctgaattcagtcagggagaaacctaggagtgggggtggtgtaaaggctgggaagggaattcccaggttgggcccgacagtgattgtcagggccggaaaagaggatgacctgtttggttaaaaaacggccaaaagcgcagtgttatacccagcactgtgaggttgattggtttgacttcaggggtcccgagctcg

SEQ ID NO: 616272 - DNA, 905 bp, Homo sapiens
ggcaccatcgtggagggagtgcaagagagagacaggggttgattgactaaagacgaacatggcacttcagagggtacgggaagctgctgaaaaggctaagtgtgaacttctcctcatctgtgcagacctgacatcaattggccctatcttacaatggattcttctggacccaagcaatttgagatatgaagtggagccgtgctcaatttgagagggatgtgtcacctgatctaagtcagaaggactatcgctccatgttcaaaaaagctatgcgaagatgctagaagtcagcaagagtgacataggagaagtgatactatgtgggtggcctgactaggatggcccaaggtttcagtcatgacatgtcacgagtgatctttctaggcagagcctccgaagttagcagcgtgtgcaatcctgatgaggcgtgtgggccattggagctgcaattcagggagggtgtgtcggccggcgagtgtccacggactgtgctgctcggttgatgtcatctccccctgtctctggggtatagagaactctaggaggggtctagaccaaagttagtagtaggaataccagtattccacgtcaagaagagccaggtattctctatttgccggtgatggtccaagcgcaaggtggaagtgaagtgtgtcacgggtgacaccagcagatggtggagacagcaaaccccttggcacggtttactccgctgggattcactagccctcgggagtccctcagatgaggtacttcgacattgtgcagggtggcctgtttggaaacaaaggccagcgggcgcaatggacccgccgggggtaccaatgttgtaaatgggaaggcgaatcggaacggcaaccgtgacagtcgggcaccaccacaatgcagccttggcggaaaaggct

SEQ ID NO: 616273 - DNA, 899 bp, Homo sapiens
ggattctgttactctgacactatctgagcacggtccctcacacgtcatgcaggctgcaccctgaccgctacagctgacgagccgagaaggttcacagaggtcgtttgtctgcaagccaatctggaaagtgccggacttcgagctacaggctccccctccatggacctccatgggtcagattatgtgaaatgaaccgtagtacaggtcatggaatgccgctggcctatggcagagccctcgaccattctgcatacgctgaatggctgtcccacatgggaacagggccaggaccgagggatccctccgaggatcacccacagcagtggtacggcagcacagacacggacaggatgccctgtgaagctctatcttgcactggtggtaattaccaggatgacccaggagaggcctaggaaagagtcgttcaaacggcatgggcagccagcccgtagcctgtcaggaaaaatcagttgctccgccgtctgacaaaggtggataggtgagctcgggttgccctgcggctttgatggatgtggaggatgagttcgataacgggaagaggtcatcctgtcgccagtcccatcagtgctcaagtcgcagacagcatcgaaaaccaattgacctctcagtgagcaaaggacatataaagacccttctgtatgggtccaggtttaggtgtttcaatgaagaatggaaacttcagagtttttcctttagtaacacagcatcatgaaaatacggcatagtgcagaacaagggtggtccttgagagagtctctggcagctgtcaccaaggcatgtgtcctaacagaaaactcctgtttgaacggagagtagcaaattacgatctgtgctcagcccggttaacagcttgtaccgagtcaccctcagagctatac

SEQ ID NO: 616274 - DNA, 143 bp, Homo sapiens
ggagtggtggggcacgcctgttgttgcagctactcatgaggttgagctgggagtatcgcttaagcatgggaggtcaaagctgcaatgagctgtgattgagctactgcactccagcttgggtaacagagcaagatcctgcctcg

SEQ ID NO: 616275 - DNA, 129 bp, Homo sapiens
tcggtacctttgagccttcagtagaagcatgtctcagggatagcaggttagttttaggttgagggtatagatagtgtctaataaaaaatagttcattttaatacatttgtcaagcacttactatttgcc

SEQ ID NO: 616276 - DNA, 322 bp, Homo sapiens
ctactactactaaattcgcgggcggtcgacgtcgagcggacacatgacctatgtgtggaggaggatcagaaggtgaagtatgggcagggcgcggtggctcatgcctttaatcccagaggccgaggctggtggatcacttgaggtcaggagtttgagaccagcctgggcaaaatggcgaaatcctgtctccactaaaaatacaaaaattagctgggcgtggtggcgggcgcctgcaatcccagctactcaggaggccgaggcagagaattgcttgaacctgggaggtggaggttgcaggccaagatcgcgccactgcactcca

SEQ ID NO: 616277 - DNA, 520 bp, Homo sapiens
  misc_feature (27)..(27): n is a, c, g, or t
  misc_feature (55)..(55): n is a, c, g, or t
ctgggacagcacattccagggccgctngctacagctcggcccttcccacgagggngatgtctcatagccgctcgggttgcatgagattggccttccggaccaggccccagtggagaggagaatgttgtgttctccgccactggcatgtatgtgtgccttcgaggtgtccgactctgctcagcttagtgattgcaattgttacaagcaagcatgtaccagctgcgtcagaaaaaaagtcacagtgtgtgccccaaatagttaaaaccaacggctgggcgcggtgactcaccctgtatctcagcactttgggaggctgaggtggcgcatcacctgaggtcaagagttcgagaccagcctagccaacatggtgaaaccccatctctactaaaaatacaaaaattaggccgggcacggtcactcacgcctgtaatcccagcactttgggaggccaaggcaggcggatcacgaggtcaggaattcgagaccagcctggccaacacagtgaaaccccttctgtact

SEQ ID NO: 616278 - DNA, 374 bp, Homo sapiens
cgtcgacctataaagcaaccacacaaacaagccaacataataaccagccaacagcacaatgacaagatcaaatctacacaaatcaatactaaccttgaaagtaaatggacaaatgccccacttaaaaggcagagtggcaagctagattaaaaaaaaaaagcgagacccaatggtatgtcgtcttcaagagacccatctcacacataatgacactcatcgtctcaaactaaaaggatggaggaaaatctaccagacaaatagaaaacagaaaaaaagcagaggttgcaatcctaatttcagacaaaacagatttcaaatgaacaataatttttcaaaaagacgagggggcagggactgcttcagtttctgtcgac

SEQ ID NO: 616279 - DNA, 419 bp, Homo sapiens
acatggaccctcctaggcatgggactgcctggcatgcagccttatattattctgttttcatactgctataaggaactgcccgagactgggtaatttataaaggaaagaggtttaattgactcacagttcagcatggctggggaagtctcaggaaacttacagtcatggtggaaggcgaaggggaagcaaggcaccttcttcacaacgcagcaagaagaagtgccaagccaaaggggaagagccccttataaaactgtcagatttcatgagaactcactctctatcatgagaatagcatggaagagactgcacccatgattcaattacctgcacctggtctctcccttgacatgtggggactgcaattcaagatgagatttgggtggggacacaaagcctaattataccattctgctcct

SEQ ID NO: 616280 - DNA, 239 bp, Homo sapiens
ctgtgttgtccacagtcgtatggctgggggaacgtggttcttgggttcatctgcgtcagctcatgggaagcgtctctcagttgattatggcgagaagtccactgctggagttctccatttacccggggccccaggttgccacaggtgtagtggagcccgacaattccttcgtcagcacccataccaccctgggcgcactctgatttgtgccgtcatggtagacaatgaggccatctatg

SEQ ID NO: 616281 - DNA, 616 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (28)..(28): n is a, c, g, or t
  misc_feature (31)..(31): n is a, c, g, or t
  misc_feature (37)..(37): n is a, c, g, or t
  misc_feature (166)..(166): n is a, c, g, or t
ggnggggngntgagttactgactgaccnggncctggnttggttttcttatccgtgagacagagtctcactctgtcgggagtgcactggtatcatctccactaactgctacctgtgccgtgggggttgaagcaattctcctgcctcagactactgagttggtcgggncagggatcatgaccacacccgggtaatttttggatttttaacaagacggggttttgccatgttggccaggctggccttgaactcctgacctcaggtgatcacccaccttagcctcccaaagtgctgtgattacaggcatgagccactgtgcccagccccttaggaatttctaaaagtttctcatattaccctagaaataattcaatgacttattttaactgtgtatgtgattttatcaatacttctagaactaacaaaactattgtatcacaatgttttttatgaaaaattataaataaataatctaccttcccaacaacaggggaggagttaaataatttacaatgctttagacaagaaattctaaaacacttgggtctcaggggccttttaactttttaaaattattaaggttccggagaattttggttaattgggttatatggatac

SEQ ID NO: 616282 - DNA, 490 bp, Homo sapiens
aattcggcacgaggaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttcaaagggacagaaattgtgcacttgaggagctcagattttaaggctgtagcttgccgatgctcccagctgaataaagcccttccttcta

SEQ ID NO: 616283 - DNA, 236 bp, Homo sapiens
ggctgactacaggatcttgcgagttatgcgggagtactactcgattgtcaccgtcaaggagtcacaggtcgcctggttctaggaataagtgggggaagatatgtaggagtagaagattaggccgccgatagtcggtgtactcgtatgttcataaccattggtggccaactgatgtgatgcgtaagggagggatcgtagagctcggctgttatgtcacggctgcgtagtgatggaag

SEQ ID NO: 616284 - DNA, 1123 bp, Homo sapiens
acccacgcgtccggacaccacccccccgccccaccaccatggaagagaaaccatgggctgaggtttctcttccaaagcatcctgatttctcaaatctcttgccatcccatcgaccacccccatgaccacagccgtttgatgttatgtaaccatcaatgtcgaaaactggaacttctgggaagtccaccgtctgcagcagcatgtgtggtggctaaaagcatggcattacaggagagcaacagaacatgcccatgtaatcattggcaaggcagcctagatagacttcactgatccttgatcaaagtcaccggacatcttcagagcctcatttcctcaattacgtaaacaacatacgaaactaggagcaggcgcacgtaggactccacgacctggtaaatcccagcacttaatagacgaggccaacagatggcgaggacatagcattgaagccacaggagatatcaagaccatagcctgaggcaacatagtgggaccctgacctcatacaacaaaatacaaaagccaggatatggaaggagagatagacctggtagtaccccaagtactcgggaaacatgaagcaaagaaggatccactatgaagcactggagaagggtcgacggcatgcagatgcaaggcgtgggtcagagacaactttcaactcacagacatacgcgcaacaaacaccaaggacacatggaactcaaaaatacaaataatcgaacataataccaacagaaagaacaaacagcaacaacaacacaaaaacgcaacacagcgaagaaaaaggcagggcgaaaagagagaacggaaaggagaaaacaggacaagaagagaagaaaagaaagaaagagaagaagagaaagaggaggaggaggaggagagagagaagagaaaagagaggagcaaggagacgagaagaagaaagaaaaaggcgagacagaagaggacgaaggaaaggaagagagagcagaaaaaggagagagagaagagaggagagaaaggagagagaagagacgaagagaaaaaaagaaaggaaagaggagcaagcgcgagaggaagaggaaagaaagacaggaggacggagaggagagacagaaggggagacgaagcagaagagaag

SEQ ID NO: 616285 - DNA, 332 bp, Homo sapiens
aattcggcacgaggcgaggacggacaggaccgcacagcaagcacctgtacacgggccgacatgttcacgcacgggatccagagccgccggcacttcgtcatgttcttcgcgccctggtgtagacactgccagcggctgcagccacctttggatgacctgggagacaaatacacagcatggagatgccaaagtctatgtggctaaagtggactgcacggccactccgacgtgtgctcgccaggggtccgagatacccaccttaaggcttttcagccaggcaagagctgttaagtacaggtctcggcttccagcattggaaactggatgctgca

SEQ ID NO: 616286 - DNA, 534 bp, Homo sapiens
  misc_feature (534)..(534): n is a, c, g, or t
ggaggacacatcatgtggctgaacattgtcaaaggcagcatcccagtcggctctcgagtcttggtgaaaccatccctgagctcatacagggagattgatagaacatgattcttattaccatactctttctctgatgcaggctgagactaagtgtaacccatggatcacagtccgaggcaaacgaatgcactgtccaggattcatttaaaggtgtggatgctgctctgacgagacataactggctagaccaaagtgacagccagtttgtattgcaccgcataactgaagccactaagacggttgcatctgacacgatacattccttcatgtacgaaatcaaggagggtgactgtgctgaacggggtgaagactctcgggactgacatgcaccgatgctgtagaagcactcactgtagaatgcacagcatccgaggagaagaggagctgtactgagacatgccacaacgagagcctcgaatgtgtggcatccctatcctcagagcccagacctggagcccatatttagacacggtn

SEQ ID NO: 616287 - DNA, 117 bp, Homo sapiens
ttactcttgagatccccgcgtggagcctctctcaaaaacagataaagtggacagaaaataggtggtaaggactaatcatttaagggacaatgcccccagaagagtggctactagagt

SEQ ID NO: 616288 - DNA, 1317 bp, Homo sapiens
  misc_feature (56)..(56): n is a, c, g, or t
  misc_feature (73)..(73): n is a, c, g, or t
  misc_feature (253)..(253): n is a, c, g, or t
  misc_feature (414)..(414): n is a, c, g, or t
  misc_feature (625)..(625): n is a, c, g, or t
  misc_feature (675)..(675): n is a, c, g, or t
  misc_feature (740)..(740): n is a, c, g, or t
  misc_feature (812)..(812): n is a, c, g, or t
  misc_feature (887)..(887): n is a, c, g, or t
  misc_feature (893)..(893): n is a, c, g, or t
aacaatcagccatcgccatactgggtgagctcaccctttatactcaaatgttcccnttaatagtctccttccntgaaataaatacttaagggatttcaccagtctctggaggaccactttgaccctttgtaagttaaggtttcctcacccacctgccgaccagtttctcatgtgttcctataattggtcaacggagacttaatcctgaccaatgtttggacaacaagattccaaactatatctggctttaacnccagtttataccagtgtatgctctagacttggaagatgtagaagtttggatgtggattacctatacttatgtttcgtgatgaatccattgttcgcttctcattataagctaattcatccttttgtgaattcttcatagatagtatatataaaagtacattntaatagaaagccaggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaanaaccaaaccactgggaaataatcaattggcaaaaggggtgaacaaattcnataactgggaaagcaaagagaagaacaaggttttgatttgggatggataaagcattggttttaantgggtggaaaacttcacagatcactaatggtttctagaggttaccttcaagtggggcaacgctgggggtttnaaggtagtcagtgggcctagttcctaaagccacagtatagggagtctggttaacctggaattggtctggttgcgnaagttnggtttaacgctggctgggagggctcccttttaaggacaaaactggtgttggtggattaagtggtttggaggggaacctggaagaacctgattgtagccccggtggcagataactggctgatttctcaggatattatttctctggggaaacatttctacattagcaagaggagttaagagtggattatctttttcgaccttaattccagagattatttctgtagtgagaattctggaacctattatgttagggacaattaaagctgcatggcctgacttggtccaattcaatatgggtgatactaaaatttgttgggcagaatatcttggtaaaccgtttattttaagggcgtttttgttcctttgtagaggcttatacagatagtcaatcttgggaattttattgagaagtggtgtatcgcaat

SEQ ID NO: 616289 - DNA, 309 bp, Homo sapiens
cgtcgacagataagcttgttttttgtaaggagtttgtgtgctgttggaaaacatggaaaatgcatccttaacacctgagcctgtggtcatcttcagtattttctgtcatttgcgatagctttcaaagggcattgtgtatccgtaataatgtccttgaagtcatagactgcaaatgttgatctcttagtcttatatagacaaggaggtcaccccggagtgtacgttgtaatagttgcaactgtatatgttgtacagccaaatatacaaacatccggtctatattctcaaaaatcaaaaaagagtcgatgc

SEQ ID NO: 616290 - DNA, 382 bp, Homo sapiens
  misc_feature (1)..(1): n is a, c, g, or t
  misc_feature (91)..(91): n is a, c, g, or t
  misc_feature (93)..(93): n is a, c, g, or t
  misc_feature (110)..(110): n is a, c, g, or t
  misc_feature (117)..(118): n is a, c, g, or t
  misc_feature (155)..(157): n is a, c, g, or t
  misc_feature (165)..(167): n is a, c, g, or t
  misc_feature (171)..(171): n is a, c, g, or t
  misc_feature (173)..(173): n is a, c, g, or t
  misc_feature (176)..(176): n is a, c, g, or t
  misc_feature (179)..(179): n is a, c, g, or t
  misc_feature (205)..(211): n is a, c, g, or t
  misc_feature (240)..(242): n is a, c, g, or t
  misc_feature (245)..(245): n is a, c, g, or t
  misc_feature (253)..(253): n is a, c, g, or t
  misc_feature (257)..(259): n is a, c, g, or t
  misc_feature (261)..(262): n is a, c, g, or t
  misc_feature (265)..(265): n is a, c, g, or t
  misc_feature (268)..(269): n is a, c, g, or t
  misc_feature (272)..(272): n is a, c, g, or t
  misc_feature (283)..(283): n is a, c, g, or t
  misc_feature (288)..(288): n is a, c, g, or t
  misc_feature (291)..(292): n is a, c, g, or t
  misc_feature (295)..(296): n is a, c, g, or t
  misc_feature (306)..(307): n is a, c, g, or t
  misc_feature (312)..(312): n is a, c, g, or t
  misc_feature (319)..(319): n is a, c, g, or t
  misc_feature (332)..(333): n is a, c, g, or t
  misc_feature (343)..(343): n is a, c, g, or t
  misc_feature (347)..(347): n is a, c, g, or t
naaaaaaaaacatttaaaattataaacacaattcctagctcacaggccataaaaagcaggcagcaggctggatttgatccacaggccatantnggccgtctcttaaacangccttcnnacgtcatgcaaagcctttcccattccacacactttgnnnactcttcnnnttcnanatntcncattttaaaacacacataatacaagnnnnnnntctgggtcaatatactcacgagagagaannnttnagaaaaanaggnnngnncgnacnnaanaggggggaaangcganagnncannggggtcggcnnaaaanatatttnggaaatgtaaaannaaagattaanaatnttattccatgcaacataaaataatatgcataaatc

SEQ ID NO: 616291 - DNA, 316 bp, Homo sapiens
cacgactacggcgactccggaagctgctgggtgcttgggtggtccgtcaggctgcgggaaaagggaccatgtcactctcgccctgtatggctgagcgtctggtggcgaggtgacgcaatgtggctatcccttcccacctgggcagatctccttgaacgctccggtgccatctgttggcccgcgctgacaccgcgcgccccaagccttgccgacactgcagcagcatagctccgcgtgtcaagcggattggtcattgtgtgctggcactggtgctcaggcctcaccaggcagaatcactggctcttctcctccggtc

SEQ ID NO: 616292 - DNA, 160 bp, Homo sapiens
tttgaaaacatagttgctgaggcagctgctggagcagaggggctgggtgtggcacgggtgtgaagaggtggtggatgacagtggtgacctgctgccgatctggctccggtgagctggagtgagtgagctgctccctgtgagtgcccactgctaccaccag

SEQ ID NO: 616293 - DNA, 241 bp, Homo sapiens
  misc_feature (82)..(82): n is a, c, g, or t
  misc_feature (214)..(214): n is a, c, g, or t
cgtcaaatatgtttggatttaaagggctattttatctatgctccaaactttatacgttgtcaaaaattatatatagatagantggagagcaagacttgattttaagctcatctgtcaggagatgctatgctactgttctgatatctctaaatgtcagctgttacaccattgctgatttgttcagggatctctcggcacttgattcctctgttcngcgtgtcgacatgaagagtgttgctgc

SEQ ID NO: 616294 - DNA, 721 bp, Homo sapiens
  misc_feature (26)..(26): n is a, c, g, or t
  misc_feature (87)..(88): n is a, c, g, or t
  misc_feature (90)..(93): n is a, c, g, or t
  misc_feature (212)..(212): n is a, c, g, or t
  misc_feature (326)..(326): n is a, c, g, or t
  misc_feature (400)..(400): n is a, c, g, or t
  misc_feature (446)..(446): n is a, c, g, or t
  misc_feature (449)..(449): n is a, c, g, or t
  misc_feature (470)..(470): n is a, c, g, or t
  misc_feature (560)..(560): n is a, c, g, or t
  misc_feature (599)..(599): n is a, c, g, or t
  misc_feature (606)..(606): n is a, c, g, or t
  misc_feature (622)..(622): n is a, c, g, or t
  misc_feature (627)..(628): n is a, c, g, or t
  misc_feature (634)..(634): n is a, c, g, or t
  misc_feature (682)..(682): n is a, c, g, or t
ggtctctgaaatccattgctgttganctccaactccaggccccatggggttgcaccaagctgctcaacctcacctgtttcttgaaannannnngccttccactaggcagatgggtccagcaggagacattggagcaccaaatggaaaagctcttccttccttcccctcttcctcacgttcccaccaccggtccacgggaatgaggccgtgcntgctcaacacggttgcggtgctatggcagagcgccgacagtcttctctcaatactacatttatatttatgcacattttcaatatctgcagggtcctgtagaatcctacttaggncttccaaaagaagggctgccttatgatagcgataaacaatatcttcggctctgctgaaacatctcatccagggntgcagactgaacatttctacagcacaattatagatgagtttctctncanctcacactgcttgattttatnaataaaaccttctgctttgttagagcaagaatcgcattcagccttttctgctaactgttcttgcacatggctgatgcagaatttatatcnttcgttcagattcttgacaacttgtttcacagctgcggntgggctnagctttccgccattgntctgnnctttgncaagatgcagagaagccgcaagcagctgtgctgctttgcatgtacaanaacagctgctccaaccgcccccagtctttgctcagctga

SEQ ID NO: 616295 - DNA, 641 bp, Homo sapiens
gacataatagacgatagaaagcgcagaaggagcgtggatcggaagagaagggatacgtgtcaggactagaaagaagtcagaaatcttcaaaaggtggtagtagtagagatacagaaaggatcgaaggataagaatgcccggtccgacagaaagaggtctatatcagagagtagtcgatcaggcaaaagatcttcaagaagtgaaagagagcgaaaatcagacgaggatagagacgaaaggcgtgaatggaagaatgccaggcatttcttgagccattgcgtttgcagcagaagatgtgtggataaaaacaggattacctttccttgtaaagaggatgctgccttaagaatagcagtgtcgtaaaaaatcttgatggaaaatacagactgtgtgtttaccagacgattcttgtactttggagcgataatttagtgaagagttatttatcaaagattatgtgagggttccaaatatagtgtaaagaatgataatagataacacaatcagattaacatcccttgtcatcttttccaagatatcctatatctcttcaggtaagaagtcgtgtatattttagtaggcaaatctttaagtcgtgttcccgttctaaggtctgtagtcatacattgctttggcagaaa

SEQ ID NO: 616296 - DNA, 120 bp, Homo sapiens
gaattgatagtaaaggcagatatgttctcatcagtagtaagaatctcaaggttatgcttattccccaatggaggtatgagatataatcttttctgcctttacttatcaattcaccaagga

SEQ ID NO: 616297 - DNA, 225 bp, Homo sapiens
gcgtcgacggagtccctggtctgaagttaaaccctgggaacatgttgatgtttgagggttgtgcagaactggccctacccttgggggggcatcataggagagcctgggggtgtgagagcaggagagttcacccctcacccctatcctcagctagctgcagtacttggaaaaacaggccctaaacatcacctagaaaacaaaaagtaaagtcgtatcggtcgacgc

SEQ ID NO: 616298 - DNA, 392 bp, Homo sapiens
  misc_feature (37)..(37): n is a, c, g, or t
gggggaattttttttcccaggggctccatcccctccnacaaatccccccccacaccaattggtggggtctttttttcccttggttaaacatttaaccccaagccaggccctgttttaacccctcccccctcatgttctttccttttttgcgaggtattttgccttaacccactttggcagtgacaaatggggatttgagggggtcccccccgcccttcagcagggaagacttttgggccctggagggccgtttaaaacatgggcttattaactggctgcctgagccatgaaaaggcccaatttttttgaattttttttgaatccccgtaaaaaaactgattttttttggataaagaaccctaaacggataataaaagttgttccaaatggga

SEQ ID NO: 616299 - DNA, 864 bp, Homo sapiens
agcggaattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactgatttttattcacccttgttttatttttatccagccatactacctttatcacttttttttttttttggggtgcaaacgcttaacatttctgcaaacttttttcccccttgagttatgcattggcatttggtcagtgaagagtaaaaagaagtgtaataaacacatcagtcataatgtaaataccggtttggacccacatgggtgggatacagcagggtaaatccaaggctgggttaaaaatacataattgggaaagtctcctaatatttaaagacctagtagtttacaaggccttttaggaggtggtggtaaagactttgggtccacttttacaaatctagccacgagggggtccataatttatttccccaatttaagtggagtatctcaattggtaaaacaaagaatttctgcccctactacacgggttaactggctagggtaaagaccatgtgtctgaagaccactaaaactgggttgttaccagtgtagatgggtaaagggagatgggactacagtgccacatacctgacaacttgggccacccgagaggtacacattagggaagggcaagaataccaggaaaggggttaaaaatgcaaagcgagaacacagtggaagataccatggaaaaccagaatccagagaggatgggattcccacaaagatcag

SEQ ID NO: 616300 - DNA, 1186 bp, Homo sapiens
gtggtggattgtgttagtgtgttttggtagttgttgtctggtgtatgtgtgtttggtaatttggtttgggttgggtgttgaactatgttgagtgtatggagatgtttttgctctgatgatagattgttatttgtagggtgtatgttctctacatataggctgtgtttgtcatagattagggaattttcgatctatgcgtatgtgtttggtgggtgtatatgttcttttctgatgttgggtgttattcatattatattttgtgtgggtctattatttgtgaatgtggctcgaatttatattatattggtataatggggcttgtgttgggtgtcgtccaatggtatatctattttgcctgtgtggagtgggctgctctttgtcctggactcctatattggttccgctgtgctgtatgggtgcgttattgggtggtgttactatgtgatggtatatcttcttagtaggttcacctaggccttttcatgtggctctcggtaatcgtgccatttgtgcgggccctgttcctttggaagaagaaatattgctctgcttacgctatcgagcaacctctagtcctctagttagtatctatcctatcctggtatcggtcctcgtcggcttagtgttcccttccgtgtgttctcacactaccgtttgtaggtgttggtagtgggcactatggctatgggtactctacctagtctcttccccgtttgtgttatcagggcacagttacctgtaggtggtagagtatgagagtccatgtcctctcagccagatataatagagcctctaccgtgctacctctactagtgctaaggcttgttgccaggcatgcccctggcccctcgccattcttattgaatacaagccctgatcgttccatctcgctcagcagaaaaaataggagccctggccccccaacgtttcattgcagagtaatagccgttaagtccttgccctatgctccttaccaaagtacaagtcacagtctttcccaccattgttctgcaaactaggagtgtaccgttcaggtcactttatcaaagaaaagtatctacttgcatttatagaataagagtactagctcatcaccgctcctgcgcctttactatgaaacaggagtcttgattcggcttttgcctatcagagaaggatctgactcataaccccgggaccagataaa

SEQ ID NO: 616301 - DNA, 295 bp, Homo sapiens
atgcgacttcagttctcatgaggcacatggtttcctgtttcttagaccctcagagacttgacctgtttggagtagaagtcgttcatatttgaatgtcgatatgctgaatccgaatcggagtttacaggctctactactttcttctgtgttggggctctcttgggcttagggactgtatccgaagagcggtgttccctttttagcagacttagccgttttgacttggaactttatctgtctgtttcagagccaaatgatggtgaaataacagaagcagaatcttcttcagttactg

SEQ ID NO: 616302 - DNA, 187 bp, Homo sapiens
atattaagccatgtgaataagtagtagtccttatttgtgaaaaattccccaaaagctggggaaaacaaatgggtaacttttccagttacttgacccgattcagtgggggaaaaccagccttttttattctattgaaacccaagcctttttaataaaagcttgttaaatttaagaataaagtttttta

SEQ ID NO: 616303 - DNA, 225 bp, Homo sapiens
agcacttgagtccaggagttgtgacaccagtttggggaacatagtgagactgtgtctctatgaaaaagaaacaaaactagccagtcatggtggtgcatgcctgcagtctcagccacttgggagactgaggtgggagaatcattgagcccaggagatcaaggctgtggtaagctgagatcaggccactgcaccccagcctgggtgacagagcaagactctgtctca

SEQ ID NO: 616304 - DNA, 438 bp, Homo sapiens
  misc_feature (1)..(1): n is a, c, g, or t
ngcatcttcctatatcctcatgtacaccgtatgcagcttcagtggcgaagagtcattggagactttaactctcatgtagtgatcaatacagatgctactgtgtaaggtctgcactgtagtggagttaacgtctgtacagagtaacaagctcatggtcaggcttccaatgtagccactggctggcgctttggatgtaccgatgtagatgtcacatataatatcagtcagtatcagttgagatatgaggctcattatgtggccttgatacagctctagcatactcggcagggagtacttagtggtgcacaattgatccaggtagtttatatgtttcttcttaggtattgtataataaaccctgtcctggaggctctttctatgaggtacgtcgccactgttgtcctgtatggtgatctcagcagccctcagtagaacggc

SEQ ID NO: 616305 - DNA, 288 bp, Homo sapiens
actagtccaacatacgactgtccacatgctggtaattttttgtatttagtagcagacaggtttcatcatgttgggcaggatggtctcgatctactgactcatggtccacaggcttgacttccaaagtgctggggattggggcgtgagccacgcgtctgccgtatctgattctttccccaaaaacagaaacagcacgggtgccagtatgcgttcatgggtgaacggcttctttgggtagccgctttgtctgcagagcccttggactctggaggcctagaactagcaatg

SEQ ID NO: 616306 - DNA, 711 bp, Homo sapiens
tctggaaagggagtctcgctctgtcaccaggcgggagggcaggggcgcaatctcggcacacctccgccttcggggttcaagcaattctccggcctcagcctcctgagttgcgtgggactatgggtgcatgtgccaccatgtgcccagctaatttttgtgtttttttagtagagagcggggttttcaccagtgtgggccaggagtggtctcgatctccgtgacctcagtgactccacccaccttcggccctcccaaaggtgcgtgggatcccagggcgtgagccactgtgggccgggccagcccgtgtgtgtgtcttttcaaagaacctcggccccaggtgaggtggctgatctcacttcccatgtggtctcgttagaaattacacctccttctccgggggactccctctttccgtgcagccttgtccttgggggagtacggggaagtaccgtgcaggtgacccgtgcccccatgacctgggccaggcaggatgatctccagagcccgtacgggggggaatcctcaggtgaccagcccagccccatccgaagccaggttggggccggggcataacttcgcggggctctcccaagaccatcagagtgcatccagccctctgggggttgggctggcatcaggtactcatcaggccttggtctctagcctcggccgaggtgtctggtcccgcctcctggtgttccgtggtgccag

SEQ ID NO: 616307 - DNA, 620 bp, Homo sapiens
tgagcccccccccccccccccccccctctctactcccacccccaccaaaaaaaacaaaatagctattattaattatacgataatctgttaggtaaggttccgtcctttctttcttcccgtgctttacgcgttcagctagtaaggctggggaggtattgacgccagtcctgtttaaagggagcaccatagagagaggtccgggaaagggaaggaaattcggataggtcccctagtatcgagaaactatccaaaatcgacccgtccctagcaatcggcacgctcgaaacgtagggagggaagattacgtcgctagtaactaatttatcccccataggccggtcttagggagaggccggccgaaatggcgcccaaaggaaggagagcggccctattagtccgtctagtctcttcggaataaagatcaaggcgtcatgcgccgtccgccaggtccacatcatggtgggctcggggtcgtaggctcggagcttccgccagcgtacccagcgtcggcgagaaaggcgggttttagctccggatgtcgaagcttctcaaagataaggtagaaatatagttctagacttttttgtactccttatcgaaacaagggggacgcgagaaaa

SEQ ID NO: 616308 - DNA, 256 bp, Homo sapiens
catctgtagttacttcacttacgaataaggtctctggctgggtgcgatggctcacacctgtaatcccagcactttgagaggctgaggcgggcagatcacctgaggtcaggagttcgagaccagcctggccaacatggtgaaaccccgtctctactaaaaatacaacaattagctgggcatggtggcacacacctctaattccagctactcgggaggctgaggcaggagaattgcttgaactcaggatgcttcttga

SEQ ID NO: 616309 - DNA, 314 bp, Homo sapiens
  misc_feature (7)..(7): n is a, c, g, or t
  misc_feature (117)..(117): n is a, c, g, or t
  misc_feature (260)..(260): n is a, c, g, or t
  misc_feature (287)..(287): n is a, c, g, or t
gccctgntatctttgccctgttgagaagccaagatctcagctgtactagtcaggtgttttttcagacagcaagtagaacaggtggtggccaactccagtgctgtaccctggaggagntccgggtcagcactgggcaaggtaggtagctagctgcctgaccctagtctggggttggaacttctgtttgcctgagtaaagggatgtcagtcctaagatttctccacattgtgctttctctgcagtggtaaaagctggccttnattgcctgcatggtaccctaaggcagnccactgctctttttgatcaaggattct

SEQ ID NO: 616310 - DNA, 706 bp, Homo sapiens
agcgggaggactgtggcttggggcatgcagagggtctgccatggggcagatcagtggagtcaaggatgggtgtgtgggtagatggcatgggcggagtcctccactgctgtcatgggcaagagctcacagttggggcctggtggggaggatgctgtagagctgctaggaagatgacgaagcggagctgtggtccccgctttggacagatgagggcaagggaggcctgagcaatgccttagttctagagcagtgacctacacatgtgacccgtcacgaccagtcgagtcctggtggagatgtgcacaccataaatgggggaacatggagaacacccaggaacgtatgattctccatccatttatgcagatcatggttcagctgccagggcactgaggaaggttgctggatcttatctccaatccgagggactctggaaatgccagcaggctatgggcgtggggtgcaccatgaggacaagagaccaagagcagcatttactctcaaggataagctgtgaacaagagcaccagtccctggttcttaaactacagcggtgagtcccgtcagaagggtgtgttgcaagaggtaaggacctccagagcttcatcgaggcatataggaagggtgagatgccctaactccagaagagctggcgttttcaccacgttgggaccaagtttatacctaatgaaaagcaaaagagacg

SEQ ID NO: 616311 - DNA, 168 bp, Homo sapiens
agtgctacctccacaaacagacctcacacaccacacacaccacataccacacacaacacaccacacacacactgaatactacacacacaccacatactacacacacaacacacacagcacgcacacaccacattccactggctatacactgtttgtggaggtagcact

SEQ ID NO: 616312 - DNA, 365 bp, Homo sapiens
  misc_feature (159)..(159): n is a, c, g, or t
  misc_feature (179)..(179): n is a, c, g, or t
ttatgctcttgttatgacgcccaagctgcagtaccgtggttatgcacaggtgcactccccctactcatcaggacaggagttctgacttgctctgtttccagcctggctctgcttcacctctccttaggcaaccttctggtgccctgcacgttcactccngacagccagtgcacataccncctcgacctagtgccctatagcccagcatttctgcgactcaggcgatccctctcgcctcaccctcccaagtagttgggatcacgcgcatgtgccctccccctggcagcagtttttaatatggtctttaagacactcaataacttggcttctcccattcatctagaaacaataacaataataccaac

SEQ ID NO: 616313 - DNA, 586 bp, Homo sapiens
caagaaggaaggagctggctatcacctgatttgctcatggtcggcgtcatgatgggagtcggctacgtgatggcgacttccatggttgatggctgcaacagtgttgtcaataagtcatgtcaacagacttaaaagttgaatctcgaatgttctgctccaggcgaacaacccaagttgttggtaattcgtgaacagcgggttacaggactaatgatttgtattctaatgggcctctctgtgtgcatgacttcagtcctaaagttgattccattgcctgttctgtatggtgttttcctttatatgggagtttcctcattaaaaggaatccagttatttgagcgtataaaattatttggaatggctgctagacatcagtctgattggatataactccgttatgtgccgctctggaaggtccatattttcacagtcattcagcttacttgtttggtccttttatgggtgatacaagtttcagatggtgtagtggttgttcccatgatggttcttgcattagtgtttgtgcgccaagtcatggagctgtgtgtcacgaagagagaaatagttggttgatgatttatgcaga

SEQ ID NO: 616314 - DNA, 374 bp, Homo sapiens
  misc_feature (138)..(138): n is a, c, g, or t
ggcccccctgcccctgggagccccctgccagagtccctcagtcctgacctgcaacacctgagacactgagaaaaagaacaggctgataccctcatgaaattccaagacaaagaagaaaaaaacctcaatgttattggncctaaataatcaaaaggataatgttttcataattttttattggaaaatgtgctgaatctttgaatgttttattctccagatttatgaactttttttcttcagcaattggtaaagtatacttttgtaaacaaaaattgaaatatttgcttttgctgtctatctgaatgccccagaattgtgaaactattcatgagtattcacaggtttatggtaataaagttatttgcacatgttca

SEQ ID NO: 616315 - DNA, 88 bp, Homo sapiens
  misc_feature (62)..(62): n is a, c, g, or t
gccgctctccccctagaccttttaagggttgtttggagttttagatgcaaaattcacaagtnttcaagtgattgttaaagaggttgtc

SEQ ID NO: 616316 - DNA, 851 bp, Homo sapiens
agcggggggaggcgccgggggcgcgcgcgcgcgcgcttgggcgctgctgggctgcgagcggcggcggcggcagggtggttactatcggcgggagtcgggccgtgagcctcctccttcttcccccttgtttgtcctcctgctcgcccggcagcggctgggtccgggggccccctgggtgggtccatggcttctgcttgtgtgctgtgcaccagcgtgcctccaggccaattacacgttgttgagacagatggggcctgcattggtttccattttcaaatctggatgggatggacgcaccatgtgcgcaccctgctatccccaaagtggagctggtccctgccggggaagcccttctactgcctgagctcggaggacctgcgcaaaaatcacagtgcttgctacactgactactgccaacagggatcgacttgagggtgccccagtgggtcacccttcaatggaagccctgaagcaccccggtccatgttgagggagccctgggtgaacatcttggttaagggcaattcaatctgccgttgcctcggttgttccatcccatggtatcacatcattcaattcattcatttggttatacctttggttccatgtcacctaagtccattccaaggcggttggttctagtcacgcaaagccggtccaggatagcgacttggggcaccttttggtacaagtatgtccccttccagtgtgttgacgcactggttgttccttcctcgccaatgaggaaccacagtacccgtcataccaaggggaatttcgttggattccgtacaggacctcttctccccaacgctcgcaaggggtccttggccttcagggtgttaacccgc

SEQ ID NO: 616317 - DNA, 700 bp, Homo sapiens
  misc_feature (412)..(412): n is a, c, g, or t
atcctttgcagtgccctccagaaaataaagtaaagccatgtgacagtaatgtggtctgtcactctgtttaatctgttgtatggagatccaactatttctttcatcagaaaaagtccgaatagctaaccttaatttgaaataacaggacattaaattcattatagccatagataggacgaaacgaacaaataagtcaaaaataatcgtggaaattgagcaagggatgatgaggtacatactcgaagagacgataaatgggtgaaatgcattttgggggtcatcatttgatttagagatagattaatcccatactctcgaattgagttgaaatcgagtaagtctgtcgctttgtcgatcgaagattaaagttagaattttgggacactgcttctattcataggcgtcatatatngtctttgcatgagaaggctctatacttatggagctatatgaaggggctaaatgtaaaacacaagactgtcattagaatttgaattattgggcgtgtgaatataaatcgtaaccgtatgaagtttattttgtatagtagttaagtatgattccaagttactactttgttattgtacctaagtagattttctttaagtcagaagccaattaaaatagttacagagccattgaacttctttaatattatattatgtgaaaactttttgttgtccattgtatctaatatggt

SEQ ID NO: 616318 - DNA, 975 bp, Homo sapiens
tgcctacaggctattctatgtcgatggctcgtctcacgctgggtgtccccgggtatgagtgtttgtgagtcagatagttttaacgaactgtcatgtaatgccaagaagaagagatcacaacgagcaactaacagtgctccacgcagtgacaacactgcgcagagtgtgttgtgccattggttcgctccatgtcacagccatgcaagagagtttcaacgatgagggccattcaacgactgcattggactcatgataacctaggcagattggcagttctatctgtagctagatgtaaaagtagttggtgcacttgcatatgacgtgtgtcctatcttctcaaggggatagaaatccctactgagtgacatactctttggattgccatggctgaatgatgggctccattgcgttctcgagtcatatcttgcaccaatgtgtcctgaccagtgcttggctgaaccaaggttcacccatggtcacgagatgcctgaaggatgtcatgagaacagtgtctttgcttgaattttgagtgaaggaagcaactaggctacgctatgtttcaggaagattatctatgagagactggatgacaagcagtgggggatcggtgttacagatgaggaatgtggatgagctgtacagagaaggtctattgacaaaaaggggatttttcaagtgacatcgagttccagaccgcatctgaaagcattggagggcgcaaagacaaaggatgacgtgaaagaactttagctaaggatcttgcgggatacatgtcgtgtacgtctcttttactgtctcagaaaggttccgccagccttatagaaactggttgcatgtaacttttggtttaaaggggttggctcttctttgtgagggatttattgcaggacctttttgggcgtagttgtgtttatcactggatggggataggggcgatgggtgtaaaatttgcgtaaaagaaaattatcgaagaat

SEQ ID NO: 616319 - DNA, 152 bp, Homo sapiens
tgcaggttgtgacactgttacttacgtgcatcaaaatcagctattgatgcctatgatgattattcattaagagttcaacagatgataccatccctatggcttctcactgggcctcgcatcttgacggcatggacatcctaccatccagtagc

SEQ ID NO: 616320 - DNA, 412 bp, Homo sapiens
gttagcaagagatactagtagcattacagtgatgtaatatatggacatgctagtgtatatttagtattctaccctgcttacttagtatcgctggggggatctctacagtgttacattataccacaacctcatgtctactgtgtatttccatctcactcaatatttcagttgttccactatttcattattcttgcagccagctctttgtgtacatggaccaggttagttaatcaaggttacgaattgttggctcagtctcttttgagtgtggggtgctggaaatagcgctgagtaggaataacagccttaggttccaataaatggtgctcacctgtcttgtgtccctggataattcactatgtgtctgtagacctccttggcacctgtggcagcatggtattatggggggtca

SEQ ID NO: 616321 - DNA, 298 bp, Homo sapiens
gggggggggggccccttttttcccccccaccttcaaggggggtttttggggccccccttttttttccccaaaaaggtgttttcttcccgttgggggtttcccccggggggggggggggtttttcccaaaccccaaaggggcaaaaggggggccctcttccccccccgatttttccccccccccctttttaggggggccccggggggggggggaacccccccattggggtttggggttttttttagggggtttcccctgggccgggggggggggttttttttttcccccccccccccca

SEQ ID NO: 616322 - DNA, 245 bp, Homo sapiens
  misc_feature (33)..(33): n is a, c, g, or t
  misc_feature (46)..(46): n is a, c, g, or t
acaagattctgtagtttgtctctggaaacaggnataggcatctggnaaagtagtacagcttctacaactttgctgatatacagatgggaatatgaagtgcaatgtgcgaaccagggcttggtattaagcctttcccaacttgtgaatatagaatttgataatacacttttgtgcattagcaatggtttttactaatgctaaaacttttaaagtttattttttaataaattgttgagtatcacatc

SEQ ID NO: 616323 - DNA, 337 bp, Homo sapiens
gtagtccagctcttgttttcactctagctttgtgcatcagagtcaggaactgccccaggctttgcgcaatcgagagcaatacctcacgagctcacttatgccagggataatagtattatgctggctgttgtccactgccggaaaacaagagcgtcaacaatggcatccaggtttacagttccttacagtgggagtgctaatttggtaccaatttaatccctctatcatggccagagacagaggtcacataattctttttaacaaagttatcactgtaggacaaattttccaaagttggccgggcacggtggctcacgcctgtaatcccagcgcctgg

SEQ ID NO: 616324 - DNA, 237 bp, Homo sapiens
actggaaacacaaaccctttttttaaaggggcatttcatttccgtgggggggccaaaaaaaaggggcagactgggacaaacctttcccatcggccaaggggtggaacccgacatccaaaacccagggggcagccaagctcagcgcaacctccgggctttttgttttgactccaaaagggggagcacgtcccccttgcccccggggccttttacattggggatgagggatcggctcgt

SEQ ID NO: 616325 - DNA, 204 bp, Homo sapiens
  misc_feature (33)..(34): n is a, c, g, or t
  misc_feature (193)..(193): n is a, c, g, or t
cctctctttttatcctccctttatcccggtagnncgtcgagggccggaaaatgtaaaagtagacgcgcgtgtttaaaatcgtcttaaagaaaggcgaggacggcttatcggcgaagggggagcccggtcctcccttacaaaaggtcgccctcagaaaaagagccgccctcacagccccaatatcggcaccccncagacgagaat

SEQ ID NO: 616326 - DNA, 129 bp, Homo sapiens
ttatgggcattgtaccagtattgctgcctgccttatccgctgcatccacagtgaggcgggctgccgctggagtgggccactacgtcatctacacgggccacctgacatacctgcagcttcactgtcatt

SEQ ID NO: 616327 - DNA, 174 bp, Homo sapiens
gcggaccagcgacatttgcagggtgtagtggtcaccgtgtagtcccagctactccggagtctgaggtgggaggatcacttgagcctagagaggtcacggtcatagtgagccatgattgtgccactcaattcagccttgggccacagagtgagatcctgtcacaaaaaaaaaaaa

SEQ ID NO: 616328 - DNA, 118 bp, Homo sapiens
tccctttagacagagtgtgcactggctcggcgttcattgctagaataccagccagagataggatgaaccgcgtgcttcaggacagggcggagacggaggaggaaaggagtgtggtgat

SEQ ID NO: 616329 - DNA, 276 bp, Homo sapiens
cgcgtatttcaagaaggcaacaattaaggggaaaaggcaggtaggaaattccaaggcccgggcagggctcactcctgtagtcccagcactttgggaagccgaggagggcggatcacctgaggttgggagctcgagaccagcctgaccaacacggataaaccccacctctactaaaagtacaaaaattagccaggcgtggggtggcacatgcctgtaatcccagctactcaggtaggctgagacaggagaatcatttgaaccggcgttgcgacgtga

SEQ ID NO: 616330 - DNA, 186 bp, Homo sapiens
tcgttgcttcacctgatatttcttggctctagtctcctctacattagattggaagaatcctctatagtttccctgcctatatggaaattagtctgtgctcttcggatcacatggaatgttgtcatggtgcattattcatgataaactctgacagcttcaaggttaggtgtgatgctgaatacaaaa

SEQ ID NO: 616331 - DNA, 231 bp, Homo sapiens
gagtcgaaggctgagcggacccggtcgagagccggcgagctccgcgcagggagggtgcgcccaccggtcccgccgggcgcccgtggtacgcgccgtcagggccctctccgccgggggctcggctttcttttacctcttccaaatttaaccattacctaaatccgaagggaaatgagcaaacctctcggattgggtgtcaaggtctcctccgggctggggctgagcaagccc

SEQ ID NO: 616332 - DNA, 179 bp, Homo sapiens
tttccctgggttgataatatgtatattctatgactatccataatgtgtatctattctgtgatgtttccagttttgcactcttatgaatagagcactgctattaacattcttgtactagttttttcatggataaatgtttttatttcacttgaggttaaaatacctagaactggaattcg

SEQ ID NO: 616333 - DNA, 168 bp, Homo sapiens
ctggccgcgagcccagacctacccgtgagaagtggactaagacggtaggtttagcacgcctacagagacgaggccgtagatggttaagcaggaagaagattgagccttaaagcctgatcgccgagggaatccaatgtggatcaatcgggatctcctgtccaagaaagg

SEQ ID NO: 616334 - DNA, 196 bp, Homo sapiens
gcgctaaacagcgcacgccatatggctatgcgagacttctataccgcagcaagactgtggaaagcgcactaattccggcaatgacctggaaatgccgttctggcgcgaccaggccgaggcaacgttcaatcagacaggtaaattgcgcattaccgtccggtaaccgtgaacaggcatggtcaggtgaagcagcctc

SEQ ID NO: 616335 - DNA, 102 bp, Homo sapiens
ccgagatcgcgccactgcactccagcctgggcgacagagcaaggctccgtctcaaaaaaaatatgtatatatattatcatcactgcaatgtagagaatccat

SEQ ID NO: 616336 - DNA, 376 bp, Homo sapiens
gactttatgatgccggctggcatcataatttgacgcgtattctcttgcccacaatttcgcgttgggaaagaccaagtcctcgaaggactggcttcgtgcacatcgtgtcaaaacttttgtctcctgttaaaattttgcttattttttgtacggctttttcgagtcggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcaatttccttagctgccgtaatattcagctccctgagctgagccttgaggtccg

SEQ ID NO: 616337 - DNA, 144 bp, Homo sapiens
caggatcctgaacaacatagaatggtatgcttgggtgttttccatatgagagcggatggacctctttataaagtaggttgctgcagaatccagttcttccaaaagccactattatttagggtttatatcacaagtcatatacca

SEQ ID NO: 616338 - DNA, 928 bp, Homo sapiens
aggctaccgttttttgggagaatacgggtccgccaaggggcgccaagccggtgcccaagggtaaccgggacgctccgtccacggggaagtggccgtgttgcgaccccccgaaaacaaggagggggtcacccacactttggcgcaaacacacaaaaggtgtgtccgacctctgcagaccaggagtcgtcaagaatatggcccctgtcgaacatgcccacagcggggaagaatctctgtgattcgcccccaccagcaaaaacccgcaccccgggtcaggtggcgccaaacaaagcaaggaacccacacgtctggtgtaacagagattagagtggcacccgcggaaacattcaccggccacggggcacaccaatatggttgcaccgacaatcgaccaccttgaaagaacacgagttgttggtgggcacgaaggcccccctgtcagattcgcagcactttgccctaggaggggtctgcgtagtaaaccaaaatcccgccgcccgttgggagaaaaatcttatatatgctggttcacccttaattgacgtgggatatgtctactctgggggcctggttaaaacaatcacaggggagggctttcccacacagtgtcacacaaaaacaacgttgttatttctttctcaagaacctcactgacagactatatactcccactggcactggaaagttgcacacgcttcgggaagttcacactttctgttcaagcagaagaaaccacgcgtatgtatctttactaaaaaccccctgatagattattagtcttaatcaccaacaaacctctttgcaagattatcttaatagaataatcacgaaagttttttccaataatatgcctacaaatcaaaatcagtaacacatgtaaattcctggcgataaataatcaaaaaaaaaatccccgaaatacaaaaca

SEQ ID NO: 616339 - DNA, 290 bp, Homo sapiens
  misc_feature (188)..(188): n is a, c, g, or t
  misc_feature (218)..(218): n is a, c, g, or t
  misc_feature (222)..(222): n is a, c, g, or t
  misc_feature (233)..(233): n is a, c, g, or t
agaaaactcccagctaaacacccgtaagacttcatacaacacaatactctatactgtgatgatcacagctgccaaggctacctaagaggagacagttatctcatatttggctgccagctttttatcttctctcgaccacttaaacttcagacttcctgtcctgctggtatcatggagaagtccatacntactcgctcagctatagagagctcaccatngaantgcctcacagncagttcaaggctacgaatctatttatcaattctttctcatctaatagtcctcgtcta

SEQ ID NO: 616340 - DNA, 740 bp, Homo sapiens
ctcggtcactgcaacctccacctcccaggttcaagcagttctccctgcctcagcttcctgaatagctgggattacaggcatgggccacaatgcccagctaattttgtgtttttagtagagacagtgtattgccatgttggccaggctgatcttgaactcctgacccccagttgatctgcccacctcggctcccaaagtgctgggcttacaggcgtgagctaccacacctgcctaattttatattttaagtagagatggggttttaccatgttgactgggctggtctcaaactcctaacctcaagtgatctgccctgttccgcctcccaaagtcctgggattacaggcatgagtcactgcgccgggcctatattttatctctctgtcttccatatcatcttctgtattgttcatctctatgccattcttggtattctgacactttctcagatttgtccttatgtcactgattagtttcttaacttttttcccctgaaagtatgtattgtcatgaaggccaaatttagacaacagaatataaaaatcacctattaatccaatatgttatgcttgtagggtacttttaaagaactttttcacaaaagtgtggtctgtataatattcggttataacgggaaacaaaaatcccccttttctgatttgcaggtctacaggtctaaattttttgaacatacttattcactagggaagggtgtaagaaagccttggaggcccataagg

SEQ ID NO: 616341 - DNA, 868 bp, Homo sapiens
ggaggacccgggctggcgctgccgctggttcgtctactctttccttcagccgcctcctttcaaccttgtcaacccgtcggcgcggctctggtagcagcggggggctcctgttccttgcctgagctctctccctattctatacctccccaccagatcccgtgagatctgcccggcaatggcttaacttaactgcggccgcccgggtcttgtgagaaccaaagcaatgccatcttgtcttgttctttgcagaccgggattgccaagtgattcctccacgaatttgaaagacctattgcggaacctgacaccctaagcgagccagtgacagcacattaaggaacttccagcgcagccacacaccgggcccagacacaggtggtgggggcccaaaatacacccggggacccatgatgtactgggtgggccatgcccacggacatgaccggccgactcaggcatcaaatgaacaaccatccagtctggaatccctggatgcagggcgccacccgccaccacggagacactagagacaatcccctgaagtcgccacggactactgtgtacccccaatgagtataatggggttggggaagaccaccctggcctgcagggctaattcatacgaggatgggaaactggacaatatcccgaacaggaggcaacagggtaccagtggatcaacaaaaagaaagcggacaacagcagcgggagcacaagcatacccattgtgtgaccatcgctgggacaacttccagaccagtctcaagcccatggtcgacgtcagttgcacgcggcaacgcctcaccaggcacacaccctgccgagagaagccagggaacaacaccagtacggcgagtcagctgccatc

SEQ ID NO: 616342 - DNA, 361 bp, Homo sapiens
  misc_feature (53)..(53): n is a, c, g, or t
gcgaagacatagataatcttattccatatatgaagacaacaaaccccccctgnattattgactctggatgaggaaatggttattaggaaagatttcaaaacagtactctggatttgtaaggggaatattaaccaatggtgagaaatttgggatccagtttccatttgatcttgatgttaaaattaagcattgatgcttggagcaactttcctcattgaatacatgtattttgaactgtggccataagaattaccctgaaagaatatgtcagagattactggcatttatttttgccagccctcaacaaaactaagcaactttcactgaaaatatctaaataaagttttattttactaaaact

SEQ ID NO: 616343 - DNA, 388 bp, Homo sapiens
  misc_feature (354)..(354): n is a, c, g, or t
gaagacatttatttcttaacacatttatgcctgaggttgcaattttttgaatttttgcaatcagaccttggaaatgaccttgagaggtaggatataaataactcccacatgcgtagcgttccagtaatggaacagtaggcataaataggtttaatgaaggttcagggacagttgctaaccagtgaaagttctggaaactcttttctagagctgtttaaaagcatacttgtacatatatttatttcatgaaatgaattgaggtgactcatgaaggtcatctagtcttatgatcctatgaattgattcaatgcataccatagccaaggatgtaagatcagacatggaaatgtattnttgccaatacttgtcaaataaaagagcaatctga

SEQ ID NO: 616344 - DNA, 630 bp, Homo sapiens
ggctgtcacggcgggtgtgctcgaagaagaccactggccttgtgggattggctgtgtgcaatactcctcacgaggaggctaagaatatggtacacaaagattctggatgttcttgaggaaatcctttaaaatgcagcatatagaaagtatacagaacagattacaaatgatgaagctggctagtggttaaagcggaaccagatgttaaaaaagttagaagagcaagcttcgaaggcggtcaattagaagaggtgattcttcaggctgaagcatgaactatatctgggccagacaaaatgagggaatggcaactatgggagccattagtggaagagcctcctgacgatcaggggaaatggccaatataattatctacggtgacttcggtgtgttcatgggaaacatgatgtaattagaatatgctgttatattaagagcgtgtgcttatgactgacattttggtaatcaagaaaagtgatctacgaaaatatgtaggagactgttaaaataggtgcataatggtaaatatggtcatgtgaatcaattcggattcatagaagtactcacaacaaagtatgttggcaaagcatgatattgctgtgagcagagaaggcatgggaagattggaaa

SEQ ID NO: 616345 - DNA, 350 bp, Homo sapiens
ggcggcggaaacttcgggcccgtaactgggctttccgaggtgcaaaaaaccctttgaggtgaaggtgtatgaaagtcctcaaacccgatgttttccaaaaacctgggaaagggttgggaaaaaactcctaggatcccccggcatgtattgagcatatagggtgctgtaaatgaatgtttttagctgtcatgtttaaaaatacttttgcttcgttcccccaaggggggcatgcagcattttggaaggaaaattgaaaacgggttcaagaaaacatgaacagaagcaaatgatgaaaatgagccttttacttgatgttgataacctcccaataaattatggagaaaaatcca

SEQ ID NO: 616346 - DNA, 208 bp, Homo sapiens
tgattattgggatagtagattaaaagtcaaccgaatactacaagaagaagcaaaaacattccagaatacatgtattttgaactgtggccataagaattaccctgaaagaatatgtcagagattactggcatttatttttgccagccctcaacaaaactaagcaactttcactgaaaatatctaaataaagttttattttactaaaact

SEQ ID NO: 616347 - DNA, 343 bp, Homo sapiens
  misc_feature (42)..(42): n is a, c, g, or t
  misc_feature (55)..(55): n is a, c, g, or t
aaatataaataaaaaagatctaaaaatttataaaagaacaanacaacctttatgnattattgactctggatgaggaaatggttattaggaaagatttcaaaacagtactctggatttgtaaggggaatattaaccaatggaatacatgtattttgaactgtggccataagaattaccctgaaagaatatgtcagagattactggcatttatttttgccagccctcaacaaaactaagcaactttcactgaaaatatctaaataaagttttattttactaaaactattcatatatattctttctgcataataaactatatcaaaaatgtttaacttcaaaaaat

SEQ ID NO: 616348 - DNA, 986 bp, Homo sapiens
gacggaagctaaggctgccgttggggtgatgccctcagttcatccggcgactatcaccggtccggcagcgccagcctacactcgcccgcgccatggactctgtctcctgagctcgcactgcatctacatcgtgccctcattctgcacgacgatagaggtgacatgtcacgtgaggataagatcaatgccctcattaaagcagtcgcggtgtacatagtgttgagccttatcgtgcctggcttgtctgcaaaggccctggccaatcgtcaacattgggagcctcatctgcaatgtaggggcctggtggacctagctccagcagctaggtgcgtgcaaccaagcaggagtgtccgtgtcccctcacactagcaggcgtgctccagctgagcgagaacgaaacgtggaagcaaatcaagagaacgaatcctgaggagtctagatgatgacacatgggctttttggctctatgtatgactaagaacgctctttctatacatcgactggttccaagtatacataatgcttgataccttttagagaacatgaactacacagtatatagccacacagagagacatcacaagaaacactttggacgtttgacactgtgacggcaggataacagagcgaagaggcgcggtcacatagacacggaaaatcaagtccggtactcagtgtgccgactatccagcagagatgtacacgtaaagagtcaaagaagcatgggggccacgtagacagggaagattgcccgcgagtgcgcaaattagcacacgtgtaaatgagtaccaagggtccgaaatgccacagagcgggtacgaagtacaaggtaatacggcgtcgcttaccacttgtagaggaactattctacatagaacagaaaaatggctaatgaggaatctgttcgcatgcgcacgagatcctatcaagtgatgctaccgaacggccatgcgacagagacattcaccataacaatgtagaaaaac

SEQ ID NO: 616349 - DNA, 109 bp, Homo sapiens
catcaggacgacagcaagaacgtgcatttcgtgtttgatgccgtcatttcttacaccataactaacaaactaaaggaacgctgcctcttctgtgggacttcggggcctg

SEQ ID NO: 616350 - DNA, 420 bp, Homo sapiens
  misc_feature (53)..(53): n is a, c, g, or t
gcgaagacatagataatcttattccatatatgaagacaacaaaccccccctgnattattgactctggatgaggaaatggttattaggaaagatttcaaaacagtactctggatttgtaaggggaatattaaccaatggtgagaaatttgggatccagtttccatttgatcttgatgttaaaattaagcattgatgcttggagcaactttcctcattgaatacatgtattttgaactgtggccataagaattaccctgaaagaatatgtcagagattactggcatttatttttgccagccctcaacaaaactaagcaactttcactgaaaatatctaaataaagttttattttactaaaactattcatatatattctttctgcataataaactatatcaaaaatgtttaacttcaaaaaat

SEQ ID NO: 616351 - DNA, 982 bp, Homo sapiens
gcttcggcgcttatcgatctcggaaggacgagagtactcaacgcaagctacagccgaagggtccgcagaagttccagttgtgatggtcacaaagaaatcattcctggaggacattcggaaggcactcgtacgctttccaagagtcatctgtgacgctcaaggcgtttatgcctgctaaggcatggcagccaccgtagttctggctgggactctccaatctatggcggcatcgcccttgatgtggagagggggctgcatcattagaagctgtattcctaggaaagataaacggatgcatttgactcgaaacccggatacttcagaacctcctactggacgacattctctaagtcagctgttgaaaactgccaggactcctggcggcgggcagtcagcactggggtccaggctggcattcccatgccctgtttgaccactgccctctccttctatgacgggtacagacatgagatgcttccagccagcactcatgccaggctcagcgggattacttcggggctcacacctatgaactcttggccaaaccagggcagtttatccacaccaactggacaggccataggtggcaccgtgtcatcctcgtcatacaatgcctgatcatgctgctcctgtcaccctccacgattccacagaccaggacattccatgtgcctcatggcactgcaacctggccctttgccgtattttctgttcagtatttttaagaagtctgtggtaagagagctccttgaggaagacacagcagtttaatttgtaaagtagctctgagagagcgcacatgccgctctgcccttgccttcttgggactgaaccaggagctggctatgtagcgtagagagtagggaaccatactccttgcaggcagtggctctccgcgtgccccgtgtgctggtgcggttccaagtcacgcagacaggaagggtgtttgcgcactctgaacacactggcctctgtataatgg

SEQ ID NO: 616352 - DNA, 304 bp, Homo sapiens
  misc_feature (208)..(208): n is a, c, g, or t
caaagggctttgttggggaacgaaagagagaccagactgttacgtgtgcctatgtggaaagaagaagacataagaaactccattatgttctgtactaatgaaaaattcttctgccttgagatgctagttaatcgtgtaacccttatccccaacgcctgtgctcacatggaacgtacctgtgttcacttcaatggtttaactggatatnagggctgtgcagggatgtgctgtggtttgacaaatgtgtttggcaggcagatatgctatggtcaaatgtcatcaccacttctccacgtcgtcaaat

SEQ ID NO: 616353 - DNA, 985 bp, Homo sapiens
  misc_feature (614)..(614): n is a, c, g, or t
  misc_feature (657)..(657): n is a, c, g, or t
tcccaaagttggctcggctgcaagtgagtgtggacagactcagtagtgagtgggtccacagaaaagatatggtctgttagatctaagtcgcccgattgagcatggtgcaagagagatgtacttctttcccggtcgtggcttgatcacgcaggaagccgggacttgcagaagcacgggtcttccatggaatgcataacgctacctctagtatcgggacgtcttctggcaggcaggctccgacacatgcaagaatgtccaggtcagtggtttgctacaagtgcgcagacaagcatgagcggcacgtgtagctactgcgcaattcgtgcatctcgactcatgtattcttgagatctcaggagatgacaaagaacactgctggacttggctatatccacccttattaacttcgtgccttcgctcgtgacgggcaatttggaccatacttagaccttattggggtcctcaagtcgaggtgtggaggcattgggggcgaaaccagctaggcgatagatcggccagaggacaaggctatctagacatagaatacgcaaaagaaacggaaagcactagcccaaacaaagcatctcggcttgtatggcccaagggtacgaaantcccggaataacacttccgagtacatggaagctgacatgtatnaatacaattcatttcatttgatagtcggatcttttgtgtatttgctcgtataaaaattgtgctttaatttattgactctttttaatgtgggatttaggtaatccatggtaagggaaattaactcattgcacataggcagattgccagggggagaaactaaagataccattttgggatagacatttttattgcgcatcgccagggttatcttagaagtctaaaattacttgagggatcaaataagtttactagaaaatatttgtggggggaatttgttataggggaattaagtaaactcaaacttaaggcctgggctgtaatttccaaa

SEQ ID NO: 616354 - DNA, 943 bp, Homo sapiens
gtgtaagtaatattaggtctgcgcgcgtgttcgattactagcagatgatagaaacgtatgaaatcagcgatggcatgctaccaggatgaagattgaatcatcctcatggcatagtcccacggactcaagtgaagtgacacacatggggcaggcgatagggagtggaccgtcgtgggtacgttatagggcaagtgcggcgtgtcttgcatgatagcaactaggaataatgctcaggtgagcttgcaggtaattcttaaggctacagagagaatatactgaggtatgacagtacagtaactcatgttgttgttcctggtgatgcaggttcaaagataccgttgacagtgtactgctgtggagatgtactgcaatggatgctgggatttctcaagaagactcttgatagtggggctcaaaagccagtgctcctacggacagcaccaagtaatgtgcacaccagtgacaggcaacaaaggtcactggaaacactatcctgaaaacgcgctcccaacgccgaaagactacgcgtgtccacactcgaggatgagacgatccgttgtctgtcgcgaaaacggtcgtgggtgtctgaaactgtggacttggcgtcagcatttccctcactgtgatgttggaggggaaaagcacgtttcagaaacggaacgccattttcccagacaggtgaccccatgcgttatagttcaaaagggctccgtatacacgtttggcgaattgttgtgcgcggggcccaaagaagtggaccttccacggtgaagaaacatgtgccaaaggcacaagaaaccacggttagaagcggttggatcgtccaggaaacccaaatcgaaactaaccagggggtaacgggagattaccagtgacggaaaaactcgccgaaatctcttgacatcagagcggcatttctggcggcatcatggtacttatacat

SEQ ID NO: 616355 - DNA, 561 bp, Homo sapiens
  misc_feature (73)..(73): n is a, c, g, or t
agaaagtacttgtgctcctgatattcacctacctagtgatcaacttggcatcatcaaaatggggataaacaanttctatgtctcctgatgtgagcagtgggaagcatacagcattaactatgtagtttctcaccaaaaatgttaagctaaacctgataatgagaaacaatcagacatggggtattctataagaaaatcagcatggactcttcaaaaatgttgatgtcatgagagaccataaaataaaacaaagaaaagaggattattctagatgaaaggagctaaagagccataacaacagaaaataatgcatgatctttaattggtcctgaatacaaaaacaaacaaacacagctataaataatattattggaacaattgaagaaatttgaaaatattctgcagtaaatagtattatagcaattctaattttcttggggcagtaaggatattgtggttatataggggagcatctttatttttatagaatatatagtaaagtaacatggtgtctgcaatttttttaaacaggccatacacacacatatagaaagaaaaaaa

SEQ ID NO: 616356 - DNA, 165 bp, Homo sapiens
  misc_feature (1)..(1): n is a, c, g, or t
nccccggttattcttgaaagtctgcgagacatgcacctaccagaaggaaccaactctggacataagatcacggttggtgagtgtgggagacagccatgtacaccctgtggctaagtactgggccatctgtactagttgctacatacatacctccatggtgctagt

SEQ ID NO: 616357 - DNA, 268 bp, Homo sapiens
tgcttgccgaagagggagcgcctgtcacccggcgtgagagacccgagagagactgcacttggcacagcgcctccatcccttccagactggtccagacgtcggggaggtgaaacacgtctctatctctaccagctgccggcggggcaaagccccagagcctcactggccccggcggaatgaggagaccatgccgggcgcgcacacacggcagcttctgtatgaaaacggcgaccttcgggcccttttctccagcaactgcagagccatt

SEQ ID NO: 616358 - DNA, 223 bp, Homo sapiens
ctccacccggacgggtggcaaggtgtgcttaaaaagaacaaacaggccaggcgcagatggctcacacctgtaatcccagcactttgggaggccgaggcgggtggatcacgaggtcaggagttcaagaccagcctggttaacatggtgaaaccccatctctactaaaaatacaaaaattagccgggcttggtggtggtcgtctctaatcccgctcctcggaagg

SEQ ID NO: 616359 - DNA, 337 bp, Homo sapiens
  misc_feature (52)..(52): n is a, c, g, or t
gctggtcttgggaggcagggcaacctccgggtttgggcacggtgggtggccnccatagccccagtaggacaaacgggctgggtttgggcagcccctctggcaggagggtcaccctggcctgccagtttgccttccccccaaccccgtgtcctgtggtttggttggggcttcacacccacccctggactgaccctgcaggttgttcatagtcaaaattgtattttggatttttacccaactgtcccgttccctgctccccaaagatacccagatatatacccccagtggatgggcggccaagacaggcagagatctataaacagacaggctttatgca

SEQ ID NO: 616360 - DNA, 192 bp, Homo sapiens
atgcggtgaggtctagatgagttgagtttgctcatttagagactggcatccacaccatctcttttgagccccacataaattgttagtaagcaagtcagtaaaatgattttcactccattttactagggaacggaacaagtggttcaaaacagacaactggaacaacctcaaagatcatttgatcgcaggaat

SEQ ID NO: 616361 - DNA, 332 bp, Homo sapiens
tggaggaacttgccggtagttatgtgacacatgaaatcaaatgcatttcagtctacttttaccgtgggtctatgtggccattcttctgttcaaatctgtttgaaagcatggattgtgccacacacccagtgatccatcctaaaatgatggactgtcagtctatattccaaataccagagattgaacatttacagccttgcgttggggaacatctcgatgtttgaacctttgttgttttttgtacagggcattctctgtactagtttgtcgtgactgtgaaacacctagcggaatagcctacatttgtatttattttctattccatacttctg

SEQ ID NO: 616362 - DNA, 474 bp, Homo sapiens
ggcccaggcaccctggacgccccatcagtggtcatgggatggacagccgaccggccatggccatctttgagctgctggactacatagtgaacgagccacctcccaagctgcccagtggtgtgttcagctcagacttccaggagtttgtgaataaatgtctcattaagaacccagcagagcgagcagatgtgaagctgctgatgaaccacgccttcatcaagcgctctgagggggaggaagtggacttcgccggctggctgtgcagaaccctgcggctgaagcagcccagcacacccacgcggactgcagtgtgacagccagcgcccagcagtctgtgtccttgtccctgtcggcacagtggccgctgcctctggggacagtgatgctgtttgttgtggcaggggacctatgcccatgcatttgaaaaccaaacaaaatgaagaaagagaaagaaagaaagaaagctacaaaaaa

SEQ ID NO: 616363 - DNA, 706 bp, Homo sapiens
gcacgaggaagaatcttcttgaggacaggaaaaagtgccgaaatcactaacacatggtatatcataattgattgaaattgtggtctgtccaccaacggaacccaacttggcttcattcgcatattgatacgccatatatgcggcgtttgaatatgtagatgaatccattagtgtatattgataaaagttgatgttcattccgtttttttttttcgccatctggcaggcatgcttccatacttcctgatgctacgttaagtagctccagaaaggccaagattaccaaaaatatgcagtggtgtgcaattgtcattttttttagtggtgctaatcaatttaaagaaaatcatttgcggaatttactgcagagcaagaaatcatgagggtgctctttttatatttattattttgtcgaaatatgaagcagaataccagaaccgtccagtgattcaaaacgataagactgtgaaagatttaacgtatctcccatgaaaatttgaccagaggaacttctctaccaatagtgtttacacctacgtttatttccattctatccatagaagctactaccttatttcctaccagctcccactaggttttaatgagcgcaaaacaaaataaaagtttacggcctttagaggttaagcgatctacgcatagatgtgtagctcatgctgcatttcgcgtactcctgcatgcaaccaaa

SEQ ID NO: 616364 - DNA, 189 bp, Homo sapiens
tccgtgtacaggagctgggcctgtcagccccgatgaccttgctcccgaacatcaccagtgtgcacaccatcgagatcctccgggagaagggcttcgaccatgcgcccgtggtgtatgaggcgggggtaatcctgcgaatggtgacgcgtggcaagatggtctcgtccctggattccgggaaggtgcagc

SEQ ID NO: 616365 - DNA, 247 bp, Homo sapiens
taggtaggttaacatgcatattagaagacagacagattttttatatgagcactgggcctatcccaactgagcaaggctaaattactccaactcaaagccgttctgtaagaattccaggtcaggtatcccaggcctgtctgtggtcgtagtgtttccacacacaccaatactaccgcacggtggtgtccactctcttgaagtccttagacagctgcaccaagagttacgccaggcccctggtcgacgc

SEQ ID NO: 616366 - DNA, 595 bp, Homo sapiens
  misc_feature (56)..(56): n is a, c, g, or t
tcctattttctttttttttttacccagtaacattattggtaatatgcaatcccggnctgaagcccataagtacaaaggaagtagaaaatgaaagccctactccacaggtatcatgatgcgcatggatatgttcagaagagtattttcaaatcacttaaacagagctgaatgcagagcaaaagcccacagcagcaattaaattacattgggaataaatcttttggcataattttcataacccagatttcagagaatacctccacccatgccaggtgtaccagacaatcccattgtctgttttagccgtgtaggggccgctgtagtagacaccattcaggtttgcagagtgacccttgttaaaccaccagccagactgatctttttctgcgcagttcccttcatagttgtcatgatctctgtcccacgtgatgaattccattctttggtgattagccccccgcggcacctcaggatgaaactcccccgcaagggaatctccagctgtcccagaatattccccaatatccaactcgtaaaatttctttaaatctcccgctttgactttctcattttgtgcatatcgctaactctctcc

SEQ ID NO: 616367 - DNA, 262 bp, Homo sapiens
  misc_feature (38)..(38): n is a, c, g, or t
  misc_feature (231)..(231): n is a, c, g, or t
tggagattggaggtggggggattagaaatgggctgctngagtagtctagatacaaaggtcagctttagggtggcgcgcggtggttctcgcctgtaatcccagcactttgggaggctgaagcgggcggacaatgaggtcaggagatcgagaccatcctggctaacacggtgaaacccgtctctactaaaaataaaaaaagtggtggcgggcgcctgtagtcccagctgcttnggaggctgagacaggagaatggcgtgaaccc

SEQ ID NO: 616368 - DNA, 185 bp, Homo sapiens
ttattgcagagagaactgctagagcggtgtggtatggtgtttgggtgaaagtcatcctcatcatctgagagcccttcaaacaggacgccacctgggatatcccggctatgagctggagggcatgctccgggaagaggagtcagtcccagagcattggggcactgcctgctacggaggtgcaaaac

SEQ ID NO: 616369 - DNA, 411 bp, Homo sapiens
ggcacaaggtgatctccttgaaatggtcacacacctttcacctgccttttctcttaaactcggttgatgtcaggggtgtgcgagccagagacgagctctatcattgatgacgctctgttagctcacataatctccatgtgtagatggggccggaatggcgttgatagcatgtgcatagtgggtcagtattccggactacaggtacatgacgccggctccatgcagcagtcattgtggctacccgagtagcgctgaataactcacacaggctgtggtgctgggttactaggatcttaggtgcacgacgatgcatgtacgcagccccttagtagatgtatggcgactatcgtgtactggtgtaccttaccgtaagctgctggccatatggctcagctggtactagttcagagc

SEQ ID NO: 616370 - DNA, 144 bp, Homo sapiens
agactcagccgggacataggtgtgctactgcggctggagctgcgatgagactcggaactcctcgttttagtttgtgctccatgttttgtgtatgtatggtggtttgtaaatttgtagaattaaatcattctccttgttgtggag

SEQ ID NO: 616371 - DNA, 939 bp, Homo sapiens
aacaggatacacccataatgcactcagcaagcctggtgtaacatctagattgagttagcatttgtcatcaaatgatggccatttgttctgtttcatggttgtgaaccaactgaagacataagcagggcctcagtaacccacaaatagcacatgtgtgcataagctggaaaaatgaacccttcttctgggaggacgccagcccaggccaggtcacccggcttggcctaggcagtaacatgagagtgagatttgggtcccgttctgttccccagtggggtatctatcactttctgcaggggcacaagcctacatggtggctctggtcatcatcattagagaatagacagaaatgggctgcacaccagaatgaatgacttgaattgaaagggcacggagtgatggtggcaaggaaacaaccaagttgatactgatttagactggtgaggaaccagtaagcactgtgtagtacatgcaacacggttaaaattcccgtggaagatgttacataatcctatcaatggctgtccatttatggaaatctattttaaaaattttatgtaatactgcacagtcggtttgcatgatgcttgtacgtagtagcaactcagtaaatactgtttgaatgaactagtataggtatggacttaggtagtgttcatgtatggtttcaaagaccggtcgttaaggtgagcaagaagggcacatccccctcaagaacctttacatccaggtacgcacgcagaaggtgacgacgggcgaaactacaggtcggggtctagaaccctaaaacacactgagcattctgaaataggcgacacccaacccccccccacataacagcgaaccgccaagcggcgcgagaaagcaaagccgccgggcactacaagcagcgagcagcgaacacaccacggcaaacgaaccagaggaaaagccggcaat

SEQ ID NO: 616372 - DNA, 175 bp, Homo sapiens
taaagacgatagtgtcaatgctgtagtccgcaatgagggtgcactacgacagtggtgctacattttctaccccagaaaactaggatagctcttatgaaacttatgggtcgaaggtggctttatcattactgtgagagtagagtggttagttgaacagggccattcaacgcctccg

SEQ ID NO: 616373 - DNA, 204 bp, Homo sapiens
ttttttttgagacggagccgcgtctgtcgtccaggctggagtgcagtggcgcgatcttggctcactgcaagctctgcctcccgggttcacgccattctcctacctcagcctcctgagtagctggggcaggaaggactgcttgagcccaggagagtggggctacatgtcatccactgcactctggcctgggtgacagagcgagac

SEQ ID NO: 616374 - DNA, 148 bp, Homo sapiens
atgagccggtccatgtttgaaggcgtgagagagagagagagagaaagaagagagagaaagaaaaagaaagaggaagagaaagagaaagaaaaagaaaggaaaagaaagaacaaaagcctcatggctttcatgctactatgttttttta

SEQ ID NO: 616375 - DNA, 316 bp, Homo sapiens
  misc_feature (81)..(81): n is a, c, g, or t
aggattttttacacttaaatttaaaaccccccccagtttgtattccttcagcagaacctacagaaattatctactgatttntattagtaattaaatcttttcttcagtctttttagacttgacatgaatacgaagagtttcagaacaggcagagaatgccttaaagctttgcatcagttagaggaggcccgtctcttagttgaacagtgttgagtccaccaggagctactcaaagtctcagtgtgccaaaacttcgttcagaaatactaagttctagagctgctgttaagaaactgtgttaagatactcttcccaa

SEQ ID NO: 616376 - DNA, 239 bp, Homo sapiens
ttatcccccgcctactcgggtaaaggaggggataaaggaatgagtcacggttaaggactctttcattctgccttggcaacaacaacgacacacaagagacggcagcacgcttgcccgccgtagcacgccctgcgcgttcagagcgaagctggtaagcggcgtgtcagttggccatgcagcaatcctggattctcgtctcgcgctggacccaccacgtgaatatcccaccgtttgcccgg

SEQ ID NO: 616377 - DNA, 315 bp, Homo sapiens
aggatcctcgggtcccttgtctctaccataaaattcaaaaattagctggagcatgtggcttctgcatgtagtcccggccactcgggagcggtgaggcaggagaatcaattgaacccggcaggtggaggctgcagtgagccgagatcatgacactgcactccagcctgggcaacgagagcaaaactctgtctcaaaaaatgaataaaaacaacaacaaaagtgaatctggaaaatagcctgagcaacaagagtgaaactccgtctcaaaaaacaaacaccaaaaaaattcaggcataaaaaagggttatttctaca

SEQ ID NO: 616378 - DNA, 110 bp, Homo sapiens
ggaacaaatcaacaacaacctatttagctgtcccacaacactttctcggctatccggaatgccccgaccgttactcggattaccccggtgcaggtgtggtattaccgggt

SEQ ID NO: 616379 - DNA, 285 bp, Homo sapiens
  misc_feature (11)..(11): n is a, c, g, or t
  misc_feature (71)..(71): n is a, c, g, or t
  misc_feature (279)..(279): n is a, c, g, or t
tcacgcctttntgaaccccaaatatctgagaccagtctcagtttattttgccaaggttaaggatgcacctntgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtggatccgcattttttatgtaaacagtaagggaacgggggcaatcatataagcgntttgtt

SEQ ID NO: 616380 - DNA, 932 bp, Homo sapiens
ttgaggggcaatgaggagagaacagaaaggaagagaggggggctggccgcatcacattttattcttataattttattagtatgcataaatggttaatggacaggcattaccaacttgactgacctgggttacctaccctgcagagaaagtatatgctattttatctaacttacccaatgccttgtgaacccaatgttcataagctagctaaaactatcatcttggaccccaggtgatatcataaataaatctagcttatataatcacccattatatttttacaaaaagggagaataaaaaccgcctggctgaaaaaatgggccttttttttcaggcttttaaaatgcgctgtccaagtttgcttcctgggagttaaaacaaaaagggtggccaaaaacacttttgttgagaatggtggtggagactggcattatccggtctttttgggatggggcgccctttctgtctgggtggttgaaaaaaacatgtgggagaagaaggagaaaaatacccctttgcgatttttaaatgtcttccccctgtaaagagcaaaaataagaagttttttggtccagggagaacagtgtaaaaacttctggggttttacaatatccgtcttccgcctaaaagcggagttgtatatggacgcgcgtcaaaagagggcgggggaaacgggcaacgaaccctttttttttggggcattaagtgagggccgggggtgaaccccgagaaaaagagaaccttttttctgggggttcccgaaaaggaatatggatctggtgctgacaaagaaagagggacccgttcggtgtgggcacaccaaaaaaaatcagcgcggtgaaagaaaacgcgagaggggggatatatatttggagcaaaggggggtgctcgagggggcggccgtcctccccatgaaagagggaagaatgggg

SEQ ID NO: 616381 - DNA, 421 bp, Homo sapiens
gcagacatcagctaccaataaccagccagattcattgccataagatcgatatcaccagccataggcaatcatcaacatcaagggccatatgatgagcattcaaattatgatccgcagcatgacccctataggccaaaccaggagtcctatcattcacaaagggcaaactacagccaccagacacaagatgaccgtcgcgatgtgagtcggtctggagcagataatagaggatatggcgggtcacagggaggaggtagagggcgtgcggtatatgacaaggatggaagaggtcctatgacaggatcaagtggtggtgaccgcggtggcttccaaaattttggtggtcacagggattatggacccagaacagatgctgcttcagaatctgataattcagataacaacacaatctttgtgcaag

SEQ ID NO: 616382 - DNA, 482 bp, Homo sapiens
cactgggtacatgtggtgtcacagatggcctgctctgcacttctacttctaaagcacagatgggaagaaatggatcttgtctacgatctaccctgtacccaactgggcacttacacagaagcctcactcattcaggactgcattagaattctcatggctaggttggccgtcacttcattttaaaaaaaaattatattttacgactgcattggcataaagaataacatctaggctggccgccacttcattttaaaaaaaaattatattttacgactgcattggcataaagaataacatctaggctggattcattgttacatattgatttttttatatttatttttttttcctgtttgtaaaggaaaataacaacactatcatgtatccctaacagtatctgggcctctggcactgtgtctactaggcctaatggaaaagtagatcctgcattcacccattcaataaatatgtattgaacatca

SEQ ID NO: 616383 - DNA, 170 bp, Homo sapiens
tgttgcttgtttgcttgtaggttgatcggttggctgtatgcttattatgtttatgttacttggctggttggctgaaacagaatcagagtttactaaaagtaccataaagtttgagatgtccacaaatttccttggtataatgtgtataggaaaggtatgcaacaaactca

SEQ ID NO: 616384 - DNA, 141 bp, Homo sapiens
  misc_feature (13)..(13): n is a, c, g, or t
ccgctgcgcttantagactcgagaggatcccccttcgcagtagtatgattatcatcgtcaatcgtaatcggggagagatgttgcatcaactcagacatcttctggaagccccaggaggctgtgcagggagatgtgggattc

SEQ ID NO: 616385 - DNA, 100 bp, Homo sapiens
tgaacattcgtgtcagtgaaatagaagaagggcagctttgaggaacgcgagtaatcagctcataaatcacattgagacagttttcggacaccaatgttcg

SEQ ID NO: 616386 - DNA, 553 bp, Homo sapiens
  misc_feature (252)..(252): n is a, c, g, or t
  misc_feature (265)..(265): n is a, c, g, or t
  misc_feature (277)..(277): n is a, c, g, or t
ggaagttcttttgtatctttcactcttccttgttccttatctccacgtgtccataataactagtatagcagagatagccggtcctcagtaagtattagaaaattgaccatgcttgacattttcaagtactgtaaacatttcctccactgtattttttagaatatatcctctctcactattcctagttatagccttaacccaagtcttaaccatatcttacctctaggactagtgcttccctgttccttttgnctcattctacgcnaacgaaaaaacnaacaaaaaccaatcaacccatgagaccacaatactttaaaaaaaaaagatcatagtaatcatctcggtagattatgataatgtttcttccttttctcacctttacatggcttcattatagttgacatgagattaagattgtggatattcgaggaacgttcctgtcaacttcctttccaaaagttattacaacttccagcctgtcttacctgtttctggcaggtaagcgttatatcttttgaagtctacgttaccattctgatgttggagcggccgc

SEQ ID NO: 616387 - DNA, 157 bp, Homo sapiens
tcagacctaactgtgggacttaaaatgcttcccctgcccgctgacacaccacaccaccacattattaaaggcctatttacagcaattccttttactgagctcatcatgtgtagctatcaagaaaacatcacaggcactttgggaggccaagcagtcg

SEQ ID NO: 616388 - DNA, 792 bp, Homo sapiens
atcttcacttgtcatgttatataatcattattactttgctgtaatgttaatattgatttattaatatatattatcttttcatacattttctaagaaacatttatattgataagatcttttattttgccaagggcataaattattgtttttcttttttttttttaaataaatttcaccaagttatggctcttcgggtgaggttgttttccctccgttggggaattctaatcccaggcactcctcagtctcatggttcattacctatgaggtttcattaactctcttggtaaatttgtacggactttgggagttacttaaaaaaccacagttcctaaaacattttattggggagctcaattttcgggcttcctacttaccaagaggcagtaagtgataacctcgggccttggtcttacacttttcacctttcgggatcccttaacctcgggtcccaagttactaccctggcttataatccattaaccactcactaggtcacaaagttggagggctcgggtttgacccagtgattgagaagtgtctcagatgtcggttttatttttttgcgaaatttttataagggagacaggtgggcgtggtaaaaatattttttaaagagcatatacctataaggggagggaccttaaagttacctttacagggggggggggggtagaagactcatttaatagttagtgtaaaaaagttttcaccagcggaagattttctttattttaaaaagaggagttcagggtgttaacctggcagtataccacaatttaagtgttttag

SEQ ID NO: 616389 - DNA, 372 bp, Homo sapiens
ttttgttttttagagatgcagtcttgctatgttgcccaggctggtcttgaactcctgggcttaagcgatcctctcacctcagcctccgaaagtgctgggactagaggcatgagccaccgcccctggcctaaacatcatctttgattctctgtttctttcatgctctcctgtttgctctgcctccaaaatctatccttagtccatcactttttccccctctgccccttcgtctcttctccaccaggcagacaactgagccttttaaacctccatcagatttgtcctctcctggcttggacccctgcaatgacttcttacctgggtccagcctccgtcgacgcggccgcgaatttagtagtagtaggcgacagc

SEQ ID NO: 616390 - DNA, 238 bp, Homo sapiens
tctgtctcgtcagcctcccgaggtagctgggactactggtgcggcaccacaccggctaattttgtattcttagtagagacggggtttcaccatgttggccaggctggtcttgaactcctgacctcaggcaatccacccgcctcggcctcccaaagttctgggattacaggtgtgagccaccgcacccagcctcttctgattttgaatccagtattcttctcatttgcttgttccgctg

SEQ ID NO: 616391 - DNA, 437 bp, Homo sapiens
ttttcaagcattgtacaattttagactgagtaatttaacaataagtaaaaagtggacatgctaaacaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaagaatattaaaaaaaaaatcagaaacgaataaaaaaaaataactattatgataaaaatatatgatgttaaaaaaaaatattgtcttataaaaatattaatatatataaatttaaatctataatagaaaataccttaaataacaaaaaacgtataaaaattatacataattaaaaaaatatgtaccaattaatatggccaatgcaaaactgaaaagttataattaatgtcaaaaaaaagata

SEQ ID NO: 616392 - DNA, 458 bp, Homo sapiens
  misc_feature (85)..(85): n is a, c, g, or t
agctttatgattaagaaagagttggcaaaagattttgaattcgctcccaaagttgggagggatttttgcccacgtccaacccaanaatgtgaataacgccaggggccccaagaaaaaaactgttaagaaaggatatcgccattccccccccccccaccagaaagtccggtcgataaagaattgggtagtggtggattcttttttaaggccaatccaaaaaaacggccgaaaatggaagccattaaggcttaaccagccgaagccctccgttagaggccagagggaagaaaccaagccttttttccccctaagggaaaacccattgtggaacctaagggagctttttctgaaacttaaatttatgtggcccgcctccaggaaaaggtttaaaaaaccaaaaattaaaaactgggggctctttccgcttaaaaaattgccctttaaatgggggccgatta

SEQ ID NO: 616393 - DNA, 113 bp, Homo sapiens
tgtatccggactgctgaacgtaccagctgtgtagacctgagacaaatcatatccctcacagaacctcatagtccttgtcagtcaaatgcagacagcagttgcaactccaacag

SEQ ID NO: 616394 - DNA, 944 bp, Homo sapiens
  misc_feature (107)..(107): n is a, c, g, or t
  misc_feature (198)..(198): n is a, c, g, or t
  misc_feature (205)..(205): n is a, c, g, or t
  misc_feature (210)..(210): n is a, c, g, or t
  misc_feature (273)..(273): n is a, c, g, or t
  misc_feature (318)..(318): n is a, c, g, or t
  misc_feature (320)..(320): n is a, c, g, or t
  misc_feature (340)..(340): n is a, c, g, or t
  misc_feature (346)..(347): n is a, c, g, or t
  misc_feature (395)..(395): n is a, c, g, or t
  misc_feature (412)..(412): n is a, c, g, or t
tctcagaggatcccctcgaatcgaggtttctcaacatcctggcttagtattgtgtgcaaaatcagagaggggtgcaagatcctgatttttcaggagttcaagcgacnatggcagcccaatacggcagtatgagcttcaaccccagcacaccaggggccagttatgggcctggaaggcaagagcccagaaatcccaatngagaatngtgtnagtgggtaaaaccggagcaggaaaaagtgcaacaggaaacagcatccttggccggaaagtgtntcattctggcactgcagcaaaatccattaccaagaagtgtgaganangcagcagtcatggaaggaancagaanntgtcgtagttgacacaccaggcattttcgacacagaggtgcccaatgntgaaacgtccaaggagnttatgcgcgtgcatttcttttggactccccaggggcctcatgatctgtttcgtgggtgttccaagtgggcgtttacactggatgaagagcacaaagcaagagaagatcctgaaaatgttgagagagggctagaacgttcatgatcctcatatcaacgggaaagatgatttaggtgacaccaaattgggttgctacttaagggaagtccagaagaattcagattgatgggcatttcggtgaccggtaatgtggttaaacaacagggcaaaggcgttggagaggaggcctagtaggcacagttggtgggcttgatcccagggtggtggagggagacacaggaggtggtaccctatggttgcaaaggggggggggagtcagaagaaacaggatgcagatccacattgtgggtggggaaaaatggttaaaaggttgaaaaacaaatggaaaatgggagaaaaactgaaatacaaggtttattgtggagagagagggagaggtaaataagaggcagtttgggcagaaatgttttgaa

SEQ ID NO: 616395 - DNA, 978 bp, Homo sapiens
  misc_feature (107)..(107): n is a, c, g, or t
  misc_feature (232)..(232): n is a, c, g, or t
  misc_feature (239)..(239): n is a, c, g, or t
  misc_feature (244)..(244): n is a, c, g, or t
  misc_feature (307)..(307): n is a, c, g, or t
  misc_feature (352)..(352): n is a, c, g, or t
  misc_feature (354)..(354): n is a, c, g, or t
  misc_feature (374)..(374): n is a, c, g, or t
  misc_feature (380)..(381): n is a, c, g, or t
  misc_feature (429)..(429): n is a, c, g, or t
  misc_feature (446)..(446): n is a, c, g, or t
tctcagaggatcccctcgaatcgaggtttctcaacatcctggcttagtattgtgtgcaaaatcagagaggggtgcaagatcctgatttttcaggagttcaagcgacnatgctgtaaggcagcaaagggcaagaacggaagtggagagtaaggatgggatacttgaattaatcatgacagcacaccaggggccagttatgggcctggaaggcaagagcccagaaatcccaatngagaatngtgtnagtgggtaaaaccggagcaggaaaaagtgcaacaggaaacagcatccttggccggaaagtgtntcattctggcactgcagcaaaatccattaccaagaagtgtgaganangcagcagtcatggaaggaancagaanntgtcgtagttgacacaccaggcattttcgacacagaggtgcccaatgntgaaacgtccaaggagnttatgcgcgtgcatttcttttggactccccaggggcctcatgatctgtttcgtgggtgttccaagtgggcgtttacactggatgaagagcacaaagcaagagaagatcctgaaaatgttgagagagggctagaacgttcatgatcctcatatcaacgggaaagatgatttaggtgacaccaaattgggttgctacttaagggaagtccagaagaattcagattgatgggcatttcggtgaccggtaatgtggttaaacaacagggcaaaggcgttggagaggaggcctagtaggcacagttggtgggcttgatcccagggtggtggagggagacacaggaggtggtaccctatggttgcaaaggggggggggagtcagaagaaacaggatgcagatccacattgtgggtggggaaaaatggttaaaaggttgaaaaacaaatggaaaatgggagaaaaactgaaatacaaggtttattgtggagagagagggagaggtaaataagaggcagtttgggcagaaatgttttgaa

SEQ ID NO: 616396 - DNA, 778 bp, Homo sapiens
tggacttttaaaaaagtaagccttatatccctggtttggcaaataaacggggctaagtgggtggctttgggtgattagtcaaagagacaaatcatatctgtgagatctcggatcttcctgggcttccaaccttagctgggggctggccggcagcagcagggagcacgctggtggttggcagcagccacagggggcaagcagccacaaagggcaagatgggatcagccaaagaagggctggaccttttcagcaagtggggaacggtgtaatccggtctccacagacaaaggcgcaggactcgtttggtcccctgtggatcgatacgacctgggcggtactggatggcaaccacgccggggtacgcccaatctggcaagacacagacatctgggcaacctgttggcggaacaccctccaggaaagcgaagacatcgcagacagttcctccggggatcctcaaagccctaaccagggttgcaccgatgctgccatttgtcggaacccacctgctggatagaccagcccccaaagggcacaaggtgggacacatgttccaccattgtcaccagccagcccgatgggcacttcagcgggactccccacacatgggtctcccagcactaggactccagctgtggcacactcactcccacgcctacacagggctgccccgtggccacatcacagcggacgaaccccacaacccggccacacagcaagctcttcacccaggcccgaaaccacggtcgcggaccggacacaggaaaacacatggcgc

SEQ ID NO: 616397 - DNA, 1072 bp, Homo sapiens
  misc_feature (1072)..(1072): n is a, c, g, or t
ggaaacggtgcgtgagcacgggcctgaggaagagtcaggtaggggacaagggtgtcagaggcctagaagcagccccgcagctcctcttgagcagaaggggaaaccaggaagggaaacaaacccttccgagtcctcgggaagtttccagaaccaggagcacagagagttacagttggatccagactgggggggtctccaagtttgctaggaggtcacagtgtgggagagagccccaggcggctgagtgacagctggctgttgctgacttccatttttcacacctgggaaagggctctgtgtacagccctatgcccccgaccaggtggctcaagtagggacggcttggggatggtggacagtgaccagaggagagactggctatgggaatgttgcagtgccaccctaagtcacaaaaagtctttgctactcacagccccaagccttccctgcctgtgggtactaaacacccaaggactgcccatctgtttctccctggacagcaacggacggcaggggatgtcaggcagagggcagggtgctggttaaactctgcccagctttgggcatctctcatagactcttcctagtgctcaagctggagacatttatgggaccaggaggcgggtcttgagcatctccccttgtcccatgcattgcaacatcaatggtagtgatatccagatggggggtgaatgggtccgaagcaggattgaagtaagaaccaggttctgaatcaggcagttaagaagggatcaaaccccaagaagattacatagccgggtgagggcccaaggcagagaacctgtgattctttaccctcaaggacctgttttctcccatttcttgtgaggagcccaagcaggcaaggaaagggggccctactgtggacacaaaggttggcgacggtcacgcaatagcagagaaacctcgaagaactaaacaggggagagtagaagaacacacattaagtaagagcaaaactagggagagccaaggaaggatgggaaggcacataattaatataggatatcactatcgtcgtccacggtcggtcgtattcgtgtgctatggn

SEQ ID NO: 616398 - DNA, 959 bp, Homo sapiens
agcggaatgtaatgcacatccctgtgaccacagtcttccgtgctctcagacccaagctccgggacgacacggactgggtccaagcacctggcacattgtttgtccgcactgtctttgaagctgcattgtggaacctgctgtgaatggtagcggcgtatcttctgatagcagtgattgtaccagcttttgtatttgacagctgatttgctatctgaccagttctcaagagacgtatgagcgaggataccatggccgttctccccttgattgtggctgtccaagcatagtgcaagcaccacgcggtgttgacgcgaagctactgtacagaagggtggtaggctcagtgctgactgtcctagcacgttcctattgttgtccttgcggcgagtttggagtccgctaggatgggcctggtttgccctagatgaatggttctagcgcgatcaggacgtacccttggatattgcgagcgtcacccggaagttcctatgcgacaacggtagatccttgaccttgcctcgctgacgtggcgtaatgaaacaagcatcggcctcataccttgtagtcttgactgagttggctattgacacatgagattacctctaccaccagttggaccctaaaacaatccttcggaaatgcttagcgccagaactagaaaagagcgcaagaggaccagtggtctccaagcttggagccccacacgaagcaaaaccgaccgtcgcagtccgacccgagatagaaaaaaccgagcgccccgggggccagcagtgaacgcgctcacgaagacaaaacagcacgtgccgagtcaaccctaacaagatgacccgaagagtacggacggccaaggcaatgaccccccaataacgacgaaccatacctcccactcgccatagcgatgaagagacaacggcgggggccccgcgttggaccccccaatgtagcaagaagcctccaat

SEQ ID NO: 616399 - DNA, 124 bp, Homo sapiens
ccggcgccagtccatcgcccagccagtagagcgcgttatccagcgcgtcttgtcgtccaactgccacagggtatcgcaagccgcggtgcggtaatcgatcaccttggtatccgggatcgcctct

SEQ ID NO: 616400 - DNA, 148 bp, Homo sapiens
tttgcttgctggtcgtccctagcacggatcccctatccatacgctcctacacatgatgctcctacaccatgagtgccctacacgactatgctcttcctatcacttgtgacagcggcgcttcaccgacgccgttggacttgttcaccca

SEQ ID NO: 616401 - DNA, 436 bp, Homo sapiens
tggctcttgcatggggcccaataagaaaatcttttccggaaaccctcacaataaagccttaatagccctttttttgttaaaatgccaaagtaggttagcccaaggccccattttcttttgttaaaaaccaaattcaaagatttaattcctgctaagaatttaaaaggtcggccaacccattcatcataaaatccaaataatcttgggacccatttatctagtgattcatcccccaatctgttgaaaaagcataatataaatggtgatgagactagaccctaatggaaatggttaaaaaattcccaacccccaggggggggaatgcctttaaaaaccctaatgggaaaaaaagctggtaaaatttaattggtcaagcaattccctccaataaaatggaaaaacctgaaccttttggaataaaaccaaaatcccgccc

SEQ ID NO: 616402 - DNA, 529 bp, Homo sapiens
  misc_feature (14)..(14): n is a, c, g, or t
accggactcctggntgtgttgcccgtctcggcatattctcataaaaacacacgtgctctccctgctgatcgtgtctgactaatctctcaaaccccaacctcttctacaaaacaacaactcctttctttccggggcatggttggatactttcgcctttggatacctggttttgccatcctaacaaaaccattatatacactcacaaaaggaaacctagctgaccccatagatcctaaatcctttccccactcctctttccgttccttgaagacagctttaaagactgcccccaccctagctttccctgattcatcccaacccttttcattacacacagctgaagtgcagggttgtgcagtcggaattcttacacaaggaccgggatcgcgtcctgtagcctttttgtccaaacaacttgaccttactgttttaggctggccatcatgtctccatgcagcggctgctgcctccctaatacttttagaggcccttaaaatcacaaactatgctcaacacaccaggaaggtcc

SEQ ID NO: 616403 - DNA, 148 bp, Homo sapiens
aggaccctgagtcaatcatatgctactttgaattacattttaatagactcagggtcctatttactcctttgtacaggtattaaataggaccctgagtctattaaaatgtaattcaaagtagcatatgattgactgaacagtcatgtaa

SEQ ID NO: 616404 - DNA, 129 bp, Homo sapiens
gaaaaaggcaagcttttagcccttgaaggaatcatcaaactttgggcctcggtgtgttcccccagggggagaaaaaaacgccatgttcctccaaggggcctccaaaattaaataagcaatgacttttta

SEQ ID NO: 616405 - DNA, 279 bp, Homo sapiens
  misc_feature (42)..(42): n is a, c, g, or t
  misc_feature (54)..(54): n is a, c, g, or t
  misc_feature (58)..(58): n is a, c, g, or t
  misc_feature (61)..(62): n is a, c, g, or t
  misc_feature (65)..(66): n is a, c, g, or t
  misc_feature (81)..(81): n is a, c, g, or t
  misc_feature (91)..(91): n is a, c, g, or t
  misc_feature (139)..(139): n is a, c, g, or t
tccttgagcccactcactcagagggcctgtcactagtccagnattgaatctgcnggtntannagnncaggcagtgtgattngacagcgtgntcttagagtccagcctttgaacctggcgctgaatcctgactttactgnttattcagggggccactagctaagttaatttgtgagcctgaggaacaaggcatgaccaagatttacaattgatactcgagacaccctggaagtggtgcagcaatttagtggttgagaggtactctggaggctgaggcggg

SEQ ID NO: 616406 - DNA, 567 bp, Homo sapiens
  misc_feature (62)..(63): n is a, c, g, or t
  misc_feature (65)..(65): n is a, c, g, or t
  misc_feature (70)..(71): n is a, c, g, or t
  misc_feature (76)..(77): n is a, c, g, or t
  misc_feature (81)..(81): n is a, c, g, or t
  misc_feature (99)..(99): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (123)..(123): n is a, c, g, or t
  misc_feature (127)..(127): n is a, c, g, or t
  misc_feature (131)..(131): n is a, c, g, or t
  misc_feature (144)..(144): n is a, c, g, or t
  misc_feature (150)..(151): n is a, c, g, or t
  misc_feature (154)..(154): n is a, c, g, or t
  misc_feature (165)..(166): n is a, c, g, or t
  misc_feature (184)..(184): n is a, c, g, or t
  misc_feature (191)..(192): n is a, c, g, or t
  misc_feature (200)..(200): n is a, c, g, or t
  misc_feature (217)..(217): n is a, c, g, or t
  misc_feature (219)..(221): n is a, c, g, or t
  misc_feature (224)..(224): n is a, c, g, or t
  misc_feature (228)..(229): n is a, c, g, or t
  misc_feature (239)..(241): n is a, c, g, or t
  misc_feature (246)..(247): n is a, c, g, or t
  misc_feature (252)..(252): n is a, c, g, or t
  misc_feature (261)..(263): n is a, c, g, or t
  misc_feature (265)..(265): n is a, c, g, or t
  misc_feature (278)..(278): n is a, c, g, or t
  misc_feature (288)..(288): n is a, c, g, or t
  misc_feature (295)..(295): n is a, c, g, or t
  misc_feature (297)..(297): n is a, c, g, or t
  misc_feature (302)..(302): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (322)..(322): n is a, c, g, or t
  misc_feature (326)..(326): n is a, c, g, or t
  misc_feature (329)..(329): n is a, c, g, or t
  misc_feature (332)..(332): n is a, c, g, or t
  misc_feature (334)..(334): n is a, c, g, or t
  misc_feature (344)..(344): n is a, c, g, or t
  misc_feature (348)..(348): n is a, c, g, or t
  misc_feature (358)..(358): n is a, c, g, or t
  misc_feature (362)..(362): n is a, c, g, or t
  misc_feature (389)..(391): n is a, c, g, or t
  misc_feature (567)..(567): n is a, c, g, or t
ctctggaagcttctggatcctaggctcatctccacagaggagaacatgcacgcagcaaaaannanggggnncctcnnagcncctccctgcacaaagaanaaaaaatggaagggggnantgnanaaanaatnactttaaaacttntggaanntgnaaaaaactgannaagtaataaatgaagaanaaaaaannaaagtgtncgaggggaaggatgtantnnnaantgtnnaaaatttgcnnnaaaannaaacnggcaaaatnnngnaaaaagggaaaanaagggaactnaaaaatnanattanatnaaananagaagaaggtnaaanaantananatggaccggnatanagtggacganaaanagtatattccaatgcatccctgcagannnagaatgtcacccgggaggacgcacggatcctacaccttacacatcataaagcgaggtgatgggactagaggagtaactggatatttcaccttcaccttatacctggagactcccaagccctccatctccagcagcaacttaaaccccagggaggccatggagactgtgatcttaan

SEQ ID NO: 616407 - DNA, 133 bp, Homo sapiens
ccagtgcgagccaggctcccagctggggcccacaccttctgaggcccaggagggacccaccctccctgcacctaccctagctgaggtccctcctgtgaggggcagaatgagaaaggcactaaagggcgaaaga

SEQ ID NO: 616408 - DNA, 425 bp, Homo sapiens
  misc_feature (301)..(301): n is a, c, g, or t
  misc_feature (326)..(326): n is a, c, g, or t
gtgatttcctaaggccaggggtaggggttggcgataatttgggaaagagcatgaaggagccttttggtaggatggatatgttttagatcatcactgtccaacacagcagaactttctgcaatggtagaaatgtcttccatatgcactgtctaataagctgaataacagtcacatatggcaactgaggatttgaaacaaacctaggacaactgaggacgtttttcaatttaaaataagctcaatagacttgaaaaagccacacgcgcccagaggctactcaactggacagcacggtatctanatcttgaatgctgcagcaattgtgngcatggataaatttgtcaaaacttattataaaagacactaaaaataggtgcattttaatgcacataagccttacctgaataaagttgattttaaggaga

SEQ ID NO: 616409 - DNA, 109 bp, Homo sapiens
atgaggcaatttattaacccagcatggcggggtgtaataggtggcgcggacaacttccgcttgtcaggcaagggtgcccatatcatagtgccccttctgtcgtcttctc

SEQ ID NO: 616410 - DNA, 145 bp, Homo sapiens
gcgcggagacgtttctgggaaggaccgccgcgatggctgcgcagggagagcccaaggtccagttcaaactgtaattggttggtaatggtggtactggaaaaacgaccttcgtgaaacgtaatttggactggtgaatttgaggagg

SEQ ID NO: 616411 - DNA, 249 bp, Homo sapiens
atagtctgaaagctgcatctgagttgtctctaactcttcccagcatctctcgtattatatgggtacctagattccttgactcttactaagccaagccaccttatctctgtagttcttattatttggtggactacacttgggggggtacttttttatggtcatgtcactgcgctattaactgggggctgggtgcttttccaccttccccctctgaatgaaagccacggaggcaggaggacttcgcctgtt

SEQ ID NO: 616412 - DNA, 122 bp, Homo sapiens
ttctcttccttgccctgcttcagcaccgagacgtggtagcgatggtcggcgatctgatcgcccagcgccgccagggggatcaccagcgcctgctcgagccggcaactgaatatgcacctgcg

SEQ ID NO: 616413 - DNA, 273 bp, Homo sapiens
acacgagttgatgctgcgggcgacatctagaggatcccgtgtgtacgagataacgggtgtacctatacacgtgtattagaaagaactctggcagcagggtagagcatggacggaactgaaaagctacatgataatacttggcaagagataagggctcgcactaaaggcagtgaggcatgggaatagagaggactgctgacaagaagagaagacaggtcttgagcaccatctgcctaggatgttaaagcactggagcaagataaaagatcacta

SEQ ID NO: 616414 - DNA, 177 bp, Homo sapiens
ccaggcccttttcaggaagaagctgcccccagagaatactctgagcattctttcgccctaaaaaagcaagtttcctagatcttaatgaaaagcccaaccttgtggaatattggtctacactaaaatagttctctgtgtattagctgactacaaataaaatggaagagactacatgta

SEQ ID NO: 616415 - DNA, 535 bp, Homo sapiens
gagtctacccatattacggattcctggcggtcgctcaacacaacgtgacacggcctataatcatgcactagatgataacagggactcgtctgttgtgtcaggccggcacatagaacactagatggatatcacgcatcaagagctcacctggaattgccctatatcacaagcttactgctctataacagtgcagcagcccgcctagaattcacaaaaacatgaacagagcttgggtgacatgtttagagagtcgcaaccttaccacactgtgatgaacatcataccaaatgtctctctacttatcaatcaacaatggtacttgtactaacttggatgattcagctctgatggttactcttcaagccatgtgatgttagtatcattgatagtgaagtgctcaatctgaaatgctacacaggtcctttgactttaggtcaagcttacatatcaaaaggtgtatctgtgtgtcagtgtgtgtcctacagtactgccatatatctgaatgggtaacaaattcagtcttcaccaccagagg

SEQ ID NO: 616416 - DNA, 102 bp, Homo sapiens
catagcatacgatagctcattgttcggtttggaagtagtaaaattgacaaagagctaataaaccgaatagagagagccaccggccaaagaccacaccacata

SEQ ID NO: 616417 - DNA, 272 bp, Homo sapiens
cgtaacgccttcccgcagcgaattccagaactgctggcgagcaaccccagctacgtattcttcagtgcccgccccgacagcaacgaaggcccacgcggttcgctgaacgtgccattgaccgccggctacagtgtggcagtggatcgcaaggtgattccgctgggcagcctgttgtggttgtcgaccaccaaaccagacggcacgccactgtcacgccctgtcgccgcgcaggataccggcggcgcaatcaccggagaagtacggagtaccga

SEQ ID NO: 616418 - DNA, 307 bp, Homo sapiens
tggaaccaaagtccagaagttacgcgtcacccttgctctacagccaaacatgcaggactctagtaaccccgcgaaatgatggggatagacgtttgcaaaatcctttaaaaagaggtcttaacggcaatcctggcctggacattgacttctccacatgcaaccaatcggggttcaattggtctcctaaacccttgccaatggagggcctgtggcacctgagccagccattatcatcaccagcacttccatgagctacaagctggaccccctgcagtcctcctgacaaaatgcaataagagcctccaca

SEQ ID NO: 616419 - DNA, 832 bp, Homo sapiens
  misc_feature (77)..(77): n is a, c, g, or t
  misc_feature (108)..(110): n is a, c, g, or t
  misc_feature (118)..(118): n is a, c, g, or t
  misc_feature (128)..(131): n is a, c, g, or t
  misc_feature (135)..(135): n is a, c, g, or t
  misc_feature (137)..(137): n is a, c, g, or t
  misc_feature (139)..(139): n is a, c, g, or t
  misc_feature (144)..(144): n is a, c, g, or t
  misc_feature (152)..(152): n is a, c, g, or t
  misc_feature (158)..(159): n is a, c, g, or t
  misc_feature (177)..(179): n is a, c, g, or t
  misc_feature (182)..(182): n is a, c, g, or t
  misc_feature (184)..(185): n is a, c, g, or t
  misc_feature (192)..(192): n is a, c, g, or t
  misc_feature (201)..(201): n is a, c, g, or t
  misc_feature (204)..(204): n is a, c, g, or t
  misc_feature (209)..(209): n is a, c, g, or t
  misc_feature (214)..(214): n is a, c, g, or t
  misc_feature (217)..(217): n is a, c, g, or t
  misc_feature (221)..(222): n is a, c, g, or t
  misc_feature (232)..(232): n is a, c, g, or t
  misc_feature (234)..(234): n is a, c, g, or t
  misc_feature (237)..(238): n is a, c, g, or t
  misc_feature (244)..(245): n is a, c, g, or t
  misc_feature (248)..(249): n is a, c, g, or t
  misc_feature (268)..(268): n is a, c, g, or t
  misc_feature (270)..(270): n is a, c, g, or t
cctggcgcatcctgctttattatgctgtggacatgctcaatgctgtattcattccaaatgaaaataactagactgcntgattgtactgtaagataaggaggaacgcgnnnagctgcantatatccttnnnncgtncnanagtgntatggacnggaaanngatagttttatctcacannnccntnnacactanacaacttanttntccantccanaanatcnncattcatcgntncannactcgnnganncatttaagatttgagatantnacaactcctgcaaacggtctgcctcgtggctctccactttagaaaccccccattactgtgaccctgttatatgagtcagctacacggcaagtggactctgaggtgacgtgcttatggaccaacatcacctacccggaccttaggggaatgggatatgctctagagaagcatcaccccatgccactgagtattcgggcacccgaatgggagaagaaagggccctcctgaacagttataccggggaacctgcgcataaggagcggaacggagaacatgctaattcacccgacagctttacccgacatatcgcttgcttattttatgcactccccctgaccgctactatagcggtggtaaaataatataattactgcacaattaacaccgagtatgtgccccgtacagaacatctgaaccccctcacaacttttacgtgcgaaaggcttttctggcccttacagctttttataccacgccacctcccgggagttcccgtccactaattacccctaccgatattttacatctcgtgattcgccccctcttgttgaccaccccaccg

SEQ ID NO: 616420 - DNA, 105 bp, Homo sapiens
tatgacaggtggagaacacgataatatcgcgacagatgggtaccacgcgagagtggcttcccagaagagggaatgatgtgtgtatgggcttgggcggcaagtata

SEQ ID NO: 616421 - DNA, 398 bp, Homo sapiens
  misc_feature (77)..(77): n is a, c, g, or t
  misc_feature (108)..(110): n is a, c, g, or t
  misc_feature (118)..(118): n is a, c, g, or t
  misc_feature (128)..(131): n is a, c, g, or t
  misc_feature (135)..(135): n is a, c, g, or t
  misc_feature (137)..(137): n is a, c, g, or t
  misc_feature (139)..(139): n is a, c, g, or t
  misc_feature (144)..(144): n is a, c, g, or t
  misc_feature (152)..(152): n is a, c, g, or t
  misc_feature (158)..(159): n is a, c, g, or t
  misc_feature (177)..(179): n is a, c, g, or t
  misc_feature (182)..(182): n is a, c, g, or t
  misc_feature (184)..(185): n is a, c, g, or t
  misc_feature (192)..(192): n is a, c, g, or t
  misc_feature (201)..(201): n is a, c, g, or t
  misc_feature (204)..(204): n is a, c, g, or t
  misc_feature (209)..(209): n is a, c, g, or t
  misc_feature (214)..(214): n is a, c, g, or t
  misc_feature (217)..(217): n is a, c, g, or t
  misc_feature (221)..(222): n is a, c, g, or t
  misc_feature (232)..(232): n is a, c, g, or t
  misc_feature (234)..(234): n is a, c, g, or t
  misc_feature (237)..(238): n is a, c, g, or t
  misc_feature (244)..(245): n is a, c, g, or t
  misc_feature (248)..(249): n is a, c, g, or t
  misc_feature (268)..(268): n is a, c, g, or t
  misc_feature (270)..(270): n is a, c, g, or t
cctggcgcatcctgctttattatgctgtggacatgctcaatgctgtattcattccaaatgaaaataactagactgcntgattgtactgtaagataaggaggaacgcgnnnagctgcantatatccttnnnncgtncnanagtgntatggacnggaaanngatagttttatctcacannnccntnnacactanacaacttanttntccantccanaanatcnncattcatcgntncannactcgnnganncatttaagatttgagatantnacaactccttgccactgcaccccgctccggttctccccctcacacccccacattacctgttaccgtgttttgtcagtttagctaacattgtgatgacttttctcctacacccccttccaactaccccc

SEQ ID NO: 616422 - DNA, 412 bp, Homo sapiens
tccaccatgcaagtctcagatatcttagctgtgtagtgattcttgaaattctttttaagaaaaattgagtagaaagaaataaaccctttgtaaatgaggctgggcttgtgtgaaagatcaggcgcaggcgttgggagagaggatgtgagctctctaaaattgtaataatggaaaggtggaaaatatcgtgtgtaaaggaaactacctcatgctctgaaggttgtgtggaagcacaattaaacatctgaaatggctttgttgcaccagagccagcgggtgtggagaactcgatgtttgttgttgttgagagggcgatggaataattttatgggtgctggcaatagacacatgctttattatttgcagattcttcttcaaatctgtaattaggcacattgtcgtttagcaataa

SEQ ID NO: 616423 - DNA, 121 bp, Homo sapiens
ggatcccatttccatgcaggtaggataagaatataacttcaggctgaccgaaaaatcagaataggtgttgcgtactagaatggggtctcctcctaccggcggggtcgaaaaaccgtggtgt

SEQ ID NO: 616424 - DNA, 858 bp, Homo sapiens
cgaggacaacgcaggaggcacaggcctgtactgggtccccgcaggtctgcgcgtctgttgttcccagcgctctgagaggcctgaaaaggaagagcaacctgtccagaatccccgcaggaaaggcacaaaggcaggggcaaatctcgacatggcaaaaactcttcaatgcaaaatgaaggaatgccttcgaatcaaggaaagcatagacaatgaagaacagccaccgcacgagggaaagccagcaagtagcttgtattctggaagacaagaagttagaaaacgagggaaacacagaaaacacgggcacagcagagttgaggaaccgttaacaggatacaagaaaagccagagcagtagcgggcaacaggcaaaaggagcaaggcacacagtccagcagcaggcaagggcacacagtccgcagcatgccagggcaggatccaacagcacagagggcaacagcccagcagagcaggggcgaagggccagagggtgcacaggcagcagccagaccagtgcaccaagagagcccacgagagtgcacgggagaagccagacaagtgaacaacaaacgggctgcagggacaacagcgcccagctgacggatgactatccccaggcaaagccacaaaagaaacaacaccaacaaggggctgggtcagtagctcaagcaaatataaggaagccataccatgatatgaatttcagcaatgaggacatgatacgagaatgggacaacatggctagggtggaaggatcacaagggaaaacaagcaaaaagaaattggggggcgtataaggtgaattgaaagaaattacaggcacccttgtatcctaggagtccagggaattaagggatga

SEQ ID NO: 616425 - DNA, 122 bp, Homo sapiens
  misc_feature (109)..(109): n is a, c, g, or t
tgagacggagtttttactctgtcgcccaggctgagtgcagtgggcgatctcggctcactgcggcctccgccttcccgataggaagcgattctccgtgccgagactcccngggtaccggagct

SEQ ID NO: 616426 - DNA, 1020 bp, Homo sapiens
  misc_feature (1)..(1): n is a, c, g, or t
  misc_feature (92)..(92): n is a, c, g, or t
  misc_feature (103)..(103): n is a, c, g, or t
  misc_feature (108)..(108): n is a, c, g, or t
  misc_feature (136)..(137): n is a, c, g, or t
  misc_feature (199)..(200): n is a, c, g, or t
  misc_feature (206)..(206): n is a, c, g, or t
  misc_feature (219)..(219): n is a, c, g, or t
  misc_feature (246)..(246): n is a, c, g, or t
  misc_feature (280)..(280): n is a, c, g, or t
  misc_feature (359)..(359): n is a, c, g, or t
  misc_feature (406)..(406): n is a, c, g, or t
  misc_feature (495)..(495): n is a, c, g, or t
  misc_feature (627)..(627): n is a, c, g, or t
  misc_feature (630)..(630): n is a, c, g, or t
  misc_feature (754)..(754): n is a, c, g, or t
  misc_feature (846)..(846): n is a, c, g, or t
  misc_feature (881)..(881): n is a, c, g, or t
  misc_feature (894)..(894): n is a, c, g, or t
  misc_feature (903)..(903): n is a, c, g, or t
  misc_feature (956)..(956): n is a, c, g, or t
  misc_feature (1000)..(1000): n is a, c, g, or t
nttttaaaaaaacgaaatgcaacatcctaaaaaagcgcgcaaaatttactattgatactaattcctagcaaggtttggctggtggctagccntagcacaaggngattngggaggagagcgcattggatatttaggnncattcaacatgcaggagggcggtgaaatcgtaactgtgtgagttgcccatcagaaagctacnncctgcnttttttaaaagtntttgctctacagagaatcttatcagcnatacaaaaatctgttcagtttttatactgaagcnagttttgagctgcacttgaattcacattcttagcaaaataattgcctgagcccacacacacattccacacgcatcactnaaggatagccattcattcttcatcttcatcctcttcctcctcatctncatctccttcttcctcctcctcctcctcagcttctggttcgttcttcttctttgagcctgttggcctgccagggcccttctttcctgcntcacttttgcccttggcacgagaggcagcgatatccttttcatatttctcctttagcttagctgctttctgttcatatggttgtgtatctgtggctgactgcgcagaccacatttcacccaatttctttgcngtntccccaatggataggccagggtgtgcacttttgagctttgggcgatgttcagagcaaaacagggagaaggcagaaggtggccttttaggagcattggggttctttttcttccccttcttatcanctttgggagggacgttatttttcatcttcctgttatagcgagctttgttactttttgccatatcttcaaacttcgacttctcctttgcaganatggtcttccatcttttcgaacacttcttggaganttccgcgaaattnacgggagantcgggtgtatttcttgtgccctcccggcaggctgcccgagaaggcgtcgaggncattatgcccgcggcttgtaggggtttctttcccatgttgaaanaacgcgtcaccttgtgcaac

SEQ ID NO: 616427 - DNA, 1191 bp, Homo sapiens
  misc_feature (1191)..(1191): n is a, c, g, or t
cggacgcgtgggtcgacccacgcgtccgtgatttttcttgggtcagtaggaggctggagtggagtggtgattattccccggagctaagctcaggagcccgaagggagagactgagactgactcccttatctcttcatattctttattccctaccagatggatttttttttttttgttgggagacggagtctgcgcccggtcggccaggttgggagtggtgaggggcgatggatctcggaactcacgtggcgaaaatctggcgctcccggggttcaagcggattctcctaacctcaagcctcccgagtagctggggattacgggcattggggccaccacggccaaggctaatttgggatgacttttaaggtaagagagacgggggtttcaccattggtgggccagggatgggtcctgagagtctctggaccctcggggatctggcctggcctggggcactcccaaaggtggcggggagattacagggcggtggaggccaccatggccccggcgcccaagatgggagtttcacatttggcgcctttgggggtgaacgggtccaaaggggtgggtcttcctcgccaaagaggggggagggacttggaactcggagtagtgaactctttaaaaccagaagtgggggggaatatttcccatgtatggggcacacgacgtgcacacggggggaccttccgggaacggggcctccccataaattccaaggggatccaaaaacctcccccggggttggcgcgaagaccctttccccaataaggggggggaacggacagctcccattggagcagaggaagcccactgggggcgcatggagaggagctaacaactatttcctcgtaaatataaaagtgccacgggcaaacaaggggcggcggctccacgcagggcgacaaaaaaaggggggcggggcgggaacagaatacacaaaaaagaggaacaaagatggcggagaggacggcagccaaaaaacaaatacaacaagactcataaaaaaagagggaggaggccgtcccccaacaggaagaacgtccgacgaaacaatccgtaaaaaacgaggcacggacgcaccccaccccgacaaatcgcctagcagtccagtccatgtataagtttttatgtttatttcgtatcattctaatattgcaagaaaaaaagaagagacaaaatacacgan

SEQ ID NO: 616428 - DNA, 131 bp, Homo sapiens
gacttctcagacatagcgtcggactcggaggacactcagtttcactctaaagcctcggaagtcgtcagggatgactaataagtcacagtcgtagtctcggaggacatacagtcttgtcgccttgtaactaa

SEQ ID NO: 616429 - DNA, 1236 bp, Homo sapiens
  misc_feature (178)..(178): n is a, c, g, or t
  misc_feature (1236)..(1236): n is a, c, g, or t
agcgggtggtcatggcgggtgtgctgaagaagaccactggccttgtgggatcgcgctgctgtgcaatactcctcacgagacggctgacagcagagtcattgtgacaccaaagattcatcggatggtccgttggagggacaatccgaatacaaaagatgcagacgaatatagcaacagntatcacagcacacagagttgaccaagatgcagacagcctggcctactggctgtaacagtcggcacaccgagactgtctcaaacaagttagagagactcacggcttactacaggccggtgcagacttaagtagagaagagttcggcattcatctctagagcctggaaaacagtagacacctgataaactcctgcggcacaggcacatagacagtcgcattggcgagaatagggaaagacctactggaggggaagggctccaatgtgacgttgtggaaccgaaggcgcgttccgtagacgcgaactccaaggtaggaacacaatggccccgactatgtacacttgaactctcaccaggcgtggaacccgtgttcgcgagtaggtgctatccagtgggcggagacatcctgacctggctacacgtataaacatataagatgtctcgcggtttgggtacattcaaacgccaaggacgtctgcgtgtgcatgtagatgtaccccttgcaagcgacttaattgggtaacctacaaaggaaactaacagtttggcaattagttaacggacatgagacatactgggtatacaggaagtgaagcttgggactccacacagcttttgaggtcgaacttcacttgggggtgacacttattcggggtccagttggtgggaatgttccaacacttttaccgcggagtatccatctcaagggttacacttcagcggacgcccttgatttggcttttgccaaaaagagattacacatattctccgtgggatcgatacccacgcagaaaggggccatttggggcaacgcacttgggcaaataactgcagtccaaggggaaaaagcatgcccccttagcaaggaattgggccaaagcggcccggaaggacccaataaagccatgcccgaaggttcagcaacgtttgccccgagcacaagggaatgccacctggtaccaatcgagtagaagactacgaagggacacggccagaacccgtgaaggcacaggcgaagaggagccctcatatcgaacaagactagcgccgcagagcgcn

SEQ ID NO: 616430 - DNA, 142 bp, Homo sapiens
ggagttgagctacctgagatttgatattatgactcatagagctatgcaaatgacaagctgagtatgagtttatcagctctggtctcttacctagtgggttattgcacttgtcggaacaaagcttttctgatatgatgggaat

SEQ ID NO: 616431 - DNA, 394 bp, Homo sapiens
  misc_feature (26)..(26): n is a, c, g, or t
  misc_feature (37)..(37): n is a, c, g, or t
  misc_feature (50)..(50): n is a, c, g, or t
  misc_feature (84)..(84): n is a, c, g, or t
  misc_feature (384)..(385): n is a, c, g, or t
ccaatttgagctcaatattccccaanaattgctttanagttccttatgantcaggttcaacattttatgctgattttacttgcnccttaaacaaatagaaagtatattttctgggccgggcgcgggtctcacgcctgtaatcccagcactttgggaggccgaggcgggcggatcacgaggtcaggagatcgagaccatcccggctaaaacggtgaaaccccgtctctactaaaaatacaaaaaaattagccgggcgtaagtgcgggcgcctgtagtcccagctacttgggaggctgaggcaggagaatggcgtgaacccgggaggtggagcttgcagtgagccgagatcccgccactgcactccaccctgggcgacaagaagcnntccgtctca

SEQ ID NO: 616432 - DNA, 360 bp, Homo sapiens
ggaaccccctcccccccgggggatcccccccgggggtttgggtttttggggggtttttttttttccgggggggtccccccccccctttttttggggggttgggggggtttttttttgggagaaaccccccaaccccctttaaaaccccccccctttccccccctgggggggggtgggggggggcgtcttcacccacccccctttttttggaaaggttttcccccccggttttaaaaagggggggggttttttggggggggggacccctttttttttttggcccccccccaattttttttttttttttggggggttgtggggttttttggttttttttttttttttttttcccccccccta

SEQ ID NO: 616433 - DNA, 174 bp, Homo sapiens
ccgtggttgatctacgggaccaggcaacacatacagagctggtcattgagtcacggtttgtagttttgaaagagtagccgcttgtcattcttcatttgcaaagtcatgggtaggtaggctgatgtgtttatatgataaatcatttcacatcagttacaatgaacgaacaatatg

SEQ ID NO: 616434 - DNA, 412 bp, Homo sapiens
  misc_feature (20)..(20): n is a, c, g, or t
tctagcaggatccccggctnggattagcgtttagaaggactttcccaggtagctgggactacaggcacacgccaccacattcagctaattttcgcatctcttgtagagaccaagtacggctgtataggatagctggacacaaagctgtgggctcaagcgatctgtccacctcggcttcccaaagtggtggaattacaggtgtgagccaccgcaccccacccaaaggtatgaatcttgacatttatctgtttctgaaaaaagtgaatttatagtaaagaaaatgtgtatcagtaagattcgggtaggatttcaattaaataaaatttaattaaacattgtaaggaaatactttcatgttcttaaaaacatgtaaactttgtagtgatgctactagtgtctctctgaggcttcc

SEQ ID NO: 616435 - DNA, 2033 bp, Homo sapiens
  misc_feature (750)..(750): n is a, c, g, or t
gtgtttgtgtagttgcgttcgtgtgttctgcttttgcttgtcgtgtccgtgcggcgttccatgttgctggtttttctgtcgttgatgttgttgtggtcgttgtgtgggcttcgctgtccttctgtccgttgtgagctagtgtgtatagtagttggtgctggcttcgtagtgcacggtggtggttgtagcgctcgacgaggctctatgctgtgagtgcgtctatctgatgcgttgggtgcgtgctcgtgtgttgtttgtgtgttgttgttgggtcgttcgttgtggcgttctactgatcgtatgtattagcgtggtgttggtttgtgctgtcgctcgcctagtgtgttggtatattgaatttttgtgagttgattgttgttgtatgttattgtgttgttttggttgtgtttatgtgtggtgacgtgtgtgtgttttgttcgtgttgttgtgtgtttgtatttgtattggtttgtgttttatttgggtatgctgtgttagtgttgtgtcactccactctagtatgttagtatggttcccgggtgccctcacactgttggttgtagttgtctcgtttcactccccccgttgtgtgttgttggctatcagtcaccacatcacccgtctcgcgctgtgtggtttggtggtgggaccacactcctctgtatgattgtgtgacttcgcttcttaggatggggagtgtccctcccaccaccacaacgttggggtggtgcgcacactacctcaaaatgntagttactcctgcagcggttgtgtgttgtggttgtaaataccctcctcgccgctgcccccccccttttggtgtgtattagttgttatcctcgcgtgcgtcgcttcgattatgtgtgttggtcgatagttgcgctccacttcggtggggtgtgtggcaccacaattatgttgtgcggcggcaccccacacaagtgtggtggtggtggtggtctacccaacgaagagagagatgctcgtcgtgcgtcgtctctttgtgtgtggttttacttcttctcgtcggccgctgcggcttcttcacttccatggacgccgcgctcgcgtgtggcgtgtggttgtgttgtgggacactcctcttgtagtgacccaacgtggggggtgtcgtctcatcggggggccgcgtcgttgttgtgttgccgcctcttcgtctcgttgtcccgacgccgtcgtgtggtggtggtgtcgttgtgtggtggtggtgcacaacccccccatcctcctctcgttggtggcggcatcacaacggcgacgccacctcctcactcgtgttgtctccacgacgacgcgacgcgggtggtggttcatctctcgtcgtcgcgggggtgttttcacctcacacacactcgtgtgtggcgccgcgcgcgctctccctccgcgcgataacacacccccccccgcgctttcatctgtcgcgcgcgcgggatacacacgcgggtggtctccgcgcagcacacacactcgtctctctcgtccccctctcgtcgacgcgcgcggcggctcccccgcgcgccacctcgtcggcgcgccgcgtgtgtgtcacacgccgcgcgccacacgccgcgtgcggcgccacacaatattgtgcggcgcgcgcgcgcgcgcgccacataccccgtccttcgctcactccacccacagcgtgtgtgtgtgttgtgcgcgccctcgtcgcgtgtggccgcgcaggcacccgcgggccactcacacacccccgcccacacggggtgaacacactaccacacatgtgttccacacacgtcgtgaacccgcgccacacaagtggggggggagaacacaacaccccacccgtgtgcacgaagaagaacaccccgcggagaccccacccgcggtgtgtggcgccgcgggccacaccacccggaaacacccccccccccggggtgtgtgtgtgtggccccccccccccccccctgtgtgtgtgtgtggggggaaaatatatccccgtgtgtgtggagaaacatatataaaataaataaaaataaaaaaataaa

SEQ ID NO: 616436 - DNA, 152 bp, Homo sapiens
tgacggctctcttagtaactcctgtcaagtgatgatggaattctattctacttttgcagtagatccgagtacaggtgacattgttcatgacacactccaccactaattacccatcttatcaattttctatgtctattgctgctttccttccc

SEQ ID NO: 616437 - DNA, 1826 bp, Homo sapiens
  misc_feature (17)..(17): n is a, c, g, or t
  misc_feature (1691)..(1691): n is a, c, g, or t
ggttgatggtgcagccntaatatctcacgtggtgattcgtacctcaaagcctcgttgatttgccgagatgcacatatgtccccgctgatgcgggactctttatgcgggatcggacgaatgatgaaacgatactcaatcttgaagaccaaggccagaacaacgtctgccctacatcttagagggagactcgaatggttgctgcgagtaggtgtgtgcaatgcggtaattaggcttgtgtgtaccatgcatggcaaggtgtgttcattaagcaaacaagacacaagatcctatatgggagcaaagaagaaaagctgtgcagcccttcgtgcctttagagaggagagactaaagggagggttctaaccgcgaattgagtcttccaagggtccgatgggaaagcaaggctagcaaagtaagttgattgtcaacgagatagcgcccaaaggggaagaccagggtgggattgccgaacgtctagaaatcgaaatcccccgttatcactataggttctccaaaagaagcgatatcatatctttgggtccaacgcttgtaaaaacgaacctatattgtcagtaccgaaggttataacgagcggggtcccgaaatgcgtgtgtgaagggaaccaaaaaagggggcatgggagttggacgtgagggaggaccgttgtcttaacccccaatgttcacctcgttatccaaaaacccctgatgtgtttttgccggtgtgacatggaggacgtgcaaggtgtcctcggaaagcgtaagaagttttcctacctggaggtttgcaatcattagcggcctcggggaagtgcttaggggccggttcccacaaaaaccagagtaaaggaccggaggttaggggggacattgagagggagtactatctgtcggaggctccaaacttaaatggctctttagactcttggttaacggccaacgggtgcatgggcgacccttgagaacctgagatctcacgagaagaggggtccacaccgacaaaaatctctggcggagggctggcgaagagggaagaaagtcgccacccatggaatattgcgctatgtagcccttttccttcagagggggaatacctccgcagtggggccacaaagggttaggccatttttcggcctgtattcaaggcactgtttctggaagccttccgtcattaacaacagcgccttgcaaagacaacagtttcaccatgtgagagagaagcgttcggctgactttttgttctcattcactacaagtggggaagctttgcgcggggtgctattacaccggagaaaattcctcttggttatcacccctcgaggccccctgcgggtcacaagtagctccaacgaagttgtctttaaatagatagtggtcgctcagaggtatcccacagctgctccatgggtggcccacctagagcggccactgtgcgtcaccggggttataggggcatcatatcaacaaacatgggagtttgtttataggccgccaaaagttaaaggggcgagaggaaaaaagcgggtgttgaaatccaactgttgttgtcagaacattgttgtcaagacaggggtcttgtgtgtcagaaatcaacagaggaatgttaacccatctcatgtaggacaacaatattgagaaggattgagcgactaatatgtgtgggtagaacaacaaagttgtggtgggagcacncccaaatcggtaggtggggagtagaagataattatatcagtatgaaagaagatagtatataaaccagggtgaagtaggaagaaaagaagaagtgtgggttgtatactaggagacgtgctgcatggatgtaggata

SEQ ID NO: 616438 - DNA, 341 bp, Homo sapiens
ggctgattagaggatcccctcctcaggaagcaggagctcaggctgatggggcattaggcctttttatttacctgaaatgatggcccaagctgggtgaggcttcacagatgtgagaagcagctggcatcacagtgggtggagcggggagctggcagcaaggcttggttggttcttggccccacctgtgcagcttctgcggccccgggtgtccatttccacctcccgagattccttgggcccaggcctgtagtggacacaagcaggtcccggacacacagccaagcagatgcgcagccatgtagacaaggagcccaggaagcacacaggctgaccccgtgaca

SEQ ID NO: 616439 - DNA, 168 bp, Homo sapiens
  misc_feature (9)..(10): n is a, c, g, or t
  misc_feature (20)..(20): n is a, c, g, or t
cttcttaanngcgtcctttnttgcgaagaaaataatcaaaaataatcaaaaagttttctagtctttattgtcttacaaccctcttctatttagacggaaaactttggtttataaattataaaagtattacaagttatgtgagtccgtttacgtgactctgtcgtctta

SEQ ID NO: 616440 - DNA, 198 bp, Homo sapiens
ccgctctcggaactcatataccacaagtgcagccctaaaaagcaaaaaaataaaaataaatcaaatagttgaccttggaaatagacaattaaattggtggttaccagaggaggttgtttcacttgggccgcgttggtatacaaactacttgcttgcctgatggtgatacttacgcattgtgttagcctatttcctctc

SEQ ID NO: 616441 - DNA, 593 bp, Homo sapiens
aatttatggggagccaccccacctttattgcagcaaaaagggggtaggaacaggcaccttaggactggcccaggggtgttctaaagcccccctggggttggaaaaaaacggatcggaaccaaaaatggggggaagggcggctcccaagtcccaacaaaaatcctaaaaagttaacccggtcccctccacccttcaagaaaagggggggcaacggcccccttaactttaaaaaaaaaaacctggccccggccctaaactctgggactttgaccctttcacaaaagcccttcccaaaccaccacacggggggaataacctgaaaccaacctctccccaaaaggtcctttaccgtgaccaaacaaaattcttaaaggttcaaaagtggggaaaacaaaaaggtccaaaaaacactcattggaaaacagggagagggcgcccaacaaaggttcattaccccgggttctcgcccccccacaaatgcccaaaatcgcggaacaaaaaaaagggaccctccccaaaaaaaaaaaataaagcccgcccaatcccgggcgcaggcggaaacagggcaaaaccgttatcccggaaaaaaaccg

SEQ ID NO: 616442 - DNA, 338 bp, Homo sapiens
ccgcgtcgacatcagcgcccaagcagcgtgaatcatgctggtggttgtgatgtcttgggcctgtcgcgccagcatggagaaattgtgctgaaccaccttgttggtcagaggctgatcaatgaccggaggaagagtcgggaaaggcagagactcgcaagaatccagcatccttcgccagtacacagacatcgcttcctcatcttgggccctaacatgtttgatgaaagactgaaacagaggacctgaatcaatggaaccgccttgaaaggctgttcgcatcgcgtctttgatcaatccaatagaccacccgtcgtacaatgcatggtgcgcgtcgacgc

SEQ ID NO: 616443 - DNA, 141 bp, Homo sapiens
ttggccgctccgtcttttggctgtgctttcttgagtgcttgaacctggatacactctactggcttctgtgcagtccttcctaacatgcaacgctgtgagtccaactcctcagtgcaatgccctgtcttcaaggtggatcct

SEQ ID NO: 616444 - DNA, 682 bp, Homo sapiens
cctgcaatcattaattagcaagtattgaatgcccccacccttcctcttcctgtaaagtgctctccgttttgttgttgttccccagcccaggcccccgccagggcagggaaggaaaggtatggccccggaatggtgggcccccaaacgtatgaatctactttcaagcaatcttttggtgcagtaattgttggtcccagccagcagcctgcacatcgggcccagtcggagttcagcttccgcctctcatctggccgcttcttcatttaccacaccactcctcccacatcccatattttagaccacaagaccagacctccgtccttcctccacaacgctccccccccccccccccctccgtcagcaagaaagaaaaaatataattaagcagagccaaagcaccacatgattaacaccatagttaaagagattactcacacacagaggactgatatttctgatcactccgctgtgtatttttcttccctatctatgctactgagtgagcgtgtgtagacacacgcctccccccccccattgtttgtttaaaacacacacactgatagtagtttctgtcttctcacacccacttttctccgctacctatctcgctctcactgagtgtgtctctctccaacaagacaaaaaaaagagagaaaaacttccacaacaaagacacagaaaa

SEQ ID NO: 616445 - DNA, 106 bp, Homo sapiens
tattacagtatgcggcattcggctaccttaacatgagtcatagcttgttccctgtgttaaaccgcgcttcattgaatttcttcactttgacattcagagcactggg

SEQ ID NO: 616446 - DNA, 671 bp, Homo sapiens
ggccgcgccgaggattcagcagcctccgcttgagccctcgttccgagtcgacccctgcgccctccgcacgcgcgcgctcgaggcgttcacgagaaaggatcgtcgttcgtatcagaactccatctttcgacctttgtgatgcaagtagggtgatgacctgctcctgctggcactgaggattatatccatatagaattcaacagaaaacggaggaagaccttactactgtccaagggatcgctgatgattacataaaaagaactatgaaggcgttacaaaagtttgctgcaatggtactgtaatgagcatcggaatatggagaagtatcagctacggtgacaagcaaaacatatgccatctcgaagatgactgtaggacgatcatgacaggtcatggtcagtgcttgtggctcactgaagcttagtgaggattccttgcaatgagtagaattcccttctctccttgtcacaggtttaaaactcacgctgtatagtaccattgggtccgtttacttgatatgtaactcttcatcataactgaagagctcaaaaaaaaaaactcgggctctattcgtgcggaaaaaggtagaggcactgcctgctttccctgaccgtttttgccattgtaaactggggcccaataggagcgataatgaagcaggacctgctata

SEQ ID NO: 616447 - DNA, 169 bp, Homo sapiens
ttcagcaaagcaaaaaaatcagcagcgcacagataaaagagaacgaacggcacacagaagacaaggccagacgaaattaacaagcggttagaagaacccgaagaaactaaagtgctaacaccacgaagaacacttagcagataaactgcgactgcttggattacaagga

SEQ ID NO: 616448 - DNA, 192 bp, Homo sapiens
tccccccccccccggggggggggggggggcccccccccccccctttttttccccccccccccccccattttggggcccccccccgggggggggccccccccccgggtccctttttttccgggggggggggggggtttttttttttttttttttttgggggggttttcttccccccccccgggggttttttta

SEQ ID NO: 616449 - DNA, 122 bp, Homo sapiens
tgtttccccatcttaattgtattgttttcccaagtgtcattttcatgcgttttatatcttcctaattaaggtgtgagtccgtttgtctgaactaagctgtctagactttctggagtgataat

SEQ ID NO: 616450 - DNA, 326 bp, Homo sapiens
aagaaaaaaaaaaaaagaaaaaaacgcaaacccagccaaagggcaaaggtgccgggggcagagtccgggagcaaaccaggtgcacgtccggagagtctctccccagcagagccacccctcacacacggctcagtagggcagccacaagccacacgtggccggagagcattaatttcaaaaggggcgggggtgaatcgagatgcgatacaagcataaaagtgcataggtgggtccaaagaacttagtatgaaaaaaataacacagaaatagctcagtgaataatttaaaaaatggggttagttgaaagtggtcgccaactccgggga

SEQ ID NO: 616451 - DNA, 490 bp, Homo sapiens
tggattttcatttcttcgcacttctgagacggcaaagccaaccacttagaagccttccacatctttgtcacctgcctggctcctgctctctgatgtacctctgggtagtgagatgaaaatggtgcctgcagaagttggggaaaaggatactttttgcccagcttccatgatgtctttattgcaaatatggatgacaagggtctcttgttacaggggccctcagaagcacctttcgtattcttcctctaagaccaagggacagtgtgtatagtataaggatctggcaatccagagacctcagacatcacaaagtatggatctgaacgtgggtatgtgctgacagggcacaataactatacggtgaaagaggaattttcatacaatacgagtttattgttttgatgggtaaggagggctatatacatcacacactgacttattataatcctgccaataaaatagtcttaaaattaaagatgtttacgctaaa

SEQ ID NO: 616452 - DNA, 113 bp, Homo sapiens
cactcacaggtagcgcccactcacagcagtagccgcatctgttgttcagatgctcttgatgaggttcagagcctcctgcaggcggttggtctggttgtcctcccggctgacca

SEQ ID NO: 616453 - DNA, 1058 bp, Homo sapiens
  misc_feature (212)..(213): n is a, c, g, or t
  misc_feature (217)..(217): n is a, c, g, or t
  misc_feature (242)..(243): n is a, c, g, or t
  misc_feature (247)..(247): n is a, c, g, or t
  misc_feature (253)..(253): n is a, c, g, or t
  misc_feature (259)..(259): n is a, c, g, or t
  misc_feature (276)..(276): n is a, c, g, or t
  misc_feature (373)..(373): n is a, c, g, or t
  misc_feature (375)..(375): n is a, c, g, or t
  misc_feature (396)..(397): n is a, c, g, or t
  misc_feature (448)..(448): n is a, c, g, or t
  misc_feature (468)..(468): n is a, c, g, or t
  misc_feature (637)..(637): n is a, c, g, or t
  misc_feature (719)..(719): n is a, c, g, or t
gtaggattgaggaataccctagcacgatccagagctctcgacattcagtttgcctccttcatcgactaggtgcggttcctggagctgtacaacaaggttctggacaccaagtggaccctgctgcaggagcagggcaccaagactgtgaggcagaacctggagccgttgttcgagcagtacatcaacaacctcaggaggcagctggacagcanntgtnggggaacggggccgcctggactcannagcncacgancatgtnggacctggtggaggacntcaagaacaaatatgaggatgaaatcaacaagcgcacagcagcagagaatgaatttgtgactctgaagaaggatgtggatgcgtgcctacatgaacnanggttgaactgcaagccaaggnnagacactctcacagacgagatcaattctgagagctgtatgatgcagagctncccatgcgaccacatctcangaccattgtggtgctgtccatggacaacaaccgcaacctggacctgacagcatcatcgctgaggtcaaggccaatatgaggagatgctcaagaaccgggctgaggctgatcctggtaccagaccaagtacgaggagctgcaggtcagcagcagacatggggacgactgngcaacacaagcaggaattgctgaatcaaccgatgatccaggctgatctgaatcgacacgtcaagaacagtgcgccaacctgnggccgcatgctgatgctgaccgtggggagatggcctcaaggatgccaagaacaagctggaagggctggaggatgccctgcaaagccaagcgactgccggctgctgaaggagtaccaggagctgatgaatgtcaagctggcctggacgtggagatcgcactacgcaacgtgaggtagatcagtgatggaaggtggaagtaatccgtgtgcaccacgccatgctatggggcatgtgtgcgtgctagtggtgagagcgtatctatgagtgctgggtggagtggttcgtccacagtgcaacctgggtgctatctgtgaggcgtcccataataacaacttcttc

SEQ ID NO: 616454 - DNA, 331 bp, Homo sapiens
cccatgtgctaggacatagggttgctagctagagagtttgcagccatcttcccccctcctaggtgctaatgcctaatttcctaaagtaatcggaatccttataagccaggtagctcaggaggttctatttacttatttatttattttgagacagagtctcactgtgtcgcccaggcagatctcgtctgggcccgagtctcgttgcagtggtgtaatctctgctcactgcaacctctgcctcccaggttcatgcaattttcctgtctcagcctcccgagtagctaggattacaggggtgtgccaccacgcctggctaatttttccattttta

SEQ ID NO: 616455 - DNA, 598 bp, Homo sapiens
acggtctgtaccgccaggcggatgctgtccaggcgcccggcctggtattcgcgcgccagcaacgaggcgagccggtgaggatgtcattggcgaagttattggtggcgccgttgcgcgcaaattcttcggcggggataaaggctcgcacttcctccgggcacggctggcccttgaggtgcgcagccaggcaattgacgtaagccacgtgacggcgcaacagcgtcgacttcaccgggttcacctcaccaggggcgtcatcgagcagggtcaacacttgccgagcaaaactgcgcgagttgttgaccatcgcaccccacagcgtgcgtgcttcccaccagcggttgtaggcgctgctgttgcgaaaactgatcagcaccaccagtgccgagccgagcaaggtcaggggcatcagcggcaaattgatcttggcggtgagaaacagcatgaaatccaccgtcactgccacatcccacaacaacagccagaacaacgcccagcccacatagcccatggtcttgatgatcaggcggtatttcttcagaagggcagctttcaaacgagaacctcgcggtggggcggtgggcacaatcccctgtta

SEQ ID NO: 616456 - DNA, 1006 bp, Homo sapiens
  misc_feature (160)..(161): n is a, c, g, or t
  misc_feature (165)..(165): n is a, c, g, or t
  misc_feature (190)..(191): n is a, c, g, or t
  misc_feature (195)..(195): n is a, c, g, or t
  misc_feature (201)..(201): n is a, c, g, or t
  misc_feature (207)..(207): n is a, c, g, or t
  misc_feature (224)..(224): n is a, c, g, or t
  misc_feature (321)..(321): n is a, c, g, or t
  misc_feature (323)..(323): n is a, c, g, or t
  misc_feature (344)..(345): n is a, c, g, or t
  misc_feature (396)..(396): n is a, c, g, or t
  misc_feature (416)..(416): n is a, c, g, or t
  misc_feature (585)..(585): n is a, c, g, or t
  misc_feature (667)..(667): n is a, c, g, or t
agctcaatgtgtggtgtagttatgttataataggcggagattatgcctaggttcagaggcgctgtgttatcatgtgtcagggcaccaagactgtgaggcagaacctggagccgttgttcgagcagtacatcaacaacctcaggaggcagctggacagcanntgtnggggaacggggccgcctggactcannagcncacgancatgtnggacctggtggaggacntcaagaacaaatatgaggatgaaatcaacaagcgcacagcagcagagaatgaatttgtgactctgaagaaggatgtggatgcgtgcctacatgaacnanggttgaactgcaagccaaggnnagacactctcacagacgagatcaattctgagagctgtatgatgcagagctncccatgcgaccacatctcangaccattgtggtgctgtccatggacaacaaccgcaacctggacctgacagcatcatcgctgaggtcaaggccaatatgaggagatgctcaagaaccgggctgaggctgatcctggtaccagaccaagtacgaggagctgcaggtcagcagcagacatggggacgactgngcaacacaagcaggaattgctgaatcaaccgatgatccaggctgatctgaatcgacacgtcaagaacagtgcgccaacctgnggccgcatgctgatgctgaccgtggggagatggcctcaaggatgccaagaacaagctggaagggctggaggatgccctgcaaagccaagcgactgccggctgctgaaggagtaccaggagctgatgaatgtcaagctggcctggacgtggagatcgcactacgcaacgtgaggtagatcagtgatggaaggtggaagtaatccgtgtgcaccacgccatgctatggggcatgtgtgcgtgctagtggtgagagcgtatctatgagtgctgggtggagtggttcgtccacagtgcaacctgggtgctatctgtgaggcgtcccataataacaacttcttc

SEQ ID NO: 616457 - DNA, 107 bp, Homo sapiens
caggattcgcaaacggtggcatcttcgaacaggagcatgaaggcagcatttattacccccattgtaagttcatagctattaacattagaatcaagaagtgcatccat

SEQ ID NO: 616458 - DNA, 231 bp, Homo sapiens
gtctccccactctctggaagcccaggacacctcccaaggggcgcccacaagacctccacaggggcagtctcctcagtaatctaggattcattgacaggcagtgaattagacagatgaccagtgtttcacatgccttgaaacatatatgttgatcatgctctaactttcatttacccaataaaattaatccgattgcggtgttttggggtacccggagctcggaaattcggt

SEQ ID NO: 616459 - DNA, 265 bp, Homo sapiens
  misc_feature (93)..(93): n is a, c, g, or t
ttaaaaaggattaaataggcagtagcaaatattattgtacagaaaaaggtttctgtggtcatccactgtgcccttctttctaatcagacacanctggaggggtgtacagttcactataggggcactcggcgaatcttgaccattcctggaaaaacagctcgaagtatgcatcttattaacaacaggtcattgatgtcatctttggtttcaaaaatcaccaccgttcctccatgagaagagtgaactattctttcaggggttctgt

SEQ ID NO: 616460 - DNA, 454 bp, Homo sapiens
ctctacaggatccccctccacacagcactaggattactagcgttatgcctctgtgcctggccatactctactttgtcatttgtctgtattgatctgaacaatttttcacctggttcaagtgtttttgcagcttcgtggtgttgcggagctcttggacttgtttactccttttctatttcatgaagcccacagttactgaatgggatattgagttataaactaggattcgagggagaggaccacaaggatacagagttatacctgtcatatcttcttatgcactgagcgtcaccatatattgtttgttgcgtgacgatgctcaggttgtcttaagatggcgtcacacgctttgacttttaagttcgactcttctatgtttgaattttggctgtgatacttgctatgtgattttctgtcacttactttcacctttggggccctagttgctgtgttg

SEQ ID NO: 616461 - DNA, 144 bp, Homo sapiens
taccctcgttttggacttggtggttcttccattgaccacattctctctgacttcaaaatcatgctcattcagcatttttctttctttaatagactgggtcagccgagaaatagctaactacccattttcctcccgcaattcctt

SEQ ID NO: 616462 - DNA, 893 bp, Homo sapiens
agcggaattgctcctgagacccaacaggcagcaacggtcccaagggtgagggagtgggcagggagaggctgatggggcttctacacgttccctcccgtagctgggctgctgcagctcgttcgccccagaggcgcgcggtgtccttgagtccaagtattcagcgcggacgtttgggggacggagggagaggcgctaggggaactggcacctaagactgtgtaataggacacaggtcttgcaagtcctcctccccaggcaccgcccctgtgctcccagcgcctctttgcagctttaattatcctttcagcgccgttcccccgcggctgcgtttccgtggtcagaggaaaaaggctctttcgcctcccggttctcaccctcatacagaccctcctttcagacccgccctcctgttcacagggacccatttcggagccctggctcacgctgggcgggaactgccgtgacgaattccccccaaggtgttgattatccatcccaaccagcctctggctttcctcccactccaacccagtcccaaggccctcgcccgttcatcggtggggctcgagaggcgcccccagatctcccaacggcagggtcccagctgcagctgagagaagaagcgcccggcgtgcgcggtgccacgtcgaattgggcctggggacgccggaaggtggccgagagagcacgggggcccccagacggccggctacgggcggaacgagggggggccggaacgaagaagggatgaggcccacaccgacatatggggccccgcgggagggacggccaattggcccgaaacaaaacttgccacacaaacaacaacggtgggcaagcacagtgagagcgacacagagcggccaacaggagcacacgaggagaaacgagca

SEQ ID NO: 616463 - DNA, 356 bp, Homo sapiens
atggccgggtcaggaaggagatggaggaggaggattgagcccagaattaactaggttcgaatccagagagcagtgtggaaaaaaaaaccaaaaaccaactgaccagttgtggatacccactaagagtctctattaaaattacggatgcagaaggaccgtgtgtgaaattctctttcctgaagtcccatggaggaactttacctgaaacaacccaaggggcccttttctttcttctgaggatggcagaggatatagttatcaatctctagtggtaactttcctcttccactttgataccatggggtcatggaatataactttttccaaataaagttttatgagaaaggccagtgtgc

SEQ ID NO: 616464 - DNA, 474 bp, Homo sapiens
catctgccggtccaactacgccgagtcctccggctacaactataacatcggcttgtccatgccttacgacacactgagcggcccttagactccatggggctcttggatgactggtattgctacctaaggacaatctggggtcacatcgctttaaagtcattttaacagtaatgtatgtgttttatggccagattatagatatatgcgtgcctgtgttaacaggccatttcaaacacatgactttgattctacatttagtgtttttacttattttatcattttctgtgcctgtacattttagtgtacagtaatattagatctccatttaggatgataaagaacacaaatgatgcaaaatgaagttttgttggtttatttactgtcaataattcaacagacaaaactcagtcattgattgtttaggatattaatagtattaggtttctaaaataaaagaagacgctccaatatcga

SEQ ID NO: 616465 - DNA, 348 bp, Homo sapiens
tacatgatacgactcgagctcggtacctgtgggtagcaagcaacctagggatcatttgcaggtggtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggctgtttgtgattagctgtctctaacaattgttcatacaataattgttcattattgttctcaacttggggctctccccaacctggggacccttcctta

SEQ ID NO: 616466 - DNA, 121 bp, Homo sapiens
cacagacttcatccacacttcaggggtgtctaggccaacaagcgcctttaagagatgctggtttgttattggcatcacggcgagatgacagcagccactgcttcatcacactgactcacat

SEQ ID NO: 616467 - DNA, 631 bp, Homo sapiens
acgcagacctgattttggcgcatactgcgagaattagcgtatcaccgctagcgagctggaccgattgcacaatgtcatgaggatcaagttactgatggctaactagatctggtccgaggctatgaatggaccagcgtgcagtggtaagtttgtactcgactctgtaaagcttgcccgcatgctgattatgcgagagcatgatcagagccgtgacgatgagctgaccagcatcatagtacacgtgatatcagctacagaatgttcacgtggatcaggtaacaatggccatggatgtgtacgtcatcattttctagaaaggacctgtgcagctgcatatatcatggtcgcagggtatattagttacagagctctagcacgcgcaggccttgagcatgacgggttcacggctctacttctaagatcagcattcatacatgagcagaattgatcatgaatttgccagttcttcgaagtctcccctgaatgggttttactaacactgatgaacttaactctggcccttggcctcaaccttgcacacttgcccaaccactctaccacacctaggcactacctcacctctgtataaccttttaccttagcaccctactctccccttgcgcttctcccc

SEQ ID NO: 616468 - DNA, 314 bp, Homo sapiens
catttgtcaacccagatttctactgaacctccagctttgcttctgtagatttggcatttggtttgaaaattttgctgattgtcctaatttcaagagactttacgtggaaatcaccttttaaacccacagctagcaaacaactattttatttgcactaaatagctagctttaggctctctctgggttagtttagtatgcattgccttggcttcagtgttgacagcaggagagactgtgataaagagcagaggtaggtggggtgcagcccttccttctggaaagttgaaaggagaggaaagggcggggcatagtgc

SEQ ID NO: 616469 - DNA, 756 bp, Homo sapiens
ctcgtgccaccctagcagtgtacactgtacccaatgtatatttatccctcacccccctcttatcctttcccccgagtcctcaacacccattgcattattcttatgcctttgcatcctcatagcttacgtcccacttatgagtgagagcatacggtgtttggttttcgattcctgagttacttcacttagaataatggtctccaaatctatccaggttgctgtgaatgacattatttcattcctttttatggctgagtagtattccatggtattccatggtatatgtatgtgtgtgtgtgtgtgtatatatatgtatacacacacatatatatatacatatatatacacacacatatatatgtatatctacatatatacgtatttacgtgtatatgtatatatacatatatacgtatttacatatacacacacattattccatggaatactcttatatatatacttatattttctctatccacttatcgattgatgggccatttggctgcgtccatatttttgcagttgcaaattatgctgctattaacattgctttggaaatatctctcttgaataatgacttcctttctttgggtagatacccagtcttgggattgctggatcaaatggtacatctactggctacttgcagttaactttacattactctaccttacggtcctctctatcttcagatcgatcctgccctttacccatgacgtaaacctttcagtgcgcccgaacttcccatgcttt

SEQ ID NO: 616470 - DNA, 169 bp, Homo sapiens
cctcccccgcccctacccctcagggataatgagttcattgctgggctagatgttttagccatgattctgcctctgttttatacctgcccacggccttatctttggtacatatgaaaaatcctggatcccgggtgatattgagaacaaataaaggtggagaggccttcca

SEQ ID NO: 616471 - DNA, 247 bp, Homo sapiens
tttccaagggctaatcttgagacagaaagacaagcctggagaaccagtgcaaaattccagagattacctcaaggcagctagtcaacaacccggccattgttgccagggtggactgagacccaagatagcaaccaaacaagacacatggatcttgtactcagcacaactcctgcatgcttcacatgtcaagttcctcttattttttttttttttttttaacagaattggttcgggcgccagggatgac

SEQ ID NO: 616472 - DNA, 498 bp, Homo sapiens
tactcaacaacttcaatcagatcactaaatcatacaccttttacttccaaatgatgactgttcttatatccggagttatttacttcattattttggatcacaatccacaaacgattttttttttttccacaatgttttttttggaccaacttctattatcaataccaacactgtgcacatcattccaccacaatattttataggaggagctatctgcaaccacacacatgtgagcttttcttcctcctcgactaatatcaccaatcagtgatatcaacaatctccttgattccatcaacaataccgttttttctcgcccgcaagagtgggtttctatttcgacacacggggctcccaacgtttgttgtagatagacacacaccgcgccaccataatattgttatcaccccagggcgttttacaaaatttttgggggggctttttttgccccctccccacacgactttattgaatataaaaaaaatataaattaattta

SEQ ID NO: 616473 - DNA, 630 bp, Homo sapiens
gcagaggagggctttacccaggtcacccgcaagggtggccgagggcgaagaaacgacaggctgaacagctgtccgcagcaggagagggcggggatgcgggccgcatggacacagaggaggccaggccggcgaagaggcccgtcttcccacccctctgtggggacgggctctgagtgggaagagaacagaaatcagtccagtaaagatacacaccattgaaagaaaactggatgaagatatttactcctattgggaacattgggacttcagatacgcttaattgaaatcaggaatgtgaaatcaggactgtaaggaaaccaaggatgttagtgctctgacaaaagcagctgattgtgaaagctttatctcggttcaggtggaggatgcacttgcctcatcaggtgatgactcttcctagagtctttgaacttaagatgttaagccctaaggggagaccatctatccggcataggaagaacgctggaaaggaggaaaaacaaattcccataagaatgtgaccggacaaggatagttggtgatgtgaagttcacatcttggtcttccaaatatcgatggaagaatgcattgacctaatcttggaatctcctccagtacaggatatcgagctgg

SEQ ID NO: 616474 - DNA, 109 bp, Homo sapiens
acagctgaggcaggacagcagtgcctctgcttgtcctgcctctgctgcttgtcctgcctctgcttgtcctgcctctgcctcccaagtaactgggattacaggcatgtgt

SEQ ID NO: 616475 - DNA, 221 bp, Homo sapiens
  misc_feature (7)..(7): n is a, c, g, or t
atcgagnatcaaggtacgggggcagagatggagagtcaaaggaagacaaggcaaggcaggatatcaccaccaacacctacacatctcaagagctcaagagtgcactggcaaaatgcaaggagggggcagagatggagagtacaaaggaagacaaggcaaggcaggctgaggtaaagcggctcttccgccccattgaggaactgaagaaagactttgatcag

SEQ ID NO: 616476 - DNA, 146 bp, Homo sapiens
ccaatctgaagtggtctttttaggttgcctgagtggtaacatgtgcttttcttctaaccttccggcccaagatgacagcatattaaagtgagtgaccctgcgacccactctttggaccagcagcggatgaataaagcttcctgtgt

SEQ ID NO: 616477 - DNA, 2529 bp, Homo sapiens
  misc_feature (1348)..(1348): n is a, c, g, or t
  misc_feature (1420)..(1420): n is a, c, g, or t
  misc_feature (1423)..(1423): n is a, c, g, or t
  misc_feature (1429)..(1429): n is a, c, g, or t
  misc_feature (1432)..(1432): n is a, c, g, or t
  misc_feature (1434)..(1435): n is a, c, g, or t
  misc_feature (1488)..(1488): n is a, c, g, or t
agcggagtggcagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattgggcggttattaagaattttaggacgaaatgatgatgattcaagtgaagctatgaatgatatattagcacaggttgccactaatactgagactagataaaaatgtaggaaatgctattcttaatgaaacggttttgactatcatggatattaagtcagagagtggattgcgagtcctagccataaatatcctgggtcgtttcttattgaacaatgacaagaatattagatatgtggctctgacatcttngttgaagactgtacagacagatcataatgcagtacagaggcacagaagcacaattgtggactgtcttaaagnttnggatgnctnannaaaacggcgtgcaatggaattgagttttgccctggtaaatgggaataatatcngaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgaggcagtctggagctatttaatacctgggaaaagatagaggcctcagggaaaaactaaactgaacccagactttccagcacgtgaatcatttgaagatgggagaggctaaatcagaagcaagagtcaaatcttcacaatatccgggttatatgttgtatactaataatgctcta

SEQ ID NO: 616478 - DNA, 764 bp, Homo sapiens
  misc_feature (429)..(429): n is a, c, g, or t
  misc_feature (445)..(446): n is a, c, g, or t
  misc_feature (458)..(458): n is a, c, g, or t
  misc_feature (460)..(460): n is a, c, g, or t
  misc_feature (474)..(474): n is a, c, g, or t
  misc_feature (477)..(477): n is a, c, g, or t
  misc_feature (481)..(481): n is a, c, g, or t
  misc_feature (486)..(486): n is a, c, g, or t
  misc_feature (488)..(488): n is a, c, g, or t
  misc_feature (495)..(495): n is a, c, g, or t
  misc_feature (504)..(504): n is a, c, g, or t
  misc_feature (507)..(508): n is a, c, g, or t
  misc_feature (512)..(512): n is a, c, g, or t
  misc_feature (525)..(525): n is a, c, g, or t
  misc_feature (533)..(533): n is a, c, g, or t
  misc_feature (539)..(539): n is a, c, g, or t
  misc_feature (541)..(541): n is a, c, g, or t
  misc_feature (547)..(547): n is a, c, g, or t
  misc_feature (554)..(555): n is a, c, g, or t
  misc_feature (562)..(562): n is a, c, g, or t
  misc_feature (568)..(568): n is a, c, g, or t
  misc_feature (571)..(572): n is a, c, g, or t
  misc_feature (575)..(576): n is a, c, g, or t
  misc_feature (583)..(583): n is a, c, g, or t
  misc_feature (585)..(585): n is a, c, g, or t
  misc_feature (593)..(594): n is a, c, g, or t
  misc_feature (601)..(602): n is a, c, g, or t
  misc_feature (605)..(605): n is a, c, g, or t
  misc_feature (608)..(608): n is a, c, g, or t
  misc_feature (612)..(612): n is a, c, g, or t
  misc_feature (616)..(616): n is a, c, g, or t
  misc_feature (618)..(618): n is a, c, g, or t
  misc_feature (624)..(624): n is a, c, g, or t
  misc_feature (628)..(628): n is a, c, g, or t
  misc_feature (631)..(631): n is a, c, g, or t
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgaaaaaaaaaaaaaaaaaaaaaaaaaaaaaaaaaaaaaaaaaaaaaaaaaaaaaaaaaaaaaaaaanaaaaaaaaaaaaaaannaaaaaaaaaacntngtgggccgcttggnccnaggnatttnanattgggnaaggtttanccnngcgnccgaatttggggncaattggncaattncnccctanggggggnngattacnaatcanggnncgnngtttaanancggggganngggaaannccnggnggtncccnanttaaanggcntgnaaaaaaatacccttttttgccggtggggggaattaccgaaaagggccccgacccgaagggcttttccaaaaaagttggccacacctgaaggccaaatgggaaatgtgagggcgttaattttggtttcggcggt

SEQ ID NO: 616479 - DNA, 2436 bp, Homo sapiens
  misc_feature (1255)..(1255): n is a, c, g, or t
  misc_feature (1327)..(1327): n is a, c, g, or t
  misc_feature (1330)..(1330): n is a, c, g, or t
  misc_feature (1336)..(1336): n is a, c, g, or t
  misc_feature (1339)..(1339): n is a, c, g, or t
  misc_feature (1341)..(1342): n is a, c, g, or t
  misc_feature (1395)..(1395): n is a, c, g, or t
agcgggtcgctcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggcagaccccgaggcctcggaccgggaggttccgcgcgccgcggcgttccgtgttgtggcgttgccccgccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattgggcggttattaagaattttaggacgaaatgatgatgattcaagtgaagctatgaatgatatattagcacaggttgccactaatactgagactagataaaaatgtaggaaatgctattcttaatgaaacggttttgactatcatggatattaagtcagagagtggattgcgagtcctagccataaatatcctgggtcgtttcttattgaacaatgacaagaatattagatatgtggctctgacatcttngttgaagactgtacagacagatcataatgcagtacagaggcacagaagcacaattgtggactgtcttaaagnttnggatgnctnannaaaacggcgtgcaatggaattgagttttgccctggtaaatgggaataatatcngaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgaggcagtctggagctatttaatacctgggaaaagatagaggcctcagggaaaaactaaactgaacccagactttccagcacgtgaatcatttgaagatgggagaggctaaatcagaagcaagagtcaaatcttcacaatatccgggttatatgttgtatactaataatgctcta

SEQ ID NO: 616480 - DNA, 728 bp, Homo sapiens
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgaaaaaaaaaaaaaaaaaaaaaaaaaaaaaaaaaaaaaaaaaaaaaaaaaaacaaaaaaaaaaaaaaaacaacaaagaaaaaaaaaaacacccccagcggcggagagcaccagacaaagagggggcgacttatcaatcatagagggcgggcgggccggacgaacaagcggagggccctctacaagaggggggagaacaacagcgcgaagcggggggaaccccgagcggcagacaatacaagcgtaaccgaagcgagcggaacaaaatgtgtaccgccccgcgaaaagatccccacaaaaaacaaggagacacacaccccgccgcacgaccataccacaaccacctccacgacacaacgccgacgaa

SEQ ID NO: 616481 - DNA, 235 bp, Homo sapiens
tgccacggttcccaagtgctgggattacaggcctgagccaccatgcccggccccattcctgtttctatcaagagtcacaaagatcctcattcacaaggcctctaatgacattcatgaacgcgcggatgggtattatttaattggtatattacttgttaggaattgtttgtatgtttgttttcgagatggagtctcgctctgtcgcccaggctggagtacagtggcatgatctctg

SEQ ID NO: 616482 - DNA, 1350 bp, Homo sapiens
ctccacctccagggttcaaatgattctccatgcctcagcactcccgagatagctgggattacaggcgcccaccaccacacccagactaattttgctatttttagtagagacggggtttctccatgattggtcaggcagatctcaaacatccccacctcaggtgatccaacccgcgtcggcctcccaaagtgctgggattacaggcatgagccaacctcacccagcctacatacaattttaaacacctttaaagcttatctataagccacactcagaaatgaaccattcaagcatctgcatcaacatgtcattcaaccatcgctttccaaaaggcattgcaacacccattcacccgcatcatatcacacatgcagcaaacacatttccacctggtcccagctcatcagagcgacatccatttactagggaaacaactacgctccacttgacaaggtcatttcacatttggccatgcacttaaagcactggcactccactatctagctccattggtctactcttcaccgatcctaatggtcatttccccacctccttttccattggcacccaccacatacatggcgtacatgtgttcacacacaacctcccaacaacctctcaacaccttcatttcgacgcacgatggctcacaaagtgtacaatgcacttcacttggtaaatcagtataaacaacacccaagcaggggacttcctacacgatcaaccgtcacttaaggctccaatatcattacaccccaccaagactaaattacttatctcgtcaccacacacacgtattatgtacaacccgcaaccaacatggtgcttacacaggctatatccacaacaccagtttatatttggcacgtacttaaatatccacactatcgcaccgtagtcttatcaggtacaaacaggttcatgtggcacaaacgaccataaatggcggaacgaaccaaaacaccagccgtataaggtaaaggactcaacgtcttttcacagccaacactgaatactgagaacaccacgtatacatccaagactgggacaactaaacaacaatcaaacgtttcactcggcccaaagacacaacacaaatcagctacacgaacaaataccaaccacagtgacacgcaaggccacagccgccccacgatacaacacatcaacacacactatcaaccgggagccagccacacacaacatagcgagccacggcagcacaacgagagctcataccacaaacagccaacctactagcccgcggtcgcatgtccccacaaagaacaccacaggtagcacaaccagtcaccaccaaacgacaatccagagacggtcccacagacagcc

SEQ ID NO: 616483 - DNA, 2011 bp, Homo sapiens
  misc_feature (830)..(830): n is a, c, g, or t
  misc_feature (902)..(902): n is a, c, g, or t
  misc_feature (905)..(905): n is a, c, g, or t
  misc_feature (911)..(911): n is a, c, g, or t
  misc_feature (914)..(914): n is a, c, g, or t
  misc_feature (916)..(917): n is a, c, g, or t
  misc_feature (970)..(970): n is a, c, g, or t
ataatttgtaataaagttgggataaacattttctgcaacaaataatcctattgtttttgttattggagaaatcttgagtcatcctgaactagtttgaaattgtgaagctgcttcttggggagcaccaggcttgttcctaccttcctcttttcttttgcagtgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattgggcggttattaagaattttaggacgaaatgatgatgattcaagtgaagctatgaatgatatattagcacaggttgccactaatactgagactagataaaaatgtaggaaatgctattcttaatgaaacggttttgactatcatggatattaagtcagagagtggattgcgagtcctagccataaatatcctgggtcgtttcttattgaacaatgacaagaatattagatatgtggctctgacatcttngttgaagactgtacagacagatcataatgcagtacagaggcacagaagcacaattgtggactgtcttaaagnttnggatgnctnannaaaacggcgtgcaatggaattgagttttgccctggtaaatgggaataatatcngaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgaggcagtctggagctatttaatacctgggaaaagatagaggcctcagggaaaaactaaactgaacccagactttccagcacgtgaatcatttgaagatgggagaggctaaatcagaagcaagagtcaaatcttcacaatatccgggttatatgttgtatactaataatgctcta

SEQ ID NO: 616484 - DNA, 617 bp, Homo sapiens
ccccgcccccatgatcctcgccccgtgaccctcgcccggcgaccggacccccacccctcctgcgacctctgcccagcgaccccgccccccctcctcccgcgacccccgtcccgcgagccccgtttcgcgccgcctctgaccaacctctttcgcagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgaaaaaaaaaaaaaaaaaaaaaaaaaaaaaaaaaaaacaaaaaaaaacaaaaaacattagtgtggcggggcccgcccggcgcgcccacgcgagaaagagttttacaaacacaccaccggtggggggcggggcggcgcgccacaaggtgtaggaacacgggggacaaagggggtcccagaaggaaaaccgggggaccaaaagggggggggtatcccacccaaaaaaggc

SEQ ID NO: 616485 - DNA, 2197 bp, Homo sapiens
  misc_feature (1348)..(1348): n is a, c, g, or t
  misc_feature (1420)..(1420): n is a, c, g, or t
  misc_feature (1423)..(1423): n is a, c, g, or t
  misc_feature (1429)..(1429): n is a, c, g, or t
  misc_feature (1432)..(1432): n is a, c, g, or t
  misc_feature (1434)..(1435): n is a, c, g, or t
  misc_feature (1488)..(1488): n is a, c, g, or t
  misc_feature (1737)..(1737): n is a, c, g, or t
  misc_feature (1741)..(1741): n is a, c, g, or t
  misc_feature (1745)..(1745): n is a, c, g, or t
  misc_feature (1751)..(1751): n is a, c, g, or t
  misc_feature (1791)..(1791): n is a, c, g, or t
agcggagtggcagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattgggcggttattaagaattttaggacgaaatgatgatgattcaagtgaagctatgaatgatatattagcacaggttgccactaatactgagactagataaaaatgtaggaaatgctattcttaatgaaacggttttgactatcatggatattaagtcagagagtggattgcgagtcctagccataaatatcctgggtcgtttcttattgaacaatgacaagaatattagatatgtggctctgacatcttngttgaagactgtacagacagatcataatgcagtacagaggcacagaagcacaattgtggactgtcttaaagnttnggatgnctnannaaaacggcgtgcaatggaattgagttttgccctggtaaatgggaataatatcngaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggtaagtagcttctttcagacagcatatacgaagtgctgggatatactgatgttatcatgaagtttatgttctagtcagggaggtaagaaattcacaagtnaatnggtnacattnatgtcagttaggaataaatgccatgaagaaaaacctaaancagcatggaggaatattatgatggcaggataaggtgggatatagggcaactggccaagtgttttagattagagttagtcaggaaggtctctcagaggagataacatttgagtagagacctaagagacatgaggtagcagccatgcagagatcgtgaggaatagtgtaccatacggagggaaccctaagtgcaaagacctgaggtaggaacaagcatagcttgcttggagagcaacaggaaggcaagtgaagccataaagtgagagaggcagagaatggtaggatggatgtcagagacataagcggagccagacaatgtaggcctcatgggagcttgcactttaatttggaatatgtaaggaagccattgcagaggttttgaatggctaaagtaactcaggattatg

SEQ ID NO: 616486 - DNA, 783 bp, Homo sapiens
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtcgaaccaaaaacaaacaacaaaacaaaacaaaaaaaacatttgtgtgggcgccggctctggcccctctggaaaacggcttccaaagaacctatccgtctggggccgccggggcccccagatctggtcacagcgggacatttggccccataagcgcgggttccccctaaggaagaatcccgggcgcccatgggccaacagagggcgcggggagtctccccaccccaatttaaaaaacccgcccgcggggggaacacccggggagcgtgttcgctgaaacacatattcccagagggggcggagttccgggggagtgtcacataccaggggggatctataatcacacccagggagtctaccacaaacggcagacaccttccagaattttacccaaatattaacgcccccgcacccgcgggggat

SEQ ID NO: 616487 - DNA, 684 bp, Homo sapiens
aacactctgatcagcactgaggcgatggtaagatgctgtctagctcatcagcaaagcggaaaaacgtgcactgcctcaaagatgggcacacggcctgtctttccagggtgcgactctatcctcagcgccacagcttcgctccaggcctccaacaccagtcgacgccggggcagacaggagcattttgtgcgaggctcatatgtagtcacccatccgtcatccgagttcactgctccaggtagatcagtctgtcaccatggaccttgggtgccatgatgtgaggcaccgctgagaattcatccacggcccgtggcgagtcacatggagtaactgtgctgagcttgctgtgcccaagccccgacgggtgacgccgagcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgcccg

SEQ ID NO: 616488 - DNA, 381 bp, Homo sapiens
  misc_feature (15)..(15): n is a, c, g, or t
  misc_feature (70)..(70): n is a, c, g, or t
  misc_feature (110)..(110): n is a, c, g, or t
  misc_feature (119)..(119): n is a, c, g, or t
  misc_feature (129)..(129): n is a, c, g, or t
  misc_feature (131)..(131): n is a, c, g, or t
  misc_feature (136)..(136): n is a, c, g, or t
  misc_feature (141)..(141): n is a, c, g, or t
  misc_feature (149)..(149): n is a, c, g, or t
  misc_feature (156)..(156): n is a, c, g, or t
  misc_feature (165)..(165): n is a, c, g, or t
  misc_feature (178)..(178): n is a, c, g, or t
  misc_feature (185)..(185): n is a, c, g, or t
  misc_feature (191)..(191): n is a, c, g, or t
  misc_feature (193)..(193): n is a, c, g, or t
  misc_feature (201)..(201): n is a, c, g, or t
  misc_feature (203)..(203): n is a, c, g, or t
  misc_feature (207)..(207): n is a, c, g, or t
  misc_feature (222)..(222): n is a, c, g, or t
  misc_feature (271)..(271): n is a, c, g, or t
  misc_feature (274)..(274): n is a, c, g, or t
  misc_feature (277)..(277): n is a, c, g, or t
  misc_feature (297)..(297): n is a, c, g, or t
  misc_feature (365)..(365): n is a, c, g, or t
gaatgcactacgcanatcacgagtaaatactgtgtcggtaaaacttgtttcagtaaaatatgtacgtgtncgtgcatgttatgattaaatatccttcttatcacagtcancctaaaganccaaagcttngnactanggacncaaccatntagaaanagcaggganaccagacactctnggttganatgatntntttaatgncncagncgacacccacattcncacttttggctccttcagacaacttgatctttgggacttgaatttgtanagngtnaaacacctacatatgaagcncgttggccgccacactacaacactcctttttagtgagagggacaagatacctatgtctcatgatcaangtactcttttattctt

SEQ ID NO: 616489 - DNA, 749 bp, Homo sapiens
agcggagtggcagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaagtaagtcttacttttctttcttctaacaactgttaactactttgttcttttttgtattttctttgagacgg

SEQ ID NO: 616490 - DNA, 817 bp, Homo sapiens
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagatcagcgactgtgtgtgagctccagggaagtgaataagtttcagagtggttattcaaaactctttagagctaacatggatgggttgaagaagagagaaaaaagaacaaattaagaagaccaatgcagcagagcaggcagcaagcaggatgcaaccttgctggcaggacagaaacgtgggagcaaccaacatggcagcaaacaagcagcgagcaacaaggcagccacaggtaacagggggcattaccatttcccttgctttcaccaatttaacccatcttgaaattgctattttttccctttgtgggcaagaataggctaggtttcgtggtccccccacggtaggtgtttccacattacggatacgggtccttgtggaaaggatacgttgcccgtgtgtattgggatagtcgtggtacagactccaggtcattctggcattggccctattgggtcggtgctggagtggtatattcgtcctggattattagaatagacgtctccgaagacctctctgtgagaagccaggctatcattaaccgttttgtttcccaccaagcacaaccgaccaacacac

SEQ ID NO: 616491 - DNA, 346 bp, Homo sapiens
tgttccttattatcgtcttattataaagtgaaacgatggaatgttacgtagtaattatccatggaatggttccatcctgccatcgcgatactgtaacactcgtggtccagagcttcacgaagattactaatgtttttcatctctatgcctctgtcaaacttttattccttataccactgttttcacaccaagaccaccataacagccttagcattatgcatttgcaacttgcgtacctccctgatgtttcccgtcccctctctccctgtacaggaagcaattacttgggccaggcacagtggctcacctattaattgtattacttttaagacagagtctcactcca

SEQ ID NO: 616492 - DNA, 435 bp, Homo sapiens
tactaggaagtttgttctctaggcaagtgatcttagccagccagatctggtagtataaatctatgaatttagccaagcatcatgcaatggtggaactctaggaaggatgctacatttggttgtaatgtaattgctaccagagctggagagcagatggctccttttctgcctcagctagttcctcgactttatcgttaaccagtttgatcccaaccttggcattcgacaggccatgaccaagtatttgggaatgcgttggtcactgacaaatccatggtggatacatattttgaacgaaattcttcaagatttggttcagaaccttacaagcaatatgtggcgagttcgagaatccagctgtatagctttgaatgatttattgagaggaagacccttagatgacatcattgataaacttccagggtaccgagctcg

SEQ ID NO: 616493 - DNA, 497 bp, Homo sapiens
ggtgactctagaggttcccgagtgtcttcaagagtatatagactgttctacttcatgctctactcatgccatatcccttcgtggttcctgagactcaggtgaaattaccttccaatattgctggagaagggtcgtctcctcctcagtgtctcataaatcctttattagtaccaataactgcaagaaaccaggtgctgtgccatcctctggcagattaagctctctgcgaattgttttgtggactgccccagcaatgacttggtctaggcgggcctgattcacagcatctctctcaattgctcctctctgtaccagcttctgtaacaaaggctccagccttagtacataagccgacaacttttcctcatccttctggtaagtggttagatatttgacctgcaactccctaggattatctgtaaccccaaatacctcctcaagagcctgcagacattcatcgacagtaattaaaggattgtttatcttgaagaacactc

SEQ ID NO: 616494 - DNA, 898 bp, Homo sapiens
  misc_feature (107)..(107): n is a, c, g, or t
  misc_feature (255)..(255): n is a, c, g, or t
  misc_feature (261)..(261): n is a, c, g, or t
  misc_feature (295)..(295): n is a, c, g, or t
  misc_feature (305)..(306): n is a, c, g, or t
  misc_feature (310)..(312): n is a, c, g, or t
  misc_feature (314)..(314): n is a, c, g, or t
  misc_feature (318)..(318): n is a, c, g, or t
  misc_feature (327)..(327): n is a, c, g, or t
  misc_feature (350)..(350): n is a, c, g, or t
  misc_feature (360)..(360): n is a, c, g, or t
  misc_feature (366)..(366): n is a, c, g, or t
  misc_feature (395)..(395): n is a, c, g, or t
  misc_feature (440)..(440): n is a, c, g, or t
  misc_feature (477)..(477): n is a, c, g, or t
  misc_feature (506)..(506): n is a, c, g, or t
  misc_feature (514)..(514): n is a, c, g, or t
  misc_feature (517)..(517): n is a, c, g, or t
  misc_feature (523)..(523): n is a, c, g, or t
  misc_feature (526)..(526): n is a, c, g, or t
  misc_feature (531)..(531): n is a, c, g, or t
  misc_feature (551)..(551): n is a, c, g, or t
  misc_feature (556)..(556): n is a, c, g, or t
  misc_feature (599)..(599): n is a, c, g, or t
  misc_feature (824)..(824): n is a, c, g, or t
  misc_feature (893)..(893): n is a, c, g, or t
cgacccccatttcggctgcagcctcggacctagctccggccctcggtctatccggttgcatcctccctccctgttccggatcttatcttgcgccacgcctactccangatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtnaacganggaggctgtatcccccgagcgctgagtacccaancatccgaaannacannnantgcntggccagtnaccttaccccagcagtctatgcncggctctgcnacaaanctatactcactggttggacgctagatcantgtatccagactggcgtggacaaccctggccaccccttcatcaanactgtgggcatggtggctggagattaggagacctatnaggtatttgctgacctgtttgaccctgtnatccaaanacnacaaantgnatatnacccccggacaatgaagcanaccanggatctagatgccagtaaaatccgttctggctactttgatganaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtntccccgttgctgactgcagcaggaatggctcgagactggccagatgctcgtggaatttggcacaacaangagaa

SEQ ID NO: 616495 - DNA, 124 bp, Homo sapiens
aatggtctacactctattgcacaggcctctccagtgaacaggttctgttcactactgcgaacttcttggctcctgcaacattgtgaatgtactagcaataacccacacatagtgcagcgtctga

SEQ ID NO: 616496 - DNA, 767 bp, Homo sapiens
  misc_feature (89)..(89): n is a, c, g, or t
  misc_feature (104)..(105): n is a, c, g, or t
  misc_feature (213)..(213): n is a, c, g, or t
  misc_feature (215)..(215): n is a, c, g, or t
  misc_feature (220)..(220): n is a, c, g, or t
  misc_feature (235)..(236): n is a, c, g, or t
  misc_feature (248)..(248): n is a, c, g, or t
  misc_feature (279)..(280): n is a, c, g, or t
  misc_feature (300)..(300): n is a, c, g, or t
  misc_feature (310)..(310): n is a, c, g, or t
  misc_feature (312)..(312): n is a, c, g, or t
  misc_feature (334)..(334): n is a, c, g, or t
  misc_feature (336)..(336): n is a, c, g, or t
  misc_feature (391)..(392): n is a, c, g, or t
  misc_feature (429)..(430): n is a, c, g, or t
  misc_feature (437)..(437): n is a, c, g, or t
  misc_feature (448)..(448): n is a, c, g, or t
  misc_feature (452)..(452): n is a, c, g, or t
  misc_feature (454)..(455): n is a, c, g, or t
  misc_feature (526)..(526): n is a, c, g, or t
  misc_feature (566)..(566): n is a, c, g, or t
  misc_feature (580)..(580): n is a, c, g, or t
  misc_feature (584)..(584): n is a, c, g, or t
agctgttcctgagataaccatggagtcggctgctgcatgccaaggcgcatggggtccgagtgattggaagctccacattggcactctgncacctggcctcaggnnccgcggatgcctattaccagtttggcctgcactgctgggatctggcggctgccacagtcatcatcagagaagcaggcggcatcgtgatagacacttcgaggtggaccncntcganctcatggcattgcannagtggttgcggncagcacctcgggagatggcgatgctcatagnntcaggcccttacagacgatntaactatggncngggatgatgagaagtgactgcngngtgaggcaaagctgctcccaaggcctccctgggctgctgtgggctcctggggagnntggccctcgtggcccacgctccatgccagtggctctnngctctgntcctggctacnccananngggagttgtcacgctacagtgagtggctggccttttaaatcgacgtctctctcaccaggatttggtgttangctgtttctctcttaatctcacgtagcctttttcaggttngtacgtgttcttcngtcnaggcgccataactcaatatgctcctgtgaagatacgtcattgataattccagtcgttgattttttgcccccccagagatataggatctcaggtgataaggctttagaactgcgtgatacagcggatcgttctcaggccctcccgccggagtacttgcagactgcatatggtcaaaactaatgg

SEQ ID NO: 616497 - DNA, 1147 bp, Homo sapiens
  misc_feature (358)..(358): n is a, c, g, or t
  misc_feature (403)..(403): n is a, c, g, or t
  misc_feature (423)..(423): n is a, c, g, or t
  misc_feature (434)..(434): n is a, c, g, or t
  misc_feature (437)..(437): n is a, c, g, or t
  misc_feature (457)..(457): n is a, c, g, or t
  misc_feature (466)..(468): n is a, c, g, or t
  misc_feature (501)..(501): n is a, c, g, or t
  misc_feature (504)..(504): n is a, c, g, or t
ggaatacgatgggatcgtgcggaggagcggggtcaccgtacatgtctcccgctggcgcatcgatgtctgttgagaccgtggatggaacggtgctgactccgtggacccggaatacgacatatattgctgtggtgcgaatgagctcacatacacaatcacacacccatgagagagagctgtataagcgataatacagattgctggaggggcccccatgagtcgatgggccgaggccgagactggaatgttgaccgtgattcccgaaattcctcatggcgtaacgggcagctggtaaagatgctactgtatacagaggtgactcgctacctggacttcaaggtggtggagggcagctttntctacaaggggggcaagatctacaaagtgccgtccactgagactnaggccttggcttccaatctnatgggcatgtnganaaacggcgcttccgcaagtncctggtgtnnntggcaaacttcgatgagaatgaccccaagaccnttnagggcgatagaaccccagactaccagcatgcgatgacgtctaccgagaagtaagatctgggccaggatgtcatcgatttcaacatggccatgaccactgagcgctctaccgacactgatgactaccttggaccagacctgccttgagaccgacaacggcatccacagttggtacagtgagtccctggacccggtatgggaagagcccatatatatacccggctctacggcttggagctgagctgcaccagggttttcgaaggattgagtggcaacatattggggggacatatcatgccgagcacaaaacaggagagacgagacacacaatacatgggacaacagagagaagggctagtggagcgatctaacaacaggagaggacataagctagaccggccaggagaacagacggaactcggtgaacccccgcacacaacaccggaaccagtgtgccagacagagggctgcacagggtaacacgcgctcaccagtaaaccataagaacccccacaacaaaaacacaaaatagacacataatgggcaacaaaagatcaccacgagcaaggtcagagaagcgacaacacagcagaaacatcgaaagcaacgagagcaccgagcgacagcagtgtaacactgagaac

SEQ ID NO: 616498 - DNA, 367 bp, Homo sapiens
tcagatatttctttatagcaatgcaaaaatggactaacacacttgagttctgtctttttcttatggcatattttaatctaggccagacacagtggctcatgcctgtagtcccagcactttggaggccgaggcgggtggatcacttggggtcaggagtttaagaccagcctggccaacatggggaaaccctgtctctactaaaaacacaaaaaattagttgggtgtggtggcacacacctgtggttccagctactcgggaggctgagacacaagaatcgcttgaacccgggaggtggaggttgcagtgagccgacatcacgccactgctctccagcttggggaacagagcaaacctccgtctcaaaaa

SEQ ID NO: 616499 - DNA, 129 bp, Homo sapiens
gtagctagaggatccccgtccttcatcatgctacccgtccttcatcatacctacctcagcctcccgacgtccttcatcatacctaccccgattgaagagggagaaaaggtgaaggctgaaatctcgttt

SEQ ID NO: 616500 - DNA, 593 bp, Homo sapiens
aaaaaaaaaaaaaaaaaattgtgggcggctcgggccccgcgaaaaagttttttaaacaatcggtggggcgcgcgggcgcccaggacgggacaagcgaagaacaggggccaataggcgtggtcccattagggaggactccggcgctcaatgaacaataggggcgtggggagttcctccaccaacaataacaaaacgcgccggggcggggaaacccggagcggtctgcgagaaaaaatctcccagaagggggagtctcctggaggcgctcaataccaggggatctcatactacaacaagggagaggccgcaacagggggaagggctctcggacatatctctaaaacatttatacgggccccccggcccggtgggggagaaaatcggaacgggaagggaaactaacaagagagataggcaacaagctcgactgaagcaggagaaagtacatgcgagagagcgaaacccgtggcaacgcaacgcactactagctagcaaggcacagacgaacagtagcaccgaccacccagtagacaagaagccaaccgaatcgcggaacaactgaacaacaatctgagccggccgtagagctaaat

SEQ ID NO: 616501 - DNA, 867 bp, Homo sapiens
ccctaatgagacgcagcgagcagtacagagagtgaaccacgagggtgacaggcactcagctcggcgtatagtagtccgacaccctgctgtggaaggggcgtcaaatagacacccgacggcgtgagaaaaaacaccgcgggggttcaccaatagggtctcttggaaagttgtccccgcccccgagaaaaaaatggcccacgccagactgggaacaaagcgggggccgcctctctctctcataaccgggagcgccgctaacagccttctcaggcaccccccagggacacctttttgcgcgggccaagaaacaaattcgctggggacacaacaccacaggacaggggggtggccccacgccgaaaatggaagcgtccctatgatccccaggaggactttcggaaggacgtggccccagagcccatgcgacaacatgtgcccagtagacaccgggaatctaacccgggccccactcttagggaccaccaccgagcagtcctcgtgaaaaggcggaacccgggcttgataatcataagcccgcgcccagcaccaccccttccgacatactggaaagcaacttgctcaaaccgctatggtggcaacaccccagagaggaaagcaaaaaacgggtttaaacagggacactccaagctcgcggggacattaaggcctcttctaccaccagactgccagccacggatggtcatccgcacaataactctcagagggaattattgccctttcaaagaactatgacacgttttgttgtcaatcctcaccggccttccaagaccggtacctaagacaaatgccacggcttataatctttcgggcagtccccccaaaaccattggacttctacgggacaaa

SEQ ID NO: 616502 - DNA, 332 bp, Homo sapiens
  misc_feature (38)..(38): n is a, c, g, or t
ggtcgtccggtcagcgggtggccttcaagcaggatggngccttgctgaggatcgtagaaacgcagcaacagatcgaagatcgtcgattttcccgcgcccgacgcgcgaccagggccagggtttcaccggcattgatgctcaggctcaagccgtcgatagcaaaacgatccgggcgcgacggataggagaaacgcaaatcctggacttccaggcggccgctgacccgctccggcagcttgacgacgtttgcctcgggcgccttgatctcgttgctcgactgcagcaactcgccgatccgctctgctgcaccggccgctcgttgcaagtcgacg

SEQ ID NO: 616503 - DNA, 171 bp, Homo sapiens
cgtacaaaagcgctttggagatgccagaaaaaaccctacgggagggttatccccctgacgctaggccatgacacaactaaacttcaatacaccaggactaaggcaagtatgaagaagcaaaatatcgtaacgacgcaccctcgagatctaccaggcaaaaccagaacctga

SEQ ID NO: 616504 - DNA, 582 bp, Homo sapiens
agcttggggtattgtgagttcgtgtgcatccccatctgttacatgcacagcgagacaaaagaacattgtgcttggcacacaacttttttcccccttttaataatggtcatgagagccttaagtcttggggcagattttgaagctgtgtgtggcaaacagtcacagatgcggacagtacagtttactcacttaagtgcttctggtgccagcatagaattatcagagggacttcagtccaggtttaactcaggataaattccctggctggatactatcctagaatttgccgtatagttaaaacattaaacagtttcagtgccagtgcaggaaatttgcctctgcgtttgcattccttcattgtgggtggttgagaagcctgttcaggggccgggggtctggacgttactggttgtcttgtctagttgtgcagcttgtgtgtggcctggtgcgcttatggctgaagagggggtggtactggcactgggggcaagctcacttcagctgaaggcagagccttggagtggctcatcccttgggttgttcccagtgcagtgtattgtcttgaccggcgctgggcttgct

SEQ ID NO: 616505 - DNA, 591 bp, Homo sapiens
caattccatgccagcgtagggactagctttgggagtatgagaaaaaaaatcagatatacttcctcaggaacaataaatcactcacttgcctcacctgtttttaaaacaaacacatttacattatagctcaagggagcagagcattttttttttccggggatctcaaagattattggaaaagaaatagatcatactcattatgctgcatgggaaaaaacaagatctagtcggcctaagcggccaggtaacagactccaaatgaaatataaatcaaatataaatagaaacagtgggcaattagaatttagaaagggtgggagattatgcggggcgggtgactagggtacattaggggaaagcacatttggcagtgggagacgggggcttaatttgtctggactcgattctagcttcaatacatgtacaaggagcctcactaagaaatatgtataacggggttggtgaaaccagatgggatggtgcaatattcacgtaatccttacataagggatggagttgcccatgtaaaaggtatcctataaaaatcggttaggagtgccatatggtacgtgtgtgtgcattactagtggt

SEQ ID NO: 616506 - DNA, 155 bp, Homo sapiens
cagtgtcctagacctcgcagtggtcctgccagtgttttattaccatactttgagacttcgagaccagcctgggcaacaaagcgagaccccgtcactacaaaaaagttaaaaaattagctgggtgtgtttttacccgcctgtggtcccagctactc

SEQ ID NO: 616507 - DNA, 409 bp, Homo sapiens
tgagacaggctggagtacagtggcgcgatcttggctcaccgcaacctccatctccagggtgcaagtgattctcatgtctcagcctcctgcgtcgccgggattacaggcgtgcaccaccacacccagctaatttttgtatttttagtagagacagggttttgccatgttgaccagaattgtctcgaattcctggcctcacgtcatcagcccgcttcagtctcaagtgatcaacttgcctcagcttcccaaagtgagttaggtattttaaactaccataaacttcaccatggctgcgttctgcctccatttccctgctggggtaggggagtgcttctgcccacggtacagcctggcacctcctggccatcccatggagacatcgggtctcttctcagccagacaggcccca

SEQ ID NO: 616508 - DNA, 130 bp, Homo sapiens
ccagaacataaagtgaggagaaaggccatgaccatacaaggtgcatgcagatcacatgatatcatccatcaacgtttccgcacagtgcccaccagaagtatgtccagacaagcctggccagaaggcagac

SEQ ID NO: 616509 - DNA, 441 bp, Homo sapiens
cagcgggatgatcgacgcgcgccacgtctgcaggaacaggatcacgaccagcaccaccagcgcaatcgcctcgaacagcgtgtgcgtgaccgcctcgatactgtgccgtacgaactgcgtggggtcgtagacgatgctgtagtccacgccgtccgggaagttctccttgagctcttccatggtcttgcgcacatcgtccgagatctggatcgcgttcgagcccggggcctggaagatcggaatcgccaccgcggacttgttgtcgagcagcgcacgcagcgcgtactccgacgcgcccagctcgatgcgggcgacatcgcgcagataggtcacgccgccgtccggcgaggtgcgcaagatgatgccgccgaagtcttcctcggtgttcaggcggccctgcgcgttgaccgagagctgcaggtcggtgcccggcaacgacgg

SEQ ID NO: 616510 - DNA, 109 bp, Homo sapiens
aagcccactctttcgagacatctggacacactgcggtcttggtgccccaggttcaatcttgcgttagctcttttgttgagaaggaaataaaccaaaccagccacttgca

SEQ ID NO: 616511 - DNA, 224 bp, Homo sapiens
gtctcatacacggatccccgcattgaaccctggctggctctaaactccttgatctgatgtgatctacccgccttccaaagtactgggattacaggcatatgccaccataattaattttaattattattttaattatttttaatcttgcaaatttacaaattattttagaatgcagaaatacctttgtcttatctatactctatgaacagatatgctacatttgt

SEQ ID NO: 616512 - DNA, 172 bp, Homo sapiens
ggcacgaggagaaagagaagtagaagaacggctacagaaggaacaagagaagttcagcgtcactggaatgagccaaaactggacggcggccttgggggaacacccaagctggccaagttaggaacttaggcccgggaccgtccgaggccaaaaattatttctcacaaattgg

SEQ ID NO: 616513 - DNA, 544 bp, Homo sapiens
  misc_feature (19)..(19): n is a, c, g, or t
  misc_feature (74)..(74): n is a, c, g, or t
  misc_feature (163)..(163): n is a, c, g, or t
  misc_feature (219)..(219): n is a, c, g, or t
  misc_feature (243)..(243): n is a, c, g, or t
  misc_feature (249)..(249): n is a, c, g, or t
  misc_feature (276)..(276): n is a, c, g, or t
  misc_feature (342)..(343): n is a, c, g, or t
  misc_feature (352)..(352): n is a, c, g, or t
  misc_feature (354)..(354): n is a, c, g, or t
  misc_feature (396)..(396): n is a, c, g, or t
  misc_feature (412)..(412): n is a, c, g, or t
  misc_feature (421)..(421): n is a, c, g, or t
  misc_feature (443)..(443): n is a, c, g, or t
  misc_feature (455)..(456): n is a, c, g, or t
  misc_feature (500)..(500): n is a, c, g, or t
  misc_feature (521)..(521): n is a, c, g, or t
  misc_feature (528)..(528): n is a, c, g, or t
ttccattgtataaaaagtnatccttatgtaacaaaaagacttcttagaagaagaaatatataatttcaggtcanaaataatcagcaaacatacaactgtgggcaaccaaaaaaaaacccaacactggtattttccatcagtcctgaaaacaaacctgcttaanaaatatttacaggatagtacagtactcaaaaacaaaaattgaggtatttggttctnctaggagtagacaatgacatttgnaaaggnagaaacctacacaaaaataaataaggnatattctcatatgtatatgtatggtcgggaataatactggtaggtatgtaaagcatgaagaaattnnacaaaaaanangggcgagcaaaaagaaaccggatcacacactgagtcctttcnctcctgccccatttcnccagacggncttgatgtaccccctatatatnggccccgaatgnnctgagtccagcaaatgtcttgacgctaagtaatcaccataactncttagaaacccagaggaactngggtgangttaaataaataagga

SEQ ID NO: 616514 - DNA, 239 bp, Homo sapiens
tctaatgatgctcattttatcttcatcgagatggtgtcaggatctctgctgaaagtagtctttccgtttgtaattaataagtgtttcatgagggagtaagtagaaatgatataagcatacaatcctcatcctttccactttattcatttatatatttaataccatatggatgcagtatctacctatatttttggggcggtaccgggggaaggggtacccgcaggctcggaatttcgtaa

SEQ ID NO: 616515 - DNA, 860 bp, Homo sapiens
tggaagagtgtttgagtttcattcccacaaaactgggacatcatctgtgaggctctgtcccaaaaagacagggccatccctcatgtctgttatggggtggtagataaacaaaatgttataaatcaaacaaactggcaaattactctggtctctattcgcctaaatcaatacagcaacagtcctcaggggtcactggccacccactctgggaacaaaatggccttcaggtacccttacccatcccccaaggcagcagcaaatccttccgtgtgtacggcctacctaactgggccaagggcacgccaaatagatttgagaaatgttctatgggctcgtaaaatggcgccaagataccgttaaaggatctattccctggtatagagtctcaccacctgggcacttaaatctaatattcccccaattgagcgctggagataactatccagtcccattgtccctgggctaagcagtctggtaaataccgatataatcccaaaagggccctacaatggtcctatttttcttccaggtaatacggggcttaggggcgctatttcacaaagggtcccgaatcacggtttttagacccgcacaaacctgagtaaggcacgcagattatttcccataccccggagaagtcgcctgggctgtggcttacaggcaccctccctggggatccccagaaaatagtaacgcggggtacgggtggaccgcggattcccagcaggcccaaaacgtatggggcgggggagaaggcaaagacccatggggggccctggcaaggccggagatggcccagaacatcttcaacaaaggcaggcggcaaggcccgttagccatctgggtgcccgaacccctaa

SEQ ID NO: 616516 - DNA, 582 bp, Homo sapiens
cctactagaggatcccgcctcatatagttcctgtcccagcaatgcacatgagacgagatggaggcaccacactgacttcgccagctaatggctgggaattcgttgcatcttctctttactttgctacattccatctgggtatgcctcacgaggatcaaagtaagacctggccaaaatggttctccagatgaatattcgctctgctgagtatgtataacatgatcatgggctcagtctgtctcaaaagtgacctggcagcacccaattcacgggctctatcaattccagaacaacctgttcatagaggtcaatgagggtaaagtctggcaatttccagagactgtatagcctgcaacacagtatcccaattgccactgttaatgtcagccacaaaactctcaatgctgtccacagtattcagagacacagtagtctcctcctgcaaggtggcttacgcctgatgtaaactgttctccttcaagtactgcataataaggcggatcacatcccaagattcgatttcgaacgaaatagccgtatctctccagtagcaggacccatttttccctcctaacatttatg

SEQ ID NO: 616517 - DNA, 191 bp, Homo sapiens
gtactactatacaaacatacctacataccacctaccagccgatatgaccaccccactaggtagagcatagcggtttgtctcccagcgactcgtaatacctacataagatactagtctaccgtctagacgctagcaaatagcagctatctagctatctagtaatatagacaggtagctagctaccacgcact

SEQ ID NO: 616518 - DNA, 116 bp, Homo sapiens
ggtcttcctaggaatcggtgtggcctagtccatcgctgccatctaccacgcagccaatggggaacaatcaaagtgtccctagcacactagcttatctcatgtcactctcttcacca

SEQ ID NO: 616519 - DNA, 678 bp, Homo sapiens
gccaaatagctcttcttcgttggaatcagtcatgcgtagcggactatcgatggctagaatttcagtctgctcccgaccacgatatatctgccactgctagccaagacctctcctgtccctgtctgagaacgatccagcacggcttgcggttattgtaatggcattagtcaaatttgctcctaaccaacgttaccacgcagcagaagcagtgtcccgtgagacataatctccttcatcaacatcgctcttgctatcatcacctacccccgccatgagacccaccatttcccccccctcctctatccgcctgcttctctcagcctgtgctccgttgcccgctcgaccactttcgtcacgcacactctactcacctctcccgcactaccacccgcccctctcccacacttctcctctcctctccccattctcacccgccaccctaccccttcacctcgcgcccctcccccccctctccccccttgccctcccattcccctctgccctccctcctacccctgcctccctcctcccctcttctctccctccttcctcccttcccactccctctcctcactctcctccgctcctcctctccccccctcctcccatgctccagccccatcacccccctctccgccccctccctctccccccttgactcctccgctctcccgtcct

SEQ ID NO: 616520 - DNA, 130 bp, Homo sapiens
  misc_feature (69)..(69): n is a, c, g, or t
  misc_feature (97)..(97): n is a, c, g, or t
  misc_feature (119)..(119): n is a, c, g, or t
ccgtttggtttccgcaactccctggattatcctcgccaaggactttgcaatatattttcccgcctttcntggaaggatttcgctgcttcccgaagtnttggacgagcgctctagctctntgggaaggttt

SEQ ID NO: 616521 - DNA, 182 bp, Homo sapiens
ataggaggagcacaatgccatttcaggacccaagtgagtttgctgaattctataatagactcaagcaaataaaggtaattccaccggaagcacccaagatgagatctgtgtgccacgtgtcacgtggaatttgatggaactcctagaaggctcgtagagaatccaagatgaagcaggcacaa

SEQ ID NO: 616522 - DNA, 427 bp, Homo sapiens
  misc_feature (1)..(1): n is a, c, g, or t
nctgcactgtcagtacgttggagatctgtgtcggtgaggcatagatacttgttatgaagtagacttcttggcgcaatcatgttcagcagtcagcatgatgggctttagcattgtatcatccaggttgtcatgatgatcattcatgggccttgttgacaactatccgatcattgacagtagcactctgtcagtgatccagatcatgcttgccatcagtaagcaccactggtacagcactaggtaccagtacattatgtggtcagacactggcgtaacgatccatgtcattggcgttatcctagatacccagactgtatggactctggtcgccaatcctcagcacagaacgatacttgccaaagcctacgccatatgtcgtgatctgtgcagagcgctctgagagaccatcacgacaatagatagtggt

SEQ ID NO: 616523 - DNA, 298 bp, Homo sapiens
taaggcctgacggtactgctggctcctactagtagtcacacacctaatgctagtaaagtgatacaaaatgcatcacatattttaggcaggacctagattttccctatcaacctaagatagaaaataatttcagtagtagatacagaacctagaacatataagtaaggccctacgtcctagcagttggccactatagagtgtttatgtatttgtttattatattttataaggtagggcatatttcctatataacctactaactattttacaaaatggcaacagaatggtggcctacaac

SEQ ID NO: 616524 - DNA, 1279 bp, Homo sapiens
gcctacgcacatcgtacaacatgccttctctgcaaaggatctctcgttcatcccatcgtccgagcaagaggagaagtaggaagacagcaacgaagaaacgccgtggtgcagagccctcgaagtacctacttctcgatggatgtctgtcacacatgcccagtgatgctataacgatcaaccacggtgtcttgtagcctagtgcacaaaacgggtctaccttttgtgctgtgtggctgctccactggtccctctgggcaggcctacaagggagcgatacaaggcaaggtgcttcaccagtagacgcgatggttatccttgcagcgcaggaacgcacggcacctaaaatgtcactctgcagttccaacgactgagctgcgcaaagaccactccggcaactaacagcagcattgtccgcgactacccaacaagaatccagagacaaggtccgcacggcccctcctagtgatccggaggcgggggccctagacaagggggataatgcgagaaatgggacctctttcgcttgcagttagccggtgatggcccctcagaccccaggatgtcctctggtgttgaccgaaattggcgtgaaaagaatgtcgtgacctctggtgctgcgctccttaatacgaaagacgatcggtacatgacttcttgctacaagtacatgccctgtgggttgacatccttgcaattaaccagacgagtggggaacaccccatgggtagaaaggaaaaggttaattgtttcttttcccctgggaacccccccccctttggcttggggttggcctgttaaacaaaaagaaccccaatgggttgaattgccttgggggggccaaggacgaccaagaagcgccacgaacgcgcttggtttgtggaataggcccccccttttgttccacaatccaaggcaacggaaaggaagaaagccaaggcttgggaaacccacgcaagtggtcccccaaggagagaaactctaacttttccttatttgtcggcccaagaacccctggggcccatgggtgccccttggaagcattctgactcgtttcccaattcccttaaaccttgtcgccttggacacttggacccccgggcaatttggccaaaaacggaacctccaattgttaaccatttggcccgaaccctggtggccccccggtgcatttggcccccgcttcttggcccccctgggcaaccaatttccagaaaactggcgccaacctttcacaacccacttggagggtaagccacgaaggcctcttcaaagaccttac

SEQ ID NO: 616525 - DNA, 321 bp, Homo sapiens
gaggattacggtcgacggaagcatttatgggagatatgagcagtgaagatctagtgcttgtctacaaggcacatctgaatcacgaatatagaggacatcagtagaaggattagtggagggttggaaggtattttactttttcccatcattgaagaaagatagataccaaagggtttttggtcccagagagattgaaatcagattagaattcatatttctttcccccagagatctgagaatcaggttaaggtctggatccggtagccaacttttggcaaaaacatttctatctctcagctatattccagtccttgcttcggg

SEQ ID NO: 616526 - DNA, 629 bp, Homo sapiens
  misc_feature (627)..(627): n is a, c, g, or t
catggtggtttacacctgtaatcccaatactttggaaagccgaggcaggcagatcacctgaggtcaggagtttgagaccagcctggccaacatggtgaaaccccatctctactaaaaatacaaaaattagccgtgcatggtggcagatgcctgtactcctagctactgaggaggctgaggtgggagcatcacttgaaccggggaggcagaggttccagtgagccgagattatgccactgcactccaacttaggtgacagagtgagactccatctcaaaaaaaaaaaaaaaaaaaaaaaaaaaaactttttgggcgcgccttgggccctgaaaaggtttttaaaaaccttctggttgtgggcgcgcggggccccattgggttaggtgggaacatggggccctacgagctcgggttcccagaggaagaatccgcgggcgcaagcaacactgagctgctggggatttcctccccaatataaaaaaaagcgccgcgggggggagccgcgcgaggtttctgggaaaccaattcccggaagagacgtcccggagggcacataagcgggtatcctatcaaccgggaggttcaaaggaaagtcccgaaaatgcaatattaggcccgcgctggggnga

SEQ ID NO: 616527 - DNA, 242 bp, Homo sapiens
gtaggctgagacaggatgatagctggaacccgggaggtggacggttgtacgttagccgacgatctacaaagaaatataaaaaaacacacgagtggatggggagctacgagacaaccagctgaatagctatactctgacataagaatttactttcttgaaattcattcaatggaaataattacgaatgtttgtaagtgatgtcctccacagcattattcataaagcagtgcagcgtaccacaa

SEQ ID NO: 616528 - DNA, 864 bp, Homo sapiens
gccggagcctgccgtccccgcgctcgtagcgcggcctgtggactggggatcccgccgccgggcgcagcatggggcgcttccgcgggggccctgcgggtgcttccagtaccttgcttgttggtttcaaccttgctcttctggctggctggatcggccgtcattgcttttgggactatggtccggtccgcaggtgcatacaggcagttctccatcaggaggacaatgtccccagagtatttcctatgtggggctgtatgtcctggtttgagccgggccctgatgattggcccggcggggggttccttcgaaattgctgcggagcccattgccggaaggtcgcaaattgtgttgcttggggactcactcttttaaccctgccttcctgggtgaatatttgcgtggctgacaggtacccacttgaaggttattgtgctattaactaggccaaggggggttacgctatccgaagtggttcagacccattgttttgaccgcaggcttaccaatgatttcaccttttaaagcacgggggggacaagtcgggcacttggggcacaccttcaatcaccttttccattcaaaaatttcaggtggcttggtggaaaacaaggaaaggcctccgaaacaggtcacaccctaaattgccccaaagggacgttcttaggacacaacgaatttgtcttcgctggaatttgcagaccataatccggtgtaaaggccaccagctcaattgggattggccggtatggcaatggcgggtctgcgaatcttgggcatgatattcagatgggccctctggtgtgcggacaggagacccacggaagatgtggtgttgaagcactactaagtgaaagttgcaccaag

SEQ ID NO: 616529 - DNA, 764 bp, Homo sapiens
  misc_feature (387)..(387): n is a, c, g, or t
caaggctccttgggcccaaccggaaaattggtcgcgattgtagaggtttggatcagaacaggctttgtcgatggacctgcactcaagtgaggagacagcccatgcctttcaagggcatgcagctcacctgaggttcatcctccaaggttccgcaacagggccccacagaagtatgtccgacacagcctggcaagaaggcagacatccaaaccaaatgggcagccacccgatgggcccagaagattgagcccgagaaagggaagcccagatgaccagattttgatcgttttaaagttatgaaggccaagaaaatgagggaccagcgataatccagaaatgaagttaagaagcttccaaaggcagctctcctgaaagcttctccccccnaaaagcacctggtactaagggtactgctgctgctgctgctgctgctgctgctgctgctgctaaagttccacgccaaaaagagtcaccgccgcgagtaaaaaggctccagcccacgaaggttcctgcccacggaagccaccacggccacgaaagcacgcgcctgctcccaaagctcagaagggtccaaaagctccacgcccaagaaagcacctgctcccaaggcatctggccagaaagcataagtggccatcataaaagttattaaggttctttttgacctgttgaccaatgtatttaagcctttggatttaagcctgttgaggctggagttaggaggcagattgatagtaggattataataaccatttaataatcca

SEQ ID NO: 616530 - DNA, 267 bp, Homo sapiens
cgcactaatctttttaccctaacagagtcaacctcgcttccacctcctctcatagaattcaggtcttctagtaggcaaaggacactttaatagatattagccatggcaatactatttccatacaataccagtacaataggctagcctatagctagaagagaagggtcatacaatatgatcactagtatgtcctacctccctatatggcgttatcctagtagtacctatgtactagtaataaataggattatatacaaatagggtata

SEQ ID NO: 616531 - DNA, 859 bp, Homo sapiens
ctacaagacgagatacttcaacgtctgtcttactgatgtacacatgaaggaggtaattcagcagttcattgatgtcctgagtgtagcgaggtcaagaaaggtgtctggtgtatacctcaggggggaatgcaaaaccatggacgaggcaagatgaacgatttgtcgacacacaccgttgtgcatgagtgaaatgccaagatgttgcacatgctgtgtgctgggcgagcattgattccatggatttatttcgcaatcccttgtcttgacccgtacagtattccttttagagtgaaccaattgatcttcttgaatgtagcttacatagcgtgacacgaaaaagacccatgccaagtaccttgtacacaggaagaacgggaataaacagaacgactacttttgtggaagagtagccgttgcagaacgaagttctctgagaaggatgttgctgctgctgttggttggacagtcctaagtaagacattgtcagtgtaccagatccgaactcacaagtggaagggctgggcacctaagggaactacacggcggttagcccttcccgagacttcggaatttcgttcgaaactcaatgtttctattggagacgaactgctgaaattcaagacgaggtcgaaatatggtcactttaattgcgggcattggatgacagtgcggggtgatagcatgggttgtagagactggttttggtgctagaggaatgtgggtgggttaggggccagggaaggaggtgaaatcctatagagcatgcaaaggtagttctccactgggattggtggaatgagattggggggtaatctcggcacgggcgagtaagaagggggggggggtggaaggaaaggtg

SEQ ID NO: 616532 - DNA, 999 bp, Homo sapiens
ggagccctgtgtgtgaccaatggcatcttcgaagagctcacgagagacttcctgccgcagctctcgtgagaagatgcaggagctggtgtggtgatctccacgcatctcgctgtcctgtgttcctgacccctcttcctcagcgtcatgcccttcgatgagctgccgtggtcatcgtcgactgcttttctctatagacgggcatcaacggtgatcctgcaaggtggccctggcacgtcctggaccgccaacataggagcatgcatgcttgggcttgcaagcgacagacgcggcgaggcccatgacacatgactggcgcaagaaacctgagataactgtggctcaaccaagcagcagtgtctcatcctacctatcccgcacctaccgtgccgtagcctgacgccacgcagcagaatgaccgcccgctgcgaagagagatggaacatcattagacggctccttgaaaacgtgtacctacgtgcagaaactacgaggcagccccttgaggcggcccggaaacgcaccaactccgcacgcccagcatgaccgggattccaaaccaggacgcgccctgccaacgcctgattcccaacgctcgccttggcgacggagaaccacagggcccaacagaccggaacgatagaagacaccacagaaaagccatatacaccgcatggcagagaagcaattcggacacttgacgatacccaatatcgcacacgcacggaattggccaagcaaccgcctaacagaaaaaattagccttagaacaacagaagagcagcggcacccaacaacctggaacaaagccgcgatgagaccctacaaacagacccaagcagggcacacacagatgcgcccagacggtgatgcagcaaaacagcacccgagcaaaacgcaaaaacgaatgcgagcaacaagagagagatacactacgccacacagaacacgcgaaaaccaacccacacaacgacacaccactattgactacgcccagagtac

SEQ ID NO: 616533 - DNA, 792 bp, Homo sapiens
  misc_feature (20)..(20): n is a, c, g, or t
  misc_feature (25)..(25): n is a, c, g, or t
  misc_feature (39)..(39): n is a, c, g, or t
  misc_feature (194)..(194): n is a, c, g, or t
  misc_feature (403)..(403): n is a, c, g, or t
  misc_feature (405)..(405): n is a, c, g, or t
  misc_feature (411)..(411): n is a, c, g, or t
  misc_feature (625)..(625): n is a, c, g, or t
ccgggcaggggacacttaanagacnagaatagagcctgnaacatatctgaacacacagtagctaagacccaaactgggattagataccccactatgcttagccctaaacctcaacagttaaatcaacaaaactgctcgccagaacactacgagccacagcttaaaactcaaaggactttgctcgagggggatancccacaagaggagcctgatctgtaatcgataaaccccgatcaacctcaccacctattgctcagcctatataccgacatcttcagcaaaccctgatgaaggctacaaagtaagcgcaagtacccacgtaaagacgttaggccaaggtgtagccaatgaggcggcaagaaatgggctacattttttaacccagaaaactacgagagccctnanggaacngaaggggcgaaggtggattaagccagaaactgagagtagagcgctaaattgaacagggccctgaagcgcgtacacaccggcccgacacccttgctaagtatactgcaaaggacatttagctaaaacccttacgcatttatatagaggagatcaagcggaccatggaagtgaactggagtgcactgggacgaacacaacaacaaaaaacctcaanaaatacctggtggccggctagggccaaaccgatttaaatggagaaagttatgcatggcgggccattttcagctacttgggcaattgacctatagggagtcggttaccatcactggccgggtttcaaaggagtaatgggaaccctggctgaccaataaaagattgcaa

SEQ ID NO: 616534 - DNA, 213 bp, Homo sapiens
gcccttgccttttgggaatgaccaggagctggtcatgggggggagagggggaaccatttccttggggcagggggttccgggggccccggggggtgggggggttcccatcacgcaaacaggaagggggtttgggccctttgatcaactggaacctttggatcaagggggggaattccctttttcctttactcaaaaaaaggtacatccccctga

SEQ ID NO: 616535 - DNA, 475 bp, Homo sapiens
aaggtggagttggaaagaaaagtgcagtataccattcattgtaaagtgtttccaccataacagatacagtagacaaaaataactcccagaacataatgatggtaaatatacagtcaaataattaggaagtgatgagttctgagtatttactacttttgttttaaatatagctttatttatttatttatttattttagagatagagtcttgctgtgccacttgtgctggagtgcagtggcacaatcatagctcactgtaacatcaaactcctcagctccagagatcctcttgcctcagcctcccgagtagctaggaatatgggcatgccactacacctggctcatttaaaaatttttttgtagagacggggtcttgctatgttgcccaggctggccttgaactcctggcttcaaaggatcctcctgccttggcctcccaaagtactgggattacacacgagtcactgcacttggcc

SEQ ID NO: 616536 - DNA, 348 bp, Homo sapiens
tttttgtttcccagttttgacaacctcgccatgaaccctcctagaccctcagttcctgcaataggaaggtgggtgccaaaggccaggggggtccctgaaaacaaaccctgcattaaaaaaaaagttcttgggggactccttaagcctgaggcacccttggggcaccagggggtcatggtttccattggaaaggtaaggggggtttttggtttcccgtttaaaaaaattaggtttttactggggtttttgccaaacatttgtttttgaagccccctaaacatttaggattgccgttttttatttgggtttagcaaacaagcattaagggaataaattgttcccctttca

SEQ ID NO: 616537 - DNA, 644 bp, Homo sapiens
atactgagtgggcctttaagaccatgtgacccagaaggcctacccttgaggggaacgtcacgtgcaacactaaggagaatccaggcctgagggggaggtttcctgagaactccgtgccccaggctggcctgagctgcctgggcagaggcctgtgcttggcaacaggcattgccgtggcctgcagctcagagggtcactgggactgagggcgatctgtggcctgaaaagcaaatgcacagttagtgcagctcctgaccaggccttcagtggtggacatgatgtggaggatctgtgtcatggcagccacacctgggcctggccttgctccagggacactgccatgacgtgagcttggccttggctcctgtgctctgccctgccctccatgtgatcgcagtgactgtgtgtgcttggcgatgtggtagtcgacttgggtgacacatgtgtgcagtgtgttagttgcaggaccggaagggtgaggtggcctggtcctcggggctcctggcctgggcttggctgagcgcaggactctgccaaaatgtcccctgccaggcctcatggtggtgctcctggtggcagtggctctctggccgcgggccctgtctgtgtctccgtggtggctctcacagggctctccagacact

SEQ ID NO: 616538 - DNA, 181 bp, Homo sapiens
agtgagggtcgctgtctgccccttgataaaggccagattgttttggaagttccaaagttgcaacgatttttggctagggccccgaggtttacttgactgttgtgtgaaaagctgataaaaaaaccctccagaaaaaagctttttgttttacaaacatgaaaataaaacatgtaattttgga

SEQ ID NO: 616539 - DNA, 1737 bp, Homo sapiens
  misc_feature (102)..(102): n is a, c, g, or t
  misc_feature (285)..(285): n is a, c, g, or t
  misc_feature (373)..(373): n is a, c, g, or t
  misc_feature (403)..(403): n is a, c, g, or t
  misc_feature (406)..(406): n is a, c, g, or t
  misc_feature (414)..(414): n is a, c, g, or t
  misc_feature (691)..(691): n is a, c, g, or t
  misc_feature (768)..(768): n is a, c, g, or t
ctgtgtacacacctggttcgcacaggacagtacccaaagggtgtgcaagactgagtagagttcatggttctgtcatgttggctcatcggtgaccagagcgcnaaaggaggcatagctgcatgtgcctgtcatgggcgttccaggcattaactcactagcgtcgaactgcgcgcctgcgcggggcagcgaaggtcgtctgacgaagtggtgctactgctacactatactctagggacagccatgccggcagaaagaaggacaatcatgctgtgacagtccgctcantgcactgtgacactagcctgtctcgagaaggatgcgctgctctgtgtctcacacctgacagtgtgtgtgtctctgtatccactcagantggtgtcagtcaaggcccccgtgacaacantgnctgcaccncggtctgtctcggcgtcccacatcatagtccgtgtgacaagagatagtgaccgatgattgtgacagactccgtgacttggtcgactctcagcactagacacaggactgtgtcccactcgtcatatggcatctcatccttcgttttttccgcagggcaccacttctttgtagacagctttgaacgctatcataccgagaggcgcctaagctggggcgggaagttcgtctggattagccccattcgcgtgttgtcttcgtgccaagggccccagcgcanactagttgggctagggtttgatgctaggcccaaaggcgttgaccctttctctggcttgtgcgccgcatggagccccnccgggcatccgtttgtgggccgtttggaccgcggtacgcccgctaggtggtatggtgggttggatcccaccccaaggtggggggtcccctccgtattccacccgacccggatcatgctcgagttgtatccctattgttgtctcgacaccgtgggtggccctttttttgggctcgttccatgcggtccgattcctgcaggcgcgcggtatggtgcaggaaggccgcggttccccaaggcttaccctttgggatgggaccttcccattctttgccaggttggccgcagggggaggtcaatcccaccggcgcgggggggatcggtgtttcccctcttcgggaacttggcccaaggcaggtacaacctaggttagcagttgcggacgttggcgccttgtattggaatgccctcctctggcggcgaactaggtggccctggaaattaatccgttccagaacgccggatggagccctagagcttagctcgattccccaggggggaatctcggcatgtggttcccaatatgagaacccagagaaggggtctcttaattggaaagacctcacaattttggttttaatatcacttcggcggaccccacataacaaaacccagagaaactcgtatgcgtgtcacgctcgcggagcgtgtgtggagttccccccacaggggtaaccgtgcgtcacatacaacaacggccccgttctcggttgtaacgagttcacaagccccctgttgtggggcaaacccacgaaattgtcgaaggccacccccttgtcgcgactggcgagagttaggacgacagggccgaccacaaagagatgggttctcacagaggcgacatcactcactaggaagaagagatacgctgcacacagttgcgagcaggaagaagagaggagacatccaccacgagacaccagcgcaggcgcacgcacagcgcatgggtcatccaaacaggaggagacacg

SEQ ID NO: 616540 - DNA, 875 bp, Homo sapiens
tgtcaaagtgatcaacagtcggtttatgtagtatctttgatttttgagtaagaatgtggttgagtggatagggaggagctagcaagaagcagcctgtatcactcagcttaagttctccgttcccagataagggcaagccagtcatggaatcttgctgcaggccctccctctacctcgttccgggtcctaaaaatagggcccgtttttcgtacacagcccctcagagagacggagggactgtcacacatggtgcatgagtgaccgggggctgctgggcgtctgttctttgaccaaaacgcatccatccctgagaagagcacagagtcctagaggggcctgggctgggcatgggctgagcccctggtcttctctacagttcacagaggtctttcagctcaggtaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgacttgtattgcttgaatttgctgcgctttcccccgcgtcacagcagtgcagcttttgggcctttattcttatagctggaaagagaacaaaagtaccacgcgtacaaacctgtatttaaaaagagagcagaaaagaccacgtgaaatttgcatctgtgcgcaaacatttcatccgtgtgtatgtgtatgtgtgtagagtgtgtgaagcacgccagttcatcgtatatatggggttgttgtctcattttggtctgtgattggtcccctcacctcgtgggcttgtgctcgggatcaaacctttctggcctgttaggattatacacacg

SEQ ID NO: 616541 - DNA, 111 bp, Homo sapiens
gctcggtacatgcggatctctgatacatgagtccagactccccgggccatttccctagcttcttgtgtgcggcagtatcctctgaagtcttgggtagcgaagcgagcagga

SEQ ID NO: 616542 - DNA, 819 bp, Homo sapiens
  misc_feature (529)..(529): n is a, c, g, or t
  misc_feature (634)..(634): n is a, c, g, or t
  misc_feature (692)..(692): n is a, c, g, or t
agggggagcaggaagaggggcagaaggaagaagaagagggggaggagaaagagatagaagaagagtcccacgaactgtctgggtatacagcaaatgtccatgaggccgggagagcgtttcaagatcactatgtaccgggatggcatgttagtggctcatgggtgactcaacagaatgaccggctcttacacaagagacgcgagttgtgtactgccttatgcctctggtttccatgactatagccagacatgcattcgtgtgggggacaatacgcacccagcagattaacatttccccaagaggaagaaaacaactatagcgcggagcacgagggacagctagtgagagcgagtatacacccgagtcttcctcaccgagagggaccctcagacagaggacgctcctatgcacacttgtgggcgaacgaggtactgagaaccacaactcttaggtggcaagagagcccacaatttggtgttgagagccatgctaagaacccaaagtggtgcacaacggtgactctctttcncaaggccatatttcttaacattcagtcgaaaagcactcttctgtggaacacacacacaaaccgtgggtgaagcacgtgcaagagaactttcttaagtgattcccncacgagcaggggacacaattccaactccacctctggagaataaggtccaagctgtgtnatcttggaactttgagcgcaagaacagacagcagctaacataagctgcagctgccaaggtgagcccaaactcgtgaggacactctcttaaatgtgtgcactccttgtaacacaattatttttccatc

SEQ ID NO: 616543 - DNA, 153 bp, Homo sapiens
gcggttgatctgaggatcccactagtccacggtggctagtacgctggatggaattttaatctaaatgcaatatgagaataagaaatttaatttcacattactccttttttaggctgtgccaagatggttaattccagccaaccgtggactagt

SEQ ID NO: 616544 - DNA, 317 bp, Homo sapiens
  misc_feature (302)..(302): n is a, c, g, or t
gcacttggccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagagggacaacgggcgcccctctttctatttacctatttaaaaggctgggaatgttagggaacaagttggcaccaggaacccctccccaccccaatggcagctgttccctttaccctggantattttggcaggttg

SEQ ID NO: 616545 - DNA, 302 bp, Homo sapiens
gaactagtgcagataccccagtacagcctggagccaggtagacttgctggatggctagacccacaagacagataacaatcactgcagcttgcttcacaggaagccacatccataggaaaagggcaagagtactatatcaagggaacaccccatgggacaaaaggatctgaacaacagccttcagccctagaccttccctctgacagagtctacacaaataagaaggaaccagaaaaccagctctcgtaatatgacaaaacaaggctctttagcacccccaaaaaaatctcactagctaacca

SEQ ID NO: 616546 - DNA, 714 bp, Homo sapiens
  misc_feature (1)..(1): n is a, c, g, or t
  misc_feature (284)..(284): n is a, c, g, or t
  misc_feature (306)..(306): n is a, c, g, or t
  misc_feature (320)..(320): n is a, c, g, or t
  misc_feature (330)..(330): n is a, c, g, or t
ngtgtgtcatccgtgatcactgccaccaccacgcaggcctggtcagtaccgtctccattgtaaacaacatctcgctctgggtagaagtcgtagaccaggcgcttcagtttcttctcttctactagggcctggtggctgctgaccaccacagagggaggatcttgccggtccaggatacttatgctgtatttcaggtatttccgcagagtcgcaggcactcctcctccaggtaagccttggcccgctgcacgtagactggttctgcctcccacttctgcttggtnatctggcctgctgggtcgaagnggacccaggctggnatttctttgntgaattcaatgtagtcctttccatcatagtatattccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtacttaca

SEQ ID NO: 616547 - DNA, 1019 bp, Homo sapiens
gcttgttcggatgctgacgctctcttcctgtcttagtggctccggaacaggcgtttgggatgcctaacgatgcaggctgctgtcatttgtggatgtggctctatttgctgtccactcaagcagaggaaggcagccaggctttcggcttccaaatcactgctgaacagatcacgccgctggagggacgcagcacctgaccttgcagtacaacatctacacatgttggcatcaagtgctgcattagcacgtggaactatctgcatgcattccttccctccagaagcacttaggcatagtgtctggcaatgctcaatgtcaaatgggcaccggaattgcccctgctagcaatgtctacccacactgtggtcctgcgcactctcaaggctggattatttcaacttcacctcggcaacaattacttacctggaccaggaggcatgggcccgttgtgattggtctaccagtggcacgcatggaacacgggcggaaactccttggcttcagacgggagtaaggcacaggacgaatactaccacatcaataacagggaacgcaggacagacctacgagggtcactgcaaccctcccactccatcggagaataccaactcgacatggagggacactcacagggaaacgcgggacacatactgaacaatccccaaaagcgacggaaagcacccggataggcacgcccaccaaaggacgctacatcatacccaaggaacatcagggccacgtctcccaagaaacaccaaggtgccacacaagaagaccacaaggggtactcgagaaaaggaaaagccgcacgaacactactaaaagccccaggggggccacatctagatcagggaatacatgaccgagggacataacggccacaaagggacaggaccaagcgccaaggagcaccaggaagaagccaagcatggaaaaccagagagaacagccaataaaagaagcaaatgacaaatggacaaacacccagaacgatcaagagcagcaccgcgaaagggaca

SEQ ID NO: 616548 - DNA, 157 bp, Homo sapiens
atagctcctaataaaattttattgagaactagtaagtcaaatacttacagaacatagaatacatatgatcccagcctttcccattaatgacacatacattggggtagttccctgaatatccaacagttagttatattagagaacagtcgtcagctat

SEQ ID NO: 616549 - DNA, 201 bp, Homo sapiens
cgtatttataggtagaggcgacaaaccataccgagacctggatgatacgctggttgtccaagaatagaatcttagttacaactttaaatttgcccacagaaaccctctacaatcccctatgtaaatttaactgcttagtccaaacgaggaacagctcttatggacactagagaaaaaaccttgtagagcagagggtaccga

SEQ ID NO: 616550 - DNA, 473 bp, Homo sapiens
  misc_feature (1)..(1): n is a, c, g, or t
  misc_feature (284)..(284): n is a, c, g, or t
  misc_feature (306)..(306): n is a, c, g, or t
  misc_feature (320)..(320): n is a, c, g, or t
  misc_feature (330)..(330): n is a, c, g, or t
  misc_feature (406)..(406): n is a, c, g, or t
  misc_feature (408)..(408): n is a, c, g, or t
ngtgtgtcatccgtgatcactgccaccaccacgcaggcctggtcagtaccgtctccattgtaaacaacatctcgctctgggtagaagtcgtagaccaggcgcttcagtttcttctcttctactagggcctggtggctgctgaccaccacagagggaggatcttgccggtccaggatacttatgctgtatttcaggtatttccgcagagtcgcaggcactcctcctccaggtaagccttggcccgctgcacgtagactggttctgcctcccacttctgcttggtnatctggcctgctgggtcgaagnggacccaggctggnatttctttgntgaattcaatgtagtcctttccatcatagtatattccagaagctcgctgctctgtatctcgatctcacaaccaacntngctgcatacgtgagaccgtactatcgtgtatactcacgatgtcgatatgtataccggactctagg

SEQ ID NO: 616551 - DNA, 157 bp, Homo sapiens
aagataagaacaataatcattaaagatcataataagaagtacaggtcttgaaagtaactatttcattatgttaaccaagtatttcagtagttcatgatattaattagctaaaatatcagtcaggagattgagcacagtaaagtgaaacactctgatt

SEQ ID NO: 616552 - DNA, 376 bp, Homo sapiens
gactctcaggatccccgacgagttgtccgagttagggtgctactgcttatcagtgtcacttggagctgtgtgccttattttgccccttactgtcaaagttagtgtcttctgttatggaaaaatgttcgtaatttattagtaaaaactacattggtcaacacccagcagatggtgggtgctaaagtggaatggatagagttaccctacacggaatacaaagtaattgctatcttggtatcatttaaagcgaatctatgctctaaagattccataaagaaaaaaaatgactctatatacctacatatacagggaatctgaaggtattattaaaagcaatgtaagaatggttttctttacttatgggcaattatggctt

SEQ ID NO: 616553 - DNA, 130 bp, Homo sapiens
ctgtgagccaggagttgacaccagcccgggcacatgtgagaccctgtccacctcctctgtgctgtccacctcctctgtgctgtccacctcctctgtgctgtccagctgtccacctcctctgtgctgtcca

SEQ ID NO: 616554 - DNA, 360 bp, Homo sapiens
tgcgggttcatactttaaataaacgctcttgggactcctgcgccaacagttatgataacttgatttccataagagttggggcttgaacaaacctaaagaaccgaaggagttcagatctagatagcagagaagtaagtctcattctaaaacattgtaactactgttagagtctaacccatgaagctgtttcagattgagtatctttgactgaattctataagtatatattgttcagagctgaaaatcaaatgttgctcgctaggttggctgtgctgtctcagtcggacattgagagacgccagcttccctgccgctggagaccttggtcctaagtgccacatgcattatgcgacccgcagg

SEQ ID NO: 616555 - DNA, 298 bp, Homo sapiens
  misc_feature (199)..(199): n is a, c, g, or t
  misc_feature (215)..(215): n is a, c, g, or t
atgacgcagatctagtgatgctgtagtccagtctgatatgaaacattggccctttatggtgcgtgaatgactgctggcatggcccaagagtccaagatagaactacaaggcgagagaccaataagcttctatccatgagaaggtgtcttctataggtactgacaaacgatgacaggaaatggcagaagcctaccttggnaagactgttaccaatnctgtggtcacagtgccagcttactttaatgactctcagcgtcaggtatcaaagatgctggaagctatgctcgatcatcaatgt

SEQ ID NO: 616556 - DNA, 409 bp, Homo sapiens
  misc_feature (10)..(10): n is a, c, g, or t
  misc_feature (17)..(17): n is a, c, g, or t
  misc_feature (59)..(59): n is a, c, g, or t
  misc_feature (77)..(77): n is a, c, g, or t
  misc_feature (90)..(90): n is a, c, g, or t
  misc_feature (249)..(249): n is a, c, g, or t
  misc_feature (302)..(302): n is a, c, g, or t
  misc_feature (331)..(331): n is a, c, g, or t
  misc_feature (337)..(337): n is a, c, g, or t
  misc_feature (362)..(362): n is a, c, g, or t
  misc_feature (401)..(401): n is a, c, g, or t
ttgggacccnaaactcntcctaggcccaagagaagaagcctggttctggccccaagaantctcctcccaaaaaaagnccttcccttttcnaagctattgtgtcctgaaaaccccagggatcctctctccatgctccctcccagcccttgaaagtcagtttctgagaacctcaggctctcttctgcagaatgggggtccatgcctgccccccaaggacctcctgaggccaaatgttccaactgccccatnccagcacttagtgtctttcaacaacaaattcctccctgatcacaggagcaggnatctttgcaggatggaatatggaagagcnccaggncaacccagctccatggggaggaatnccaggcctcacctccccacttaatccacccccattccantcagcttt

SEQ ID NO: 616557 - DNA, 287 bp, Homo sapiens
gggaccaggcgcactccatctctacacattaacacactattccgaggcgcgccctgtggactcatagcgcggatcccagagctctgtgaggccgagggccctgtagcaccaccgtgcctcaccctatagcccacaatgtgacatctgaatactacaggcagactggaccacctttcttccatgccccgagaatggtcacaagggcttcgttggctacgctggattggggctttgggtggattataatacccgggtcggcttgataaaggagaactttctttccctgg

SEQ ID NO: 616558 - DNA, 447 bp, Homo sapiens
  misc_feature (7)..(7): n is a, c, g, or t
  misc_feature (35)..(35): n is a, c, g, or t
  misc_feature (50)..(50): n is a, c, g, or t
  misc_feature (70)..(70): n is a, c, g, or t
  misc_feature (78)..(78): n is a, c, g, or t
  misc_feature (141)..(141): n is a, c, g, or t
  misc_feature (411)..(411): n is a, c, g, or t
gcccgcnttaaaaggtcctccctaaaagccttcgngtaccccaatttaancccccaaatacccccatttnaaaaatgncctttgtagcatttattaatgcaaataaattttcacctgagaaacagctttttccctgtaacnggaaaatccctataacaaattaagattaagaatgcagcccaggtacccatggcctcatgccctataatccccagcactttgggaggctgaggcaggtggatcacttaagcttaggagttcgagaccagccgggcaacatagcgagacccccatctctactaaaaattttaaaaattatctgggcatggtggtgtttgcctgtagtcccagctacttaggaggaggattgcttgagctcaggagagtgagtctgcagcaagctatgaatgngctactgcactccagcctgtgcaacagagcaagacc

SEQ ID NO: 616559 - DNA, 258 bp, Homo sapiens
  misc_feature (131)..(131): n is a, c, g, or t
gggaaaggttcccctgaggtcactctgaggccagggacgtcaacccaaggcctggtggtcaatgtgaagggctccgtgccaactggtcaactgtccttcacgaacatatccgtggccacctgagacctgcntccacgacccttccaggaagagccgagagttcgccccaacccttcccaggcccagtgtaaaaacagactcacaaggggcttcttggcctcagcttcatttgcgagagccccgaggcaggacacagag

SEQ ID NO: 616560 - DNA, 1236 bp, Homo sapiens
atccttcgtatattaggagccaggcctacacgaccagcaaccatgtaccaaggagacctgcagtatggtattagatcttggcaccacctactcttgtgtagggtgtatttccagcacaggaaaagtcgagataattgccactgatcagggaaaccgaaccactccaagctatgtcgcctttacggacactgaacggttgatcggtgatgccgcacagaatcaagttagcaatgaaccccaccaacacagtatattagatgccaaacgtctgattggacgcagatttgatagatgctagttgtccagatctgatatgaacaccattggccctattatggtaggtgaatgatagctggccaggcccaaggatccacgtagaatacaagggagagcaccaaaagcttctatccagaggaggtgtcttctatggtatctgacaaagatgcaaggaaattgcagaagcctaccttgggaaaactgtaaccaatgctagtggtcacagtgccagcttactttcatgactctcagcgtccggctaccacaagactgctggcaactattgctggtctccatgtacttagcaattattaatgagccagctgctgatgctaatcgcttaccggcttagacaaaaggatggagcagaacgaaacgtgatacatcttagcacccttggaagggtgagcactcatagcatgatgtcgagccctccaactattgaacgactggcaatcgcaagacggtaacatctaacaagacgacagaaacccacactcgacataccaccacacaataggacacacacaaagcgagaacccaagaaacagcacaatatcaatcacacaacaaattaatacaagacaataacagaacacacacgaatatatataaacaacaatcaatcttctctatgatacaactctatacatgtacactcttcatttccatccacccaggccatctgcagcatccacacatacaaaacaaagagaaactcactataacaacaacaaatcgaagcactcaatcatacgcacatatcaagcactgaccagacacccgttgactatgatagacactatagcacaccaaaaacaaatctaattcagcgccaaatgaagatagcagcagagacgtgcatatgataaacaaacaataatattgcatatctcgatagctagcaacgacactatctcattaactcaaaaagacgtaactaatacgatactatcagag

SEQ ID NO: 616561 - DNA, 289 bp, Homo sapiens
cagcgaaccagggcttttgtcatcctcaatcattaaagcgcagagacaattgcagctgcaaagcgtcatgcaagatttaggtaggcaggtcggtatcgacaatgtccaattgcgagtggtcggcgacaatcatctccctggtcgggcaaggatggcatacgatcctggcacagggacgtttctcatacgtcaatccgacatcctcaagaccaattggctggatgctcaatacctgtatcacgagatgatccacgccgaacaggatgtattgatggccaaagtagggcta

SEQ ID NO: 616562 - DNA, 267 bp, Homo sapiens
cgtcgacaatgtctcgaagatgaacagcgtttgcctgattatcctgggcacagtaattttattggtaggcctgttcatgctggtgggcggtggatatctcatcacccttggcggctcctggtatttcgcaatcgcaggtttgggtctaacccttagcgcagtcttcgtgatacagcgccgtctgatcggtgcagtgctctatcttgttgtgttcgcggcatccatcatttggtcgctctgggatgtggggttcgcgttctggtcgac

SEQ ID NO: 616563 - DNA, 275 bp, Homo sapiens
ccctttatatgcctaggtccagagatggagaccatcctggccaacatggtgaaaccccgtctctactaaaaatacaaaaattagctgggtgtgggggcgcgcacccgtaatcccagctactcaggaggctgaggcaggagaatcgcttgaacccgggaggcggaggttgcagtgagccaagaccattgcactccagcctgggcgacagagcgagatctctgtctcaaaaataaccgaaaaaacaacaacctaaaaggtgtgggctaagctcctag

SEQ ID NO: 616564 - DNA, 1522 bp, Homo sapiens
  misc_feature (401)..(401): n is a, c, g, or t
  misc_feature (457)..(457): n is a, c, g, or t
  misc_feature (802)..(802): n is a, c, g, or t
  misc_feature (806)..(806): n is a, c, g, or t
  misc_feature (810)..(812): n is a, c, g, or t
  misc_feature (814)..(815): n is a, c, g, or t
  misc_feature (818)..(818): n is a, c, g, or t
  misc_feature (820)..(820): n is a, c, g, or t
  misc_feature (824)..(824): n is a, c, g, or t
  misc_feature (1045)..(1045): n is a, c, g, or t
  misc_feature (1186)..(1186): n is a, c, g, or t
  misc_feature (1188)..(1188): n is a, c, g, or t
  misc_feature (1207)..(1207): n is a, c, g, or t
  misc_feature (1239)..(1239): n is a, c, g, or t
  misc_feature (1247)..(1247): n is a, c, g, or t
  misc_feature (1287)..(1287): n is a, c, g, or t
  misc_feature (1290)..(1290): n is a, c, g, or t
  misc_feature (1292)..(1292): n is a, c, g, or t
  misc_feature (1298)..(1298): n is a, c, g, or t
  misc_feature (1300)..(1300): n is a, c, g, or t
  misc_feature (1304)..(1304): n is a, c, g, or t
  misc_feature (1306)..(1306): n is a, c, g, or t
  misc_feature (1315)..(1315): n is a, c, g, or t
  misc_feature (1317)..(1317): n is a, c, g, or t
  misc_feature (1334)..(1334): n is a, c, g, or t
  misc_feature (1367)..(1367): n is a, c, g, or t
  misc_feature (1369)..(1370): n is a, c, g, or t
  misc_feature (1392)..(1392): n is a, c, g, or t
  misc_feature (1399)..(1399): n is a, c, g, or t
  misc_feature (1418)..(1418): n is a, c, g, or t
  misc_feature (1421)..(1422): n is a, c, g, or t
  misc_feature (1429)..(1429): n is a, c, g, or t
gttcgcctgcgtcgctccgggagctgccgacggacggagcgccgccgcccacgatcggacgccagtgccagagagaacgacaatgacccattcatccaacagacacaacgcacatgaaagactgcgacttcccggccgaggacgagttccccgaaactgagcgcccacaacaaccacagtggccaaggatgctgacccccgagctagtacgcgggagctgcgcgccaagagcacagccgaggcggcttcacagctggacggacgtcatccagacaggacagtggacaagccgggccacccgtacatcatgaccgtggagactgcgtggccgggcagaccgaaggaggtcctacgaagtgtgcaaggatctcttcgaccccatcatcgaggaccggcacggnggctacaagcccagcgatgagcacaagaccgacctcaaccccgacaacctgcaggncggcgacgacctggaccccaactacgtgctgagctcgcgggtgcgcacgggcctgcatgcatcctgtgtgctttcttgcacatcccccactgcactgcatgcctgcggggatgcgccgatgccatctgagaatgctcgctggtggaatgccctgtccatgcctggactggctgacctgtgcgggcctgatactactgctgctcaatgatgcactgactggatgtgcgtgatgcatgcagcatgctcatctgacgaccacttcctcttcgacaagcccgtgtcgcccctgctgctggcctctgggcatggcccgctgacttggccctgacgcccgcggtatctggnacangacnnnannacntncctngtgtgggtcaacgagtgaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgnccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagagntngagctggtgcagatggtgntggacggagtgaagctgctcatcgagatggancagcggcntggagcagggccaggccatcgacgacctcatgcctgcccnganantgaagncncggncnacacccganancagccctgctgcttccnaacatattgcctgggcagtgcccaccatgcacncnngatgttcgcgtctgggagcccntagcctngctgtagagacttccgtcnacnnttggtanagtttatttcatctgatgggtaatgatactgctgatgctgaaattaagactagggttatggctggccagaaatatagacaaaaaaacataggg

SEQ ID NO: 616565 - DNA, 287 bp, Homo sapiens
  misc_feature (14)..(14): n is a, c, g, or t
  misc_feature (92)..(92): n is a, c, g, or t
  misc_feature (132)..(132): n is a, c, g, or t
  misc_feature (142)..(142): n is a, c, g, or t
  misc_feature (157)..(157): n is a, c, g, or t
  misc_feature (169)..(169): n is a, c, g, or t
  misc_feature (216)..(216): n is a, c, g, or t
  misc_feature (250)..(250): n is a, c, g, or t
  misc_feature (268)..(268): n is a, c, g, or t
  misc_feature (272)..(272): n is a, c, g, or t
  misc_feature (282)..(282): n is a, c, g, or t
cagcttcaccctgntgaggtgctgcttttgcctccgtttcaccagtgggagaatgggcagaagcagctttcctaggaggattggggaaaaanccggcctgcctcctttttgccatttccaaattcaaggatnccgggggaanacccaggcctcaggnggcaaagcctgntaggggtccccagccccttttccagtcagccttggccgaggcccccncaggagacgctttcaggaaggatgagcattgttncagcaggggcaataaagnacanagatatgccnagaga

SEQ ID NO: 616566 - DNA, 617 bp, Homo sapiens
gccggaaggtatagcacatatcaataaccgaatggtctaccccgtgcgctgtaatgagctctgttggggcttcgggccgaagaccgatgcggtcgagatacgacataacctcccaagcaagaaggttttgatacaaccctaacagcaaattaacgggcaccatgcctgcaaagtcgtacctgtgcagatcggccgtataagcccccgtcattgttgcgacctgatgcttaacagcctcactaggttgagtggtgtgcagagaatatgttggcatatttttccttcgtgtcggagctgcactggtaaagcgttcagtgaacgtccctaatgcaagtcggaaatgtcctgtcagtcagtcagtcagtcagtcagtcgagtcagagtggctcgtggcacacaacggtttcccagcccatacctgcctcctcacaacacggtggtgcccgtcgtcccgtttcacgggctggatagcttcagaaagcaggtcagcactgaatcatcggaggttactagagtcttaatgcccgcacacaaatctatggtattacactgcactgattaaccgcttttgattttgaggccacgcacataatcagtactatcttaccttctatctg

SEQ ID NO: 616567 - DNA, 510 bp, Homo sapiens
gggtagggcgcgctatacacccgggaacagtttccacggttgaatatggacttccctgtgagccactcctctctgcagtacaagacagtatctaccagcacactgaataaatatcacccagccttctgtggcgctctactggtttcctgactgcagctacagacctcacctcaacattcactgtttccagttcctcagcaatgtccacaagtgtcactccatctgcccccagcatccagaataaagaaatctcaacacttgtgagtacaaccactaccaccagtcccactgagagaatgactctcacaagtacagagaataccccgacaagttacatcctgaccacctgtccagtgacatattcattttccccttccacgtctgccagcagtgactggaccactgacacagagagcatctcctcagctccagccatcaccagtacactccacacaacagctgaatccaccctggcacccactaccaccaactcattcacaacatccgcaa

SEQ ID NO: 616568 - DNA, 351 bp, Homo sapiens
gtaaaggagggttcctgtccaaggcctgggattacatccgggagttgggccagaccaaccagggcatgcaggagaccttcaaaaaggccgagcggctgcaaatggacaacgagctccttaggcaccagatcgaggagttgaaaaatgagaacgccctgttttgagcccagttgcagcagcccaacctggaaatggtgggcgagggcccccggcagtgaggcccgccacccccacgcagccgcggccgcccacgcgggcttttggtgcccccttccccagccattaaaacagaaagggacccatgcccgctccccccaataaaataaagtttttttttctttccccaaagga

SEQ ID NO: 616569 - DNA, 821 bp, Homo sapiens
ttgggaggctgaggcaggagaatcacttgaaccctggaggtggcggttgcagtgagcacagatcatgccactgcactccagcctgggcaacaaaacgagacttcgtctcaaaaaaaaaaaaaaaaaaccatagaaattgggatccttgggtcgggttctcccaaattcttttggaggtgtccagggtcaactggcttcagcttggttttgggcaaccccctgcccgaagtcgcatataggctggttcttcacctggtttccaagggctgaggaacagaaagtagcctcttgttttggaggaggttgggaagttaagtatacatttattttttactggtgactggttcaggaccacattttacaaaatgccttgtttccttcatggtttctgggaaaggaaagttctattaatatggtttcacttggaatatagaatagttttttaaattgagggcttatttggaaaaattctggagtttaattcaaatggtttgccaataccttccaaagtaggtaatattcagagacagttgtggtgatcagatggttagagaaatttgtgtaatattcaattcgaagattccttattaatgaatgtctttgacttaattttaaccaaatagtgggacattattctgtgtacattttccttatttagtggttaacacggttagtgcaaccaataaattcttaggcaatgtgttacctggcttctaaattggaaatgtgttaattcaatactttggtggagtgtttaacattccaagttacttgttgaaattgggcttaaaaagcaaggtttgttaattagaggttcttgg

SEQ ID NO: 616570 - DNA, 1059 bp, Homo sapiens
tcgacgcaagcagctggatctccgagtaactagagacatagggtataactgttgtcgcggcgtgaggaagtgaggacggcgccaaggtgccttccgggccagtgttggatccctgtagtttagtgaagatggtgttgctaacaatgatcgccctgagtggcggacgggctcccgctggccgcctcgatgcaggaggacgaacagtctggccgggaccttcaacaatatcagagtcaggctaagcaactctttcgaaagttgaatgaaccagtcccctaaccagattggtaccttggcaagcaaggagaccctggaattatatcacatagaatatatatgtgacacaggggtgtgtgtatataggggataaatagtgtagaagagtgtcctataccataaggaagttaggactatatagcctaaccgtagaagattctgcactcacgaattatgatgacacagcatggcacagaaggtgcccactgtagtcccgagacctattcctttatagaactttgatactttacatgtcagacaaaccaaggaagctctacacttgacagtcgtgctcgaagcaaatctaggctccatcaaacaactgaattgccacgatgtgcagaggatcatggtgagccaagattgacccgacagtgtgcacacgacgcagacgccacgtcatcacgcacttgcgattccacagggctaacagaattgctccaagatcttgcccaagaaagaatcggacaggaatgcgaagctactgtggaccatgcgtacccgtgtatggcaaactgacagacagaagcatgaattaacccaggatagaagggaaggaccgaaccggcagccggacaagaggagaccgcgcagggaaggaaaaacatagaacaccagggcgataacggcagaaaagagaacaacaagacaagaaacgcaagcgccggacacaaagcacggaaggagaagaaaaaaagagagccaaggagacaccgagtgcagcagcgaggcagcgcagagccgcaatccgagaaagaagagacgacacaagaaaaggagaat

SEQ ID NO: 616571 - DNA, 138 bp, Homo sapiens
gtgtaagggggggggggcttttttttttccctttattttctttggggggggggggggttaaaaaaggcccccccccttttcccgggggccccaaaaggggtttttttttttggtaaaagggggtttttttttccccca

SEQ ID NO: 616572 - DNA, 334 bp, Homo sapiens
gccgcccctactgtgaagtgaggagcccctctgtccggccaccaccccgtgtgtgaggtgtacccaacagctcatatgagagcgggcgatgatgacagtggcggctttgtggagtggaggtggggggaaggtggggaaaagattgagaaatcggatggttgccgtgtctgtgttgaaagaagtagacatgggagacttttcattttgttctgtactaagaaaaattcttacccttaaacttaaagtataataaaaaaaaaaacttcagttttctaaaaattatatttttgtaatcagatttcagacattaagtgactgtgtctgttcgggtttg

SEQ ID NO: 616573 - DNA, 207 bp, Homo sapiens
tattgaaactgctgggttgggcactttcattgcaactatatgcctggaagcgatgacgtgaaagctcatcaggctccactaggattgtttgggtgggatggcaacagtgtcagatactttccctctcctttttctcatagcaatgttgttatcgtgttataatacattaatcgaaaaaaataaatttattcttctttcgctccacca

SEQ ID NO: 616574 - DNA, 838 bp, Homo sapiens
ccatgctagtacgaggcctgcgggtttatagtcggcaccgagggttccgtccaggtaatagactgtgacaggaagagagcctgctgacccagtgctcagagcatgactctcgtactaccaactgaggtgggtatccactccacaggccaagtgatactggaatctagatatcatgtcatcacatgtatgaaaggaaattaatctatcctctggtgatcaaaagtcttgccgtccagtagattggcatgcacgagatgcattgcatgcaggtgacagaaccacatgctgaggaacacctgaaaggtgagctttctacgagaagtgacacatggtcgtaaactatagaccttaagtatacacataatcatttaattgctaaccacgagatggagacataatacagtgtgtgctgctggtactagtcctgtgggcgacactggtgcagagaaaaattttgcccaccagtgagcactaaacagtgcacagtagttggatacactaccctggtgttagtgaagctgactgcaggagaacactctatcttctactgctccttttgctctggaacctgatgcaagcaggaactagtaaggcgtatatgaatttacacaccagacaatctacatctctagatgtgagttaataccattatgattgtcagaatttcagtcttgcaacctaacttcacaagcagtactcgatacatgaccatggtaaatttcgcaccaagtcacatagtggtcggtcgtgcacgttgacatagaacgggccgattggccgctaacagatattactcttgactgagcctctacttataacactcgacagcaaaggataa

SEQ ID NO: 616575 - DNA, 117 bp, Homo sapiens
catgcccttgctgcgcttgtgagtggcgactggtttgacggtgctgctgactgtgcgactcactgctctgtcttgttctggttggtgttactcagacagctgctgctgctgctgagc

SEQ ID NO: 616576 - DNA, 751 bp, Homo sapiens
ttgttccccccccccgcggggtgggcgcggcccagataccgcccccccccctctctctctcttaaggggggccacacccttttttcgggcgcactagaccctctcttttccccctctcagcagcgggtgggtgtgtaacaccacaccccaccctactaagtgtttgtgtctctctcctagagcaccctctctctcctcatctctctctgctctctctcagcgaggaggaggtcgcaggtcttttgtgggccgccgccccctccctgggggcgtctctcttctgagagagtgcctctctcgattatttctcttctctctgtggtgtgtgtgtgtgtgaaggatgttccccccacacccccgcacagagtctgttttgtgagggggtgttctctctcctctctggagtgcgccctctctctctctctctgacagcttgtctctctacacagaggagatcttctcgtgtcaccccccacgtgtggtgctccccacagccaccgctctcccctccgccccccgcgcgaggagatatctctgtggcgtgaaacacatattttctcccggcccataaagatagccctcgtgccctctgtgagaaataggccccaccagtttctcccccccccatcttggtggcgttttccccggcccccttggtggaaaggcccaattttttccccccccccctttccccttaaaaaaaataaatttttttaaattaaaatttataaccccactttgggccccccca

SEQ ID NO: 616577 - DNA, 151 bp, Homo sapiens
gcagagcttaattgaagtcttaagcgatgagagaagtatgcgactgtagcctcggctgagacctagatgtagtagctggagtataccttgagccattaggtagtgtgctgtagttataagcgggcctcttgcaagcggatggcaaggattg

SEQ ID NO: 616578 - DNA, 152 bp, Homo sapiens
ctagctattgtgcctgcatgtcacttagtgagacaggacttgatatttccttcagcctcctgagtagctgggactacaggcacccgccaccacgcccggctaatttttgtttttttttttgtgttattttaagtaagagacgagttttctcc

SEQ ID NO: 616579 - DNA, 1143 bp, Homo sapiens
cgagaggctgaggcaggagaatggcgtgaacccgggaggcggagcttgcagtgagccgagatcacgccactgcactcaatgcctgggcgacagagcgagactccgggaggcggagcttgcagtgagccgagatcacgccactgcactcaagcctgggcgacagagcgagactccgtctcaaaaaaaaaaaaaagaaatttcttactagagagaaacccttacaaattttaaagaattgtggcaaattctttaaaccggtcttcaaccttttacttaaacattaaggtaatttcatactggagttaaaacttcttacaatgtttgaccgaattgtggcaaatcctttttcctggtcctcagccctaaccagacttaagaaaatttcatactggacagcaacccttacaaacaggaacacattttggcaaagccttttaaccagttttcacacctttactacagataagataactcatattggagagaaatcttacaagtgtgaactaatgtggtaacagtctataaaaagtcctgaattcttaacagacattaatatttattcatactggagagaaactctaaaaacctgaaagatgttgccaccgccttttgacaagtcaaacttttctaaacattcacgaaaatcatgctgctgagaaatcctagaccttgtgacaatttgtgcaccaagcctctaaatgattgtccccttgatcgtagctaacgaaaattccatactggggaaaaattaccggtgtgtcacccactgtgtgcccagccttttgacctattggtcccgcaccttaaggaatggaaaacgcttatgcctgacagacacatgtgcacactatgtacacagcctataatgcgggtccaagtgcgtcactacaacggcgactcaaaaagaaggtgctacctgagcacgcctatgccacaacttttttatgacaacagcttttgcaagcaccaacaataacggcggcatagacaactcagcaagggaagacatctgcacgcacaaaacaggcgacgggccacaccacacgccggtcgcgcaatactaagcaagcgaccagcaacccacacagtcagtcagtagacaaccacatacactagagtcctacagcaagccgaacaccaccg

SEQ ID NO: 616580 - DNA, 210 bp, Homo sapiens
atcagtccctcctcctactgtattcgagcattggtcctggctgattcctcttgtgctagcaccatttcccgctctgcagttctctgtacacttactcttggtttattctccctgattggatgtgagaacatgtcaggcacgggatacctcttctcgtgcctttgtttaatttgttccctctgtctgggactccctagtcacctccggatg

SEQ ID NO: 616581 - DNA, 142 bp, Homo sapiens
ttttacagacacctcccagcatatagcacccatagccatgcggaagcaaccagtgtataggagatcctccgtgatgtgattctgaagaaagtctgtgcaaacccttgaaattttccactctctctgacagaaaatattaaga

SEQ ID NO: 616582 - DNA, 737 bp, Homo sapiens
  misc_feature (1)..(1): n is a, c, g, or t
  misc_feature (18)..(18): n is a, c, g, or t
ngtgttaatattacctcnagccccttccttctttatatattgcgtgcgtcgctttatatcctttcttccccccaaactcccggtgatctcgtatactcctagtgcgcccctcatccgagtattcctctttgttagctcgagagtgagacatcccgtcgctccctcgcaataaatctctgtctcgttgattgaaagcgcagctcaccactgtttatcaccgagaggttaccatcgcacttctgcaccgcggtccctccgcgacacataaatattcgccctgcgggagatattcttgcgccctcacatatttccgcgccccgcggggacgcccccaccacttgcggagattatcgtatatacccccgcccgctatatgcgcttgggcgccctgtatgcaccctctctccgccgtgtatgtacttcgcaccacgaacccgtgtcgttgtgctcgcgctgacccacttctctgcggcgcccccgcgctttatattcctctctatcgtggcccttgcgccggtggtctgttttaatatccccctcttatgtggcgagccccccgtttctctggtaaacatctcggttttacccccctcggttctcaacactctctcccccacatcttgtgttctctcacccgctatttattcccgcccaatttttccgcccacccccttttgataggcgctaccccaaatgtacgcgcgcccaggtctccccaaaattacaaataacaaaca

SEQ ID NO: 616583 - DNA, 207 bp, Homo sapiens
ctatatgtggtgttaccgtcagatagaatattatgattctaggacgacaatcatctaagataataagataataagagatttttttattagtcaatttcagttccacttgtggtatccagatgtttatctgcagggtcaggtggtacgtgataaatccagcagttgttcaaattcggggtggtggcaaccacctggcataggtgtatc

SEQ ID NO: 616584 - DNA, 1748 bp, Homo sapiens
  misc_feature (415)..(415): n is a, c, g, or t
  misc_feature (527)..(527): n is a, c, g, or t
tggggcaaaggaattttaaacctgtaaattaaaaaaagaaaacattgttcacacagaagaattatctggcgttggagaaatcaaagaacattcaagaaggtggtcaacaaaaaaatttttcaacaccccaaaataatggataaacaatagatggtatcctctggtgaaaaatctgggactaaaactaatctcagtccattcagggtttattcagtattccaagagccatggaagcggacaacaacctaaagtcatcacaaaacattcaacaaaacagaaaaacaagggagatccggaaaaacacgggcggcgaggtgagcgcgcggagccctcggcggtgggaacgccccggaccagaggggcccacgcgcagggggtggtctatgaggcatcacctcaccacacctttatccgnggagagaccctctaaggggcgcttaacaaaagcgcctctatgaccagtggagacccgtggcgctcaagagtgatggggcggagaagatggatgacatcatatatatataaanaccttcgagcgcaacaaaaatgtgtctctccacaagaaatatcagtcagtgggtcatctcacaagcgcgctactacagagatgtatataaacgcggcggggggaatctcataataagtgagggtcgccccacaaggtggggggggggcgaccaaacaaggcatcacacaacgggcgtgctggggagcaaaggcgcccatccacagaccgatataaataggagagaccacaggcagtgtgggggaaacagtcatcaagtaagaggagacacaggggggaggggaatccacccactaccgtgatggggaaaacaaagtagaaaacccaggagggccgcccactatttgggggggccacatagtgagttacacatcatagactgcaggcgaccccagcgagggtatgtagtagattcacaaacaaaagggagagacaacacccaaggcaaagtgtgatcttgccacaagatgtcacaccggcaacacaccaagtgaggggcggggttagcaaacaaccccgaacaagaggagagaggaaaggctaccaatcactagtgggggggcgactcccaccccacaccaacaagcgtggggggatacaacacaggggcgtagtatcgacgcaccaagcaaaggaacaacaccattgaaaaagggaggaccacacactatgagtcgatgatacagtagaaggagcaacacggtggagcagtgagatcaactggacgaaagcaaacgggagcaacaaccacaaagagaacaccattagtcagtgagaaccagacccgagcgactaaaaacacacctcgcgaggagaaggatgcgtgtaagagcaaaaagacacgcgtgggcacccaagtggggagaaacatgtagtccaacccaggctcgacacagagaggtaggagagagacaaaaaatatatccccaacaaactgtggagtacgaccaacggcgtgatacaagaccacaaaaaaattaccacctacgcaacgagcaaaacggtgcaaacaggaagactgtagcgcacactaccatgtcggctgccaacgagttcgaagacgcaaacagaacaacaagaagtgaaccaacagagcaggcaggagaagaagaagcacggacgcaggaggacagacagatgacacgtagagagactagcaaactagaaaaccttgcgtctgcgcggccgctgcgcgcctccctcgcctctcctagcccctgat

SEQ ID NO: 616585 - DNA, 393 bp, Homo sapiens
cgtcgacgttggattggacaagctaagaaggaagcaagctggataggcttgtgatcgctgggcaggagcctacagctcctctgcccagagtaggataaaatttgtagttctcagggattggagagatcactcaacagttaagagcacttactgctcttgcagaggatccacgttctgcgcctggcgctcacgtggtagcaagcaactattcacaattgcaattccagggtgtccgacacactttcgaccgggcactggatgcctgtggaaaacactcatccacataaatctaaatataaaatgaagctccccacttcgagattattccagggcccaccacctggagctcctcccacacacccacagctctaccctgggaatgctagtcgacgc

SEQ ID NO: 616586 - DNA, 966 bp, Homo sapiens
  misc_feature (18)..(18): n is a, c, g, or t
  misc_feature (223)..(223): n is a, c, g, or t
  misc_feature (248)..(248): n is a, c, g, or t
  misc_feature (252)..(252): n is a, c, g, or t
  misc_feature (265)..(265): n is a, c, g, or t
  misc_feature (287)..(287): n is a, c, g, or t
  misc_feature (375)..(375): n is a, c, g, or t
  misc_feature (387)..(387): n is a, c, g, or t
  misc_feature (394)..(394): n is a, c, g, or t
  misc_feature (407)..(407): n is a, c, g, or t
  misc_feature (411)..(411): n is a, c, g, or t
  misc_feature (418)..(418): n is a, c, g, or t
  misc_feature (420)..(420): n is a, c, g, or t
  misc_feature (446)..(446): n is a, c, g, or t
  misc_feature (585)..(585): n is a, c, g, or t
  misc_feature (606)..(606): n is a, c, g, or t
  misc_feature (611)..(611): n is a, c, g, or t
  misc_feature (617)..(617): n is a, c, g, or t
  misc_feature (795)..(795): n is a, c, g, or t
  misc_feature (821)..(821): n is a, c, g, or t
  misc_feature (903)..(903): n is a, c, g, or t
  misc_feature (932)..(932): n is a, c, g, or t
ccctggaaattaatcccnagcgtgcacctttagtttgttcagtgatagtaggacatcccacgagccatcatatattttcacgtttttatactcaatctactttttccgccatcttttgggaactatcccaagataatttactgcataagtgcatctatcttctaaaagacatttgggatatttcttagtctgacctctgccccctgagacactctataaaggnaacaatcagaaaaatttaacaaagnaatnaataggttaagangaaagccatctaggcgtttgcnctgggtttgcgacagtgccattgctacatttgagagctgtagttcttcctcacattttaactgagagccactagttatgttacttaanatctccccattngatgagncagttgctgggcnactnaaaagtncnaaatatcacaaaatcaaaaagttgcnagtcataagggggtttccgcatcctagcatgtgtgtgtgtgtgtgtgtgtgtgtgtgtgtgggggagggcgttgcggtgggccgttgcaattgctctcactccactcccccacctcctcctgtgtagtctgcctgcggngcccgcgggggtctctcctcngtgtngtgagngcgcgggccagcctcctgtgcaaaggtgctctgcagcgtcgtgatccagggattttagcatctgtcgtcgcttgcacatcctctcttacccctctgctatctggtggagttgggcgagggtctccagggcttccagagagtgtcgtttacgcatgtgacttgccatgcgctcaaactnaagcgccgccgggggacttactgatncccacctcggccctcctccactttgtcctcagtcttcaggttttcctttctgccgctagggcctaagttgtgggtcaccatnactcctcagcagacattggagtgcacgcntcgactgccgtcaccccagtgcttatcactgcct

SEQ ID NO: 616587 - DNA, 124 bp, Homo sapiens
cgatcctgtaacaccctcctgtaacgacagcctcctccgtctagaatggtttatatctgggatcgcgatttttcttttcttggtggcgctgttacgtgcggggctcgttaggcgtcgttacgga

SEQ ID NO: 616588 - DNA, 960 bp, Homo sapiens
gtgactcccagcaactccggacgtgtgcggcgtgagtcgcaggccatgttcctggttaactcgtcttgaagggcggctggcggcgcgcggccggcggcgaggcgggggcctgggtggggcgcctgggaaatgtgcttggaggcctgatcagacggggccgggggcggcctgggcggcaggcggcgcgcggcgctgcgcgttggctggaggcgggcggtgcacgcagccaaccgggccatgccgcatcctaggcggcagttcatcaggcgccaatcaagcgacgccgggctgcgccagtaacaacccgtgaagcccccccgtctcccctatgacaaatacagttactccaaagattggaggcgccaacagagaagtgaaggaagtctcccggacaagtgtcccgggacgacttctttggacacagcttggataggaagaatcgacttggacgggtcagggcccctcctcaactggcgttggctaattaggcagttcagccctggaagcacttcgggctcccactccacagggccgcaatctatgtctgcagacgaacaatacttggagggcgccatgttgaccccaacaaggctttggggtagcacctacagtactgtgttaacgcagtgttctcaacaatcgcagggggccacaatttttgcccttgggcggaatgttctcacctgggctctagggagcctcctacacaagcgcctgtccagggggtctcacaccatgtacaacaagggccttgtaaaacacacacgcggtaccttttccatggactgtgtgcacgcctagacttgttgtgcctacatgccacgaggggcatctcactagtaggggagacaacacagccctgcaggccttgacaccctcacgggttgaccaagggccaacaccaaactgggcgcactgggcccagggatgcaattcggcacggcgccacgagaaatatcg

SEQ ID NO: 616589 - DNA, 147 bp, Homo sapiens
tccggcgagcattggatctccaccagcggccagaactggtgcacctccaggcccgcctcgtcctgcgtgtcgtggttgaactggttgggcatgtgcgtcaggttgtagccgatgccgcggcacatgggcaccgtgatttcctggcac

SEQ ID NO: 616590 - DNA, 670 bp, Homo sapiens
aacctaggtaatgcctaatccaaggcttcccaacatcagcccgcacatcctgttcggtggggggtgtctaggacgtgggggtgcagttgtgagcttcgcgatgattttttccctctagaatctatgaggcttagtgagatttgtactggacggggtagctacgagtggttggcggcgaatctcgtgttgagctttagtttttaggatgtcgtggactgtttttctttgtttcgggcgtgagctttgctttttgagacgtatctctataaattttagcgggtatgtggtagcgtacgtctaccgctatgatgtcgcgcgaggcgatttcgctaccctgaggatttcctatattctatctattccctaatctccccccgggtccctactagccactagtctttttgctatctccctgattttatctccgtcaggaatcgtgtgattaagatcgcgcgaaatatgactttttcgagttaacttctttcgcctaatgaggcgtgtacgtatggaattcctccgtattattttaattgaatttttataactcagtgacacgcttcgttttgacgctacgtgttctgttatctaggtacccgcgatttgtaccctcgcctgctaggaagtgtcttaaattacttgcggaatttaagggttgtagatgggactactg

SEQ ID NO: 616591 - DNA, 197 bp, Homo sapiens
gaaggctgtttcctgggagaagctgttttttaacatcaatgcacacgaagcagccgccatgcgggcagtttaccaggcagctgcgctcagcccagcctttaaagtgaagccatttgtcgtccgagatgcattggtctaccccatcctggtggagttcacgagggaggtggaggaggagcctggtattcacagcctga

SEQ ID NO: 616592 - DNA, 806 bp, Homo sapiens
  misc_feature (609)..(609): n is a, c, g, or t
  misc_feature (708)..(709): n is a, c, g, or t
  misc_feature (711)..(711): n is a, c, g, or t
  misc_feature (715)..(715): n is a, c, g, or t
  misc_feature (719)..(719): n is a, c, g, or t
  misc_feature (722)..(722): n is a, c, g, or t
  misc_feature (724)..(724): n is a, c, g, or t
  misc_feature (726)..(726): n is a, c, g, or t
  misc_feature (728)..(728): n is a, c, g, or t
  misc_feature (732)..(732): n is a, c, g, or t
  misc_feature (743)..(743): n is a, c, g, or t
  misc_feature (750)..(750): n is a, c, g, or t
  misc_feature (758)..(758): n is a, c, g, or t
gggagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacattcaagcactgaccgaataagcttatatcaagataacactggaagagttactttactgataaaagatgtaaacaagaaagatgctggcgtggtatactgtgtcagcagttaatgaagctggagtgactacatgtaacacaagattagacgttacggcacgtccaaaccaaactcttccagctcctaagcagttacgggttcgaccaacacttcagcaaatatttagcacttaatgggaaaggtttgaatgtcaaaacaagcttttaacccagaaggagaatttcagcgttggcagctcaatctggactctatgcaaagtgaagaactttaataactttaccaacattggaaaacagcaactacaccattagtaatatatttgattacattttctgtgaaacttaatccatagctgtattaacagataatagttntaattaggtaatatagtcactatatatttataatattattatcctttgatcttgcacattctatggtacccctcgattgtgaagcctaaggaaatcggnntntggnttgnacngngnanatancttaaatcggntttcttngtctgccnttaaatccgcgtatcgtcacttaccccttgtggagcgggggccaaggc

SEQ ID NO: 616593 - DNA, 932 bp, Homo sapiens
  misc_feature (204)..(204): n is a, c, g, or t
  misc_feature (209)..(210): n is a, c, g, or t
  misc_feature (275)..(275): n is a, c, g, or t
  misc_feature (278)..(278): n is a, c, g, or t
  misc_feature (735)..(735): n is a, c, g, or t
  misc_feature (834)..(835): n is a, c, g, or t
  misc_feature (837)..(837): n is a, c, g, or t
  misc_feature (841)..(841): n is a, c, g, or t
  misc_feature (845)..(845): n is a, c, g, or t
  misc_feature (848)..(848): n is a, c, g, or t
  misc_feature (850)..(850): n is a, c, g, or t
  misc_feature (852)..(852): n is a, c, g, or t
  misc_feature (854)..(854): n is a, c, g, or t
  misc_feature (858)..(858): n is a, c, g, or t
  misc_feature (869)..(869): n is a, c, g, or t
  misc_feature (876)..(876): n is a, c, g, or t
  misc_feature (884)..(884): n is a, c, g, or t
cagatgattgcacaaaatgatagtgtctgagaagggtcttcattcactcatctttgaagctagtcagagcttcagatgcaggggcttatgcatgtgtcgccaagaatagagcaggagaagccacccttcactgtgcagctggatgtccttgcaaaagaacataaaagagcaccaatgtttatctacaaaccacagagcaaaaanagttnnagagggagattcagtgaaactagaatgccagatctcggctatacctccaccaaagcttttctggnaanagaacatacatgaaatggtacaattcaagcactgaccgaataagcttatatcaagataacactggaagagttactttactgataaaagatgtaaacaagaaagatgctggcgtggtatactgtgtcagcagttaatgaagctggagtgactacatgtaacacaagattagacgttacggcacgtccaaaccaaactcttccagctcctaagcagttacgggttcgaccaacacttcagcaaatatttagcacttaatgggaaaggtttgaatgtcaaaacaagcttttaacccagaaggagaatttcagcgttggcagctcaatctggactctatgcaaagtgaagaactttaataactttaccaacattggaaaacagcaactacaccattagtaatatatttgattacattttctgtgaaacttaatccatagctgtattaacagataatagttntaattaggtaatatagtcactatatatttataatattattatcctttgatcttgcacattctatggtacccctcgattgtgaagcctaaggaaatcggnntntggnttgnacngngnanatancttaaatcggntttcttngtctgccnttaaatccgcgtatcgtcacttaccccttgtggagcgggggccaaggc

SEQ ID NO: 616594 - DNA, 892 bp, Homo sapiens
  misc_feature (633)..(633): n is a, c, g, or t
cactcatttaattggatgtatgtctctcggattgaccaacagtatgttcttctcatgactaacttgatttgagttaagaatgctcactgtacactgaatgtcaataactcagctaattcacactgatgtgtcctgtgtaaacaatatgtagtccccgtccagtgccattcacctgtgaaggcagggttacagctgatgccagctatcagaatcactatgtttcacattgtggaaatatgaccaagtgcctaacacataattgcaaagtcatttgcgtactatggtatacaaaattttatcattacaaaatagtatcagcgttttttcacttaccggaaaatagatacatcttcattcaaatattcagtgcgtaaataattgccttaaatggagtcttgctgtggaatccgagagtttggaagagtcaaagggccttgtgaagacatttcctgttgccattctatttacttagatatgcagatagcttccacactgagtgggaaagtctacttaggtgaagtggtaaaatagtcactacgatgtctaaactagcgcactgatgagttgcctaatttgtcttctccaatcgataaccactggtgccatctgttcactacttactcagaaagacanttagctggatggttgaagtgtgtagtgcatgtgacgtattttaccgtgtttcggaacagatctggtgttctgtgtccttatttgcagactaagtgctctactgtggtcgtctgggtccatatccgattcatatattaccgcggggcgcccggtaaattaaaaacgtgggacccaccgattttctttcgcctattttgtggaaaaacaaaaagggggggggcgaaaaaatggggggaaaagatcacctgtgtaacacgag

SEQ ID NO: 616595 - DNA, 940 bp, Homo sapiens
gggagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacttctgacttccttacaaccttccgtaacttccaggcttgctggccccaacattcagggaccccaccacctaccaggaacaacatcattatagtaataatcttgcacattacatctatccatataccaaactaagcaatgtgataactacgaacgtccaagaacacttacatccagtacccaaaacccatgtggctccagattcgcagctcctggaccagaaagctccagcttctctagccagaccacaccagtcttccattatcatccagcaccgccagtgtacagagcacagatttctagcctcctcaaacactgagactctcacatcaccatgtcactcatctgccttccctgctactccccagcagcattgctggctccaacccaaggccacaagggttacgacccaccttattacagtacccagcaagcttcctcaagatccatattaccatcaccgcctgattacattagcagtaaaatcctaccgcaatggataccacttatcagcagacctacagtggcaaacctatcaatgcaatgctcgcaaatgaaattgcaagcgccgttcacaggaacttcctgaatactgcacattcacaggcatcatcgcagcgtttgtgtacgaattggcacagcactctcacatgttcaggcagccttttatcataagggaactcggtcacactttagtcgaagtgcgcacttgtaggcaccagctgcgggggtatcacccaacacccaggggccaatctgcatacacca

SEQ ID NO: 616596 - DNA, 1043 bp, Homo sapiens
cgccggcccgtttctctgctactctgcttctttttgtggttgtgcttggctttctctcctccgacatcgcggtgcgtttcgctcttgggcgtgtgtatgcgtctcgtgtatccttgttcggcgtgctggtgtgtggccttgctcgtgcggtcgcgtcttgctggtcttgctgccgcgctggccccctgcggttctcgtcgggcggctaggctcgtgtggcgaggtgccctaggctcgttatcctcttcgctttccgatgggctgcgttagtgactctcccgttgcccgttgctcggtgggacgtggtgccctgcgcaattgacaccctagtcccttccgtggtcacgccacgtgtcctctttcgattgtctcgcgtcgtcgtttcccctggggctatgtgctttgtcctgctcaattatgcaatgtgcgtcctcgtcccggctgtgtagctccctctgtgccacgccctggtgggttccgtggcgcgtgcacacgggctgtcttcgcatgggatgcccgcgtcgttgctcattccctatctcgtctatggttctgctcacctccatccccccattcattggccggacgtcctttggtgccgatacctgcgcgagcgttccatcgcagacccggcagtaccgaccattatggattctcgctcaatgcactcaggatgcccctcgtgttccgcttctccccttcagtgcccagagtccctcgcgcatgcctcagcgggtacaggcgtgttcagaacatcctgccacccagacacagtggtattataaatcccgctccctctccaggtcaacccccacccagccagccgaggcctgctccatccacccttcccgggaggcagccccgggatgctgcgagttggtggaggggccaggctggacgcttcactgtgggagtcccctccagacctggctggcgccctgcatccacagaaaccacgagtggccacagaatctcagtggttctcaaggactaacctgtgggggctagcaatagcgacataaccctctcttggcttcttagtt

SEQ ID NO: 616597 - DNA, 310 bp, Homo sapiens
  misc_feature (66)..(66): n is a, c, g, or t
  misc_feature (223)..(223): n is a, c, g, or t
gtgtggtgttctagaggatccctgggcgcgatccaggtggccaggactagatcataacgacagccnccctaattttggtccccacttccagcttgggacaaatcagagaaagccaaacataataaagtggcacaggatgccccatttctacttagcccaccggcagctttcccacaccagcgggcttcatacaaggcatacgggtgccttccctcttcccacngtaaagctttcccactcctctgcctgccttgggcctctgacaaaatgcaagtgatggtggctgtcagttatgaatctagtccgggcc

SEQ ID NO: 616598 - DNA, 224 bp, Homo sapiens
cattttcacaaattatagaagatggatttgttgggttaaaaagttcacatattttagaggcaattgatagtgttgctaaattgctccctagatcaatttccccgggtggtgtaggagggcgcaggaggcattttagcaaactaacctaagttaacatttgtaaagtgcttgaataatcctgggcacactgaaaggtcatatgtacatattaagtcaaatgaatt

SEQ ID NO: 616599 - DNA, 132 bp, Homo sapiens
tacttaaggatccctacaagaccttaacaggcaagctagggtggcagaagcaggaagcaggcagagcagggcagaagcaggaagcaagcaggaagcggagaagcaggaagcggcagaagcaggaagcagaag

SEQ ID NO: 616600 - DNA, 486 bp, Homo sapiens
gatcagctacatacaaatcataaaaatgctctgtatgacaaactgacaaacactcccagcctacgcctcccatatctgagtaatataaacacaaagtccctataccagaaaacttggacagttgaaataacttaacagtaactatattatatttataattattatgtatgtaggggaatgtattatgccaatgagctgaggcagaaactgtccaccactcatttattaattttacatttattttgcacacatctccaattatcattttcattgcatttttatacctatcatttggaaggaatctacaagtcaaaacgagtatgttgatcttgtataaaaaaaaaaaaaacaacacagaagtgtccagttttaatcaatcaacatattattgctgtaaaaattagagatatcatgaatacctgatggatccagtacattatatacagaaatgtgatctcagtcacttaatctgccaataatatacca

SEQ ID NO: 616601 - DNA, 472 bp, Homo sapiens
gctgtttctccctttggatcttccagattacttaattgaaactcattccatggctgggcatggtggctcacacctgtaatcccagcactttgggaggctgaggtaggaggattgcttgagcccaggaattcaagaccagtctgggcaacacagcaagaccccatctcaatttaaaaaaaaaattatttggggccgggtacagtggctcatgcctgtaatcccggcatttggggaggctgaggcaggagaatcacttgaacacagaagtttgagaccaacctgggcaacattgtcagaccccccatctctataaaaatttaaaaaattagccgggcattatggtgtgcacctgcagtgccagctactcgcgagacttaggtgggaggattgctcgagcctggcagtttgagactgtagtaagtatgaccacgccactgctctccagcatgtgtgacagagcaagccccatctc

SEQ ID NO: 616602 - DNA, 101 bp, Homo sapiens
aaacaatatacaagagccggagaacaaaatgaacgaaaatctgttcgcgttcattcatgcccccacaatcctaggcctacccggccgttaggccgatctga

SEQ ID NO: 616603 - DNA, 1054 bp, Homo sapiens
aaaagcaaagaaatgcttggtgggaatcggcagaggaggcgtgagtgaatggtgattgccagcgtggaggggctggtgacgttgctgggctggagaggacttcccaacatcgtcatctgtggcccactacgagcctttggagtggcccctgtgctgtcgctgggctgcggactccaactgggagcggtgtctctgtgctgctggagctggactgcctcttctcccggatctacacctacaagcgcatgcacgcctgctacaactcctgttctttgctgtctggagcgagtgcaagtttaactaccagtggaaccaagctgctggctggaagacaacctggaccacacagactccagcctgcttcagtgacaatgttggacttcgtgctgtgcctggacacctgtgggcctggtggcagcagcctgcacctgcacgtgtccaaggcctgcctcgggagtggcaccctgaagccactgccttcctgctgggagctggagactggttgtgcccggcaccagttacccttgagtgtactggttctccatggttggcacaagctggatcaactggcggcgtgacgtgctggactgggagcatgagcgcttcgacatccgccgattgtcctgccttcacgctgtccacactggagagcacgctgttgacggccagcgcgaccagaatcatggacgtgctggtcccggttgattctaaagacctgaccgtaaaagaggaatcattgcagatggcctgatcgaagtcatctaaaactgagtgagaagtcggagacccccagaaatgctggtgttcacagagtaagatgatcaagaagacgcagtggactcggtatgaagtgggacacaagcaacgctggacgtgtaattggtggcacgggcaggcgctactcatacaagtgtaacatcttgactgttctaagcctaaaaacacagttatgtaccagcggccaggttgcatttagcaactgaacaggtaagtcgagacagaagctaacgactgggaatgacacatgggaaacaaaaatcaagacattcttcat

SEQ ID NO: 616604 - DNA, 372 bp, Homo sapiens
tcaccctaataattatgaagggagaatgaagaagccatgtgaaagcaacttctagctgccagtcaggttctgctctgaaggctgcctatctgcggggacatgtgacttctggggcttccagattaagtaatgctcaccccacatgtctgaaattctccaaacactattccggccctgctgtgattcttcagagcagagtttctttgcctttttagtggtattgcatccctcgagcaacttgtgtgagcccttcttcagaatacagtttctaatggcagaagtgtccaacacatgtggataattacgggaagtcaatgtcctttagaaatcctttatcaaacaatatttttcaacatttgtgtgacatattca

SEQ ID NO: 616605 - DNA, 296 bp, Homo sapiens
  misc_feature (210)..(210): n is a, c, g, or t
ggatcccccgcttatcggagcggtacgcgtcggtgcactgacgtcacacagctggatcagttcgccccgctcgacagcgtcatgcaccaggctgcgccgctccagcgtgatgccttgcccaggcgaacggcttccagcaccaggttggagtcattgctgcataaacccttgcgctcgctgcccatctcgacacctgcagcctcgcaccangacaaccaggactcagtgttgtagatgatggtgctgtcgaccacctcctgcggcgtctgtggcaggcgcccaccattgaaatgagg

SEQ ID NO: 616606 - DNA, 2006 bp, Homo sapiens
cattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctgtatgtcatattattctttttcatggctttgtaattactgtagtattgaatagtttttaaaatatttaaatttttttcatggctgtgaattatttagttattgttttgtagctgtaatataggcccttttatataatagattaaagcttactggtaatcaagg

SEQ ID NO: 616607 - DNA, 798 bp, Homo sapiens
gagcgggcctttagtgcgcgctgcgcagacttcgagcgtctacttccggtgtgtgcccacagtcagagggtcctgaagaagcaggtatatcggcctactggcatcccatgtacaagagcgggcgacctggtgtttgtcaatgatttcaggtgctatgcccacttggcctgtcgattgaatcagacgcatcatgacctcaggaccaaccgtgtaccagagtgtttttcattcgggatcccacgagactggccttcctgagatcccaaacgcctgttcccgtacaaggagtgcaaggacgaagttcggcaagcccaacaagaggcgcggctttcagccgcgggggctgtgggaaattcgaaaacaaccccatggtccaggcctccgatctgcccattagcctcagagaagggcagcggagacgggccttggccggagcccgaggccgcagagggcgacgaggacaagccgaaccacgctggtggcggcggcgacaaattggggaagcctggacgacgacaagcccactgaggaggagaaggggccgctgaagaggagcgcgggggacccgccggaggacgcccccaaacgacccaaggaggcagccccgagcaagaggaggaggcggaggcggagagggcggcggaagcggagagggcggcggcggcggcggcggcagacggcgtcgacgaggagagtccgttcctcgtggcggttgagaacggcagagcccctagcgaagccggggctggtctgcgaagccagctcagccagaggacgaggagctccggggaggaagac

SEQ ID NO: 616608 - DNA, 656 bp, Homo sapiens
  misc_feature (44)..(44): n is a, c, g, or t
  misc_feature (452)..(452): n is a, c, g, or t
  misc_feature (614)..(614): n is a, c, g, or t
  misc_feature (618)..(619): n is a, c, g, or t
  misc_feature (622)..(624): n is a, c, g, or t
  misc_feature (628)..(629): n is a, c, g, or t
  misc_feature (633)..(633): n is a, c, g, or t
tgtaatacacattttccatgaacttttgaagacctctcaatttnataagtatttttcttgctctcaatatttttcaaaatttctctttacttggctgttggctgtattttaatagtcttctttctctattgatagaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagcgtaagttattttatttgttcacattctgtgattccatatactacctcagggtattctttgctgcattaacaaaagtttggagggagatgaagggttacttctaagtatcnaccattatggacagtggagcaagaggagagtagccaattgtgatcatgtgagaatgacttttgaaagcattaaagtacagtgtcgtcagtgcaattgtcagtgttccatattgcataaacaaagcttaagagatcctagagatttgtgggtaatgttagagntacnntannnagcnnattngtgaattccaggaccatgtcaat

SEQ ID NO: 616609 - DNA, 135 bp, Homo sapiens
gtgggcgaccagcgcagcgaaggaggcctcgctgaagaacttctggatcggcgagctgacttcgccgttgtcggcgatcttgatgtaggccaggcccttggcgccgtacttggcggcatgcgcggcgtattcgtc

SEQ ID NO: 616610 - DNA, 193 bp, Homo sapiens
  misc_feature (144)..(144): n is a, c, g, or t
  misc_feature (163)..(163): n is a, c, g, or t
  misc_feature (178)..(178): n is a, c, g, or t
ccggtcactcgctacacccttttagtatgactttagtggcatctcacattgacatgttttcaatttcattcagtttatttttatttattttttaaattatttatttatttatttagtttatttgtgagttgtgtagaaattganacgttcaattttctacacntactgtttttatggnttcatcattggtgta

SEQ ID NO: 616611 - DNA, 2591 bp, Homo sapiens
  misc_feature (2217)..(2217): n is a, c, g, or t
cattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagantgagaagtcatggaatgacaggtgcacgacaagatttacatttgagctgccaaatcacagatcgcgttttacttcaaaagtttctgccacagatatgtcaaccattcctccttctgccagtcttaaccttccccctgttaccatgtcagggacatatataatggaagaacatgatagtcattcggatcaggtgtggagtatagatgaacttgcttctaaacaaggttactatttacagggaacattatctgcgatgtgtggcagcaacgtggttccttggaacataatcttacaactgatcttctaaaccacttggtattggtacagaaggtgttcatgaaggaagtgactgaagtatgtcagaaagtttctgg

SEQ ID NO: 616612 - DNA, 2641 bp, Homo sapiens
  misc_feature (2267)..(2267): n is a, c, g, or t
cattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagantgagaagtcatggaatgacaggtgcacgacaagatttacatttgagctgccaaatcacagatcgcgttttacttcaaaagtttctgccacagatatgtcaaccattcctccttctgccagtcttaaccttccccctgttaccatgtcagggacatatataatggaagaacatgatagtcattcggatcaggtgtggagtatagatgaacttgcttctaaacaaggttactatttacagggaacattatctgcgatgtgtggcagcaacgtggttccttggaacataatcttacaactgatcttctaaaccacttggtattggtacagaaggtgttcatgaaggaagtgactgaagtatgtcagaaagtttctgg

SEQ ID NO: 616613 - DNA, 119 bp, Homo sapiens
tcatcctgcggtcgacgtgtattcacactgcggtcatgcgtccctgtacagttccgtcgacacgtgagcaccgtctgacctccaaatatcgtaaagctggagcctggtccgactctaga

SEQ ID NO: 616614 - DNA, 1435 bp, Homo sapiens
  misc_feature (1061)..(1061): n is a, c, g, or t
taaaacagtaatggaattcagatatcctgccaccacatttcccaaccttttaaactcttacgtggtatgttcttaaaggatttagacagacctgatttaaaatatctggctctactattcactttcagtaggaacttggaaaaatgttgaagaaatttttaatcattttgttggggattaggagaaagaggactggttgggaatgtgaaggaaagaaaggtaagacagtgtttggaatgtccttccatttttcagtcttcgtatctaaaattgtatattttcatttacttataaaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagantgagaagtcatggaatgacaggtgcacgacaagatttacatttgagctgccaaatcacagatcgcgttttacttcaaaagtttctgccacagatatgtcaaccattcctccttctgccagtcttaaccttccccctgttaccatgtcagggacatatataatggaagaacatgatagtcattcggatcaggtgtggagtatagatgaacttgcttctaaacaaggttactatttacagggaacattatctgcgatgtgtggcagcaacgtggttccttggaacataatcttacaactgatcttctaaaccacttggtattggtacagaaggtgttcatgaaggaagtgactgaagtatgtcagaaagtttctgg

SEQ ID NO: 616615 - DNA, 342 bp, Homo sapiens
tcgagctcggtcccttattcgtgttgcaccacgggcagcctgccctgataccccacagacagtttttggtgaggggggtccaggtccccttgctggtacctccctcaaccctcttttgttattccatctgtgcctgttccttaccacagaccaggcacacagaagcccaccttcttccccttaggaggagggatagtcaacacccctgctgtctctctgtcactcacacactgatttatggggtctgagctgggctgtacctgcaggatggacaggacccagcgccctcttctccccacaggctgtaaatagacatccaatcaccaggacagacaccaaaca

SEQ ID NO: 616616 - DNA, 2313 bp, Homo sapiens
  misc_feature (2109)..(2109): n is a, c, g, or t
  misc_feature (2271)..(2271): n is a, c, g, or t
  misc_feature (2275)..(2276): n is a, c, g, or t
  misc_feature (2279)..(2281): n is a, c, g, or t
  misc_feature (2285)..(2286): n is a, c, g, or t
  misc_feature (2290)..(2290): n is a, c, g, or t
cattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagcgtaagttattttatttgttcacattctgtgattccatatactacctcagggtattctttgctgcattaacaaaagtttggagggagatgaagggttacttctaagtatcnaccattatggacagtggagcaagaggagagtagccaattgtgatcatgtgagaatgacttttgaaagcattaaagtacagtgtcgtcagtgcaattgtcagtgttccatattgcataaacaaagcttaagagatcctagagatttgtgggtaatgttagagntacnntannnagcnnattngtgaattccaggaccatgtcaat

SEQ ID NO: 616617 - DNA, 193 bp, Homo sapiens
gttatgttctttggagtacagtactgtagccataaacacaaactaagatgatcccaggagacacaacgggaaagatggtcttgaagtgtacatggtgtactggtgagagtgatagatgaagattcgggagaaaaggggcagagatgaaaaaagggtaccacgatgggtacacatggtggagcaagaagatgtc

SEQ ID NO: 616618 - DNA, 180 bp, Homo sapiens
gacgacgtgcttcctcttacctttttggaggatctctcctgctgtggtggggctggcctgccgccggtgtcttacagtgcttgacttggcccgcgacactttagcctaggagcctatgctatttttagccatcttctagaatggtggttcttaaactctgcagtgtgtcagaaccaccag

SEQ ID NO: 616619 - DNA, 228 bp, Homo sapiens
ctagaggatccccatactgacgcgatatctgcatacccttccaggcagcagcatgcacagctgtatctcccaacttgatctgctggttcagttcactatttaggttgagtaactagcatttccactatatctatgtggaccccgtggcaagcccagtataaggcagtgcttccagactttgtcataagccagttaacacaccacatctgattgatccaagacatctca

SEQ ID NO: 616620 - DNA, 933 bp, Homo sapiens
ttttttttatggagctttggtcactttattggttaaccaaggaatattatccaaaattagagatgtacatggtaacttaatggtacaacacaaaattatgctaatggtaaaagcctacggggatttaccaaatactcataagggtatttttacatggactatagtgaacatgtgctcgcgacggctaataagttataatgggtttaatctctaagaaatccatatggcaaatggttctggtctagaaaaattcacacagccttaaaaatggattaacatccagtttgaatcctaatctacaaatagatcataaacagcaaaatataactgataattctttcaactacgtgtatcaaacgtgaatgtagctatcggtaggtgcacataagttcaaaatgaggaaaattaaccaaaaatccactgaacagtacaggtgtaatctattatgcaactggctttaacagtgaacatctatgtactcaaaactctgaactacgaagggtccagcatccattccttggatgtactgcaagtaggaattatcgtcttccaatagggattcatgaagccatgtgcgacaacccatggggtacaaccagtcaccgtaccaagggttacaccagcctatgatatgggtcctaccaaagtatcacgagaactatatacaacacgccacagcatatatcttatacaccagatacaaagagggacggggggcccccaagaaagctaaacaccccgttgtgggaaaaaagcgcacaggggaacaagactacacaagagctacaaacgcaaccaaaggagaaagaaaatgacaacacgaacacacagagaaaccatgggcaaaatcccaagctggggcggacattgtaagaacatggggtggcaaccaaaacaaagggggagagaagagaaaaaacaagcaagagacag

SEQ ID NO: 616621 - DNA, 284 bp, Homo sapiens
aggactcctgatatgctgctcatttttgactagaaacagtaaagagcagcttattaagatcaatggaatggttctgaatgcctgtttctacagagggattaaattaaaattttttcttttttttctttttttgagacagtcttgctctatcacccaggctggagtgcagtggcacgatctcggcttactgcaatctccacctcccgagttcaagcaattctcctgcctcagcctcccgagtagctgggattacaggcatgcaccataacacccaactaattttt

SEQ ID NO: 616622 - DNA, 91 bp, Homo sapiens
gcgtggtcgcggccgaggtacgcgggatgggcaggggtgagagacattactgagcaccttggtgagcaagcctggctttaaagattggaga

SEQ ID NO: 616623 - DNA, 203 bp, Homo sapiens
agtatcccccctactgtagaacaattgtgacgaagtgaatatataaagatgagttcttcattaaaatcgaaacatggcacaaaccatacttgggatcattacaaaatgtacatcgtttagatccaaatcacatagaaaactgttgaacttgtccatattgatattgcagaatgaactcaagtttaaccagtcagcattaacca

SEQ ID NO: 616624 - DNA, 952 bp, Homo sapiens
gcctgcccccctccctcctgggggacacaaccattttttcctcctcttcatgcatcattcttgttcggccgcatggagtttcctcgtttcgcccttctcctcatgcccccttttcctcctttgttcgcagcgagggatgtatttccgcccctctccttcttctcccgcatttattattttttttttgctggcgacacggacaacaaatagtacgagcatgttttctccttcgtacatatacattcttgtgctttcatgatatttttttttcctcgcaccgctcttggtgaaaacctcacctcccggggcggggtgttgctgggcgtgattaattttattgcttctccttccgcggggtggtagtgaaatccttttcttctcctggtgaatcctcctctcttttttccctcatctgcttctgcttccctctctcccccaccccctctcagcccgctctttgtgtgacagaagagcaattggcatctattttttttatctgggcggggggaggagggcgcgctggctgtttgagagagactatctatgagtttttttcttcctcttctttccccgccctctctctcccgcaggcgggggggagtgtgtgttgagaacaagctaattggtggggccccgcgcggtgccccctacgggtggccccccccccccccccggcagcgcatgctcccccccccctcgcttggtcgttcttttctgcgtcctcctgctggtgagggggctgctcccccgctgttgggggcttcgtgattttttttttaccaaatattttttttcgtctcttgatggcggattggttttttttgtgattatcgaccccaaaccaaaaaccaaccccgccagtgtttttttttattttttttttaaatttttccccaaatttttttttaaaaggggtttttttaaaaaaaaaaaaaaaaccccttttttttta

SEQ ID NO: 616625 - DNA, 608 bp, Homo sapiens
aaatgatcattggaagctcctgcataccataagctactggaggtcagtatacatatttgtgtgtatcctggagtacctagaatacagtcttccatgtaagaagcattttacttgttgttttttgagatggggtttcactctgtcacccaggctggagggcactggtgagatcttggctcactccgatctccatttcctgggctcaggtgatcctcacacctcagccatccaagtagttgaaacaatagagctatgtcaccatagacctgtgtcaccatgctgggctgagttttgtggagatagggttttgccttgttgcccaggctcttctttaactgttgggctcaggtgttctgctcgcctcggcctctcaaagtgctggggttacagacatgagacattcagccttaatagttgtttaatctgaataaataaacaaatgaatttttatataatggaatgttataagtaatataataaacctaatgtatctaatcattaaatattgtatttaaaatattgcttacattgtattatttgttaatatttaaggttgtataagttttgacatgttatgttgagaaattatgccataattaaagaggaaa

SEQ ID NO: 616626 - DNA, 181 bp, Homo sapiens
gtgagctttgtgagacgtttgctgaattctcaccatggaagtgaatggagcaatggggctaaggtcatttgggggatgttttggttttttgtggtgtatgtggcagtttctctgtgggctggagggagtgtacaggataacgaacgcacagtgacggtttgggcacgtgtggcatcacccc

SEQ ID NO: 616627 - DNA, 577 bp, Homo sapiens
tactgaatctcctatctaaacgaaaatcttcattttacctgtagtatcttcgtgacaggtctctctgtttcgctggctggagtagcagtggtgtcatcataggggactagcagcctcaacctcccagtgctcaagcgattctcccgcctcagctctcctgagtagctgggactacaggtcccagctaattgttgtattttacagtagagcatgggtctcgctgtgttgcccagaatggaactcctggtctagaagcaatcttcccacctctacctcccataatgttgggattacgggtataaactactgtgtcccagatggtatcttcatctgttaaatgaaaataaccatggagagctgggggttccaaagcacttaggatgtagtacgtgaattgagagatctagtgtcctaattattatcatcattcattgctgaacgcagtcggctacagtcgcaaatacagcaaacatgattcaaactgtcttaaactatccgggaggctattggttcatgaaagctgccgttaggggatggggtacacttcatgtcagttcaaacccgtggctccatgttg

SEQ ID NO: 616628 - DNA, 371 bp, Homo sapiens
  misc_feature (8)..(8): n is a, c, g, or t
  misc_feature (50)..(50): n is a, c, g, or t
  misc_feature (75)..(75): n is a, c, g, or t
  misc_feature (94)..(94): n is a, c, g, or t
cttttggncccccgttaattacctacccctaatttaagattgcccatccntcctcctcacccattgccagactantcgcaacagcttccttaantgttttccttgtctcttattttttatttttctggtttgtctcccgcactttgcccagatgagagcacagcattggttaacatttctctgctgatctatactcttcaatggctccccgttacaaataaaggaaagatgaaacttcttagggtggcattcaaggcttttcaggacctccaaactcttcctttcctccctcttttccatattgagaagactgtgccatattctctgaacctattttatctgttcccatgcccaggccttggtcattggtc

SEQ ID NO: 616629 - DNA, 117 bp, Homo sapiens
tcataacgatacatcagctcatccactgtaaatgcatgaaaatagttgtatactggtattatttatttggttgtgttgttgttgttgttatactgttatttcttatttgtggttgtt

SEQ ID NO: 616630 - DNA, 324 bp, Homo sapiens
gtagagttagggtggagagatgaaattttatgagaaactatagttgtatttactaattgtgatcaaagtatttaataagactaaagggaaacaccacattttgaaaataccatcagaagtcttgggcttctgaagcttggaagacatttaactgacattgaaaaaggaaacctatgtgtggcaatgaagttatggtatgtaagaataaagaaaaggtgggattataaagtcagaaatttctgaagctacttaacttgatctcagaggtattatcagctaagacctatgaattggggctataaatccgttacgttattgggtcta

SEQ ID NO: 616631 - DNA, 642 bp, Homo sapiens
  misc_feature (272)..(272): n is a, c, g, or t
  misc_feature (622)..(622): n is a, c, g, or t
  misc_feature (642)..(642): n is a, c, g, or t
atacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaatntaaggtgtgggaaaaaaaaaaaaaacaggccagggagggccaaggatctccccaatttggggaacgcttattgatacaggttgaaacccaggtctgatctcaatttttattgctacctgtccccaaaggaaatttacctctaaattttgaggaatgcttgtgggcattctgtcaattcaatacctgaaagggatgctttccgggcttttacccagttgtgtcctgatctttggcaccctctgtgcttttatattccaaagaccagggttagcttcctccggtatcttttcactattatgacccctgacttggccttgacattttgtgcctaactttggcccaatctctgnctattagccctgtccctacn

SEQ ID NO: 616632 - DNA, 445 bp, Homo sapiens
atagtaaatacttttaaataagtgaaaaatgtccttcactctttagacccataatcttatctcaggaaataattgctattgagaaaatgggccatatccttcaagatatgtaacatggtgattgaacatcgtttcacattttcatatttcatggacatttgtgccaatacctattgatctatcttaatccttttcatggttgcataatattttattataagggatgtatcacaatttaccagtaccagtcaactgctggaggcatttaggctccttctgatatttgctttgagctctttatataattaaaaattaaccccctcagccaggtgtggcagctcatacctgtaaatcccagcactttggaagactgaggtgagagaactgcctgagtgtaggagatcaccaccaacctggtcaacatagcgacactttgtctgaacaa

SEQ ID NO: 616633 - DNA, 669 bp, Homo sapiens
agcggacgtattcggcagtcgtttccgcgatgctgcctctgctgcgctgcgtgccccgtgtgctgggctcctccgtcgtcggcctccgcgctggcgcgcccgctcgcctttccggcagctcctgcagcggcaccccgggtgtgcacccagcccttcgggctgctcagcagtgctgcgcaggttccgagcggcggcgggccctccatgctgtggatctctgcagtgacccatgcagcctgtggctgtgtgctgcggctcgctgcacaccgacggagacaaagcttgtgtagatttcctgagtgatgacacattacgggaggaaagaaacaattcacgaagcataacaatctcgtcccataagatgtctggaggtttgcggacgctggaagctgaatgggaccagaagcgaaatttaagtgcggaaagtttgccggggaaacaaatccacggtacgactttaacaacgatttaacaacagcatcccaccaaacatttgatgcgtgaggcaggcaaccctcgcaagggcagacaggttgaagaacaggagcctgaaactgactatcaactcccaaatttcgtggtctggaagttcatcaagcactgcatgcatggcaagaaggcccttgtgtggcactgtcattatccagcaggatgcacgttggacaagaa

SEQ ID NO: 616634 - DNA, 482 bp, Homo sapiens
ctagaggataacggagcgagatcactatcacggtcaccactagaacgtgggagacagagagtgggctggtgacataagcagatctcggtcaagggcagtaaccggaacaagtaggaaggtgcgtcttagggatgcagaaaacaaagtcgtggcgaaggggacggggagccagggccaacgtaaggtgccaggtgccagcctcggggggccgtacctaatgcacgaaggccctgcctatctgtattcatgggaggtagcagctgactgcgcatacgtcactggcggcctgtgtctgacttctacacacgtccctgtggggatctcggactgtggatgtcaccaagagccagttcctcatcaatgggaaacctttctatttccacggtgtcaacaagcatgaggatgcggacatccgagggaagggcttcgactggccgtcgttgaaaacaggagtacaagctgctacgggggctaggggtcaa

SEQ ID NO: 616635 - DNA, 106 bp, Homo sapiens
catagcttgacgaaggtgaaataatcattatgattgcactttaaagtatctgatagaacatggaagataaataagggagagtaatactgcagagaattagcaactg

SEQ ID NO: 616636 - DNA, 1150 bp, Homo sapiens
gcttgctgtgcccagttgggtgcttcatctggtatctatgaggccctatagctccgggtacaatgatgagactcgctatatggggaagggtgtctcactaggctgttgcagccaccatctaatcaatatactgattgcgcctgcccgtggttcagtgaagtaatactcgcgacgtctctagcatgccaccaggagaaggatcgcacgaaattggatggatcgaggatgggatggcataagagaagtaatgaatctcaagttccggttgcgaacgcctgttgctgcgagggtagtgcacctttgcgcggttgcatagctaacatgcctaggatggccagttaggacgcaaagggtggttcgccacgctggtatcgcagcctatcagtctggcattgtacctttgtgactagggtcgaaccctctaggaacgattctaataccttgggcggctagttacccagcgacgcttcgagagtgttccattcgaactgcgacgagattcatccatgggctcgagctagacgaaagtcgtcggaccagtggcgaagggatggttcgatggaactcacatcgcgcgaggtcgggtgggcatgcatataacttcgaggggcacagacgcaatgtcggcattgggtaggcacgagggttataccaacaacacctgaaaggcaattggtcagtccaaagggaaggacacaattatttggaggaaaaaagacgtggcccatcactacatgggtgggggggggggaatgaaaacgggcagagagtattaggccgtcagcagaagagaattcccactagggaagaacaataacatagggaaagagagacaattgtgaaaggcagttggcattgtaacagacactatggagataataggaggacaaaggcatatgggcttaaagaggggcatacaaggggagaaaacaagtacgaggaaattgcagacacgtgtcgcagagacgccaccacaaagatacaacatacaagggacccggcggaaaacagcaatatggaacccgaggaacacagcacaaaagaagatgaccggaaatgcaacccccaaggacgagtgaaaagatacgacacaaataacacacacagcgggaagacccgagaaaacagaaccagagaaaaaaagaaacac

SEQ ID NO: 616637 - DNA, 238 bp, Homo sapiens
tccttatgcttctgtaggcattgaagccttaggcgagggaccctcaacccctgggccacagactggtaccagtcaatggcctgttaggaatggggctacacagcaggaggtgagcagtgggtgagcaaatgaaccttcatctgtatttacagccgctccccatcactcacattactgcctaagctccgcctcccatcagatcagtggtggcattagatcctcataggagtgtgaaccc

SEQ ID NO: 616638 - DNA, 498 bp, Homo sapiens
  misc_feature (30)..(30): n is a, c, g, or t
  misc_feature (498)..(498): n is a, c, g, or t
gggggggggggggttacttttacccagcanctttttttttgaagaagccacaactgcattggatgaattggaaattctgcttgctagctttttaaaatcgatacgcttatacactcacactttatgcacaaaatgtagggtgataaaaatgtacacaccggcatgatcctctctataattctactttcagagctaactccaatctctgttatactcgatcccaacaatctactttaagctctaaaggacctgcaaccttaaagctaacaagcctacgaatctcttatccaacataaacttcgtggtcaaactttaactttccaaattggagaactcatatgcttgtttactagcttgtcgtcccttatgtaaacttccaatttaccatactctggcttaaaatttggggggaaaatattatcaaatatctatttgaccggaataattcggaaaatcttttttaaatgaaatgaaaacatctttggccacaaatggtcn

SEQ ID NO: 616639 - DNA, 94 bp, Homo sapiens
gggaatcaggagaccaaaaccacaacactgccccggaaccagggatggctacagtttgttcaaaggtatcgtttttagccctaaccctataagg

SEQ ID NO: 616640 - DNA, 516 bp, Homo sapiens
  misc_feature (500)..(500): n is a, c, g, or t
  misc_feature (504)..(504): n is a, c, g, or t
tagggccaggctgggtctcaaactcttgactcgaagtgatccgcccaccttggcctcccaaagcgtggggataataggcatgagccaggtgcctggtccacctgggcctgtttggtttttctttcctggggctcagcaattcaaattctagtggttattgggtggaagcagtagcccaaccccagtttaggggaaggtagcacagggcagagccacggggcacttggtttcctgggccctccgaagctcacggtggcaaatacccccaagccttggctctaggccagatctggtggggtgcaggtgatggagaacacagatgactcgggcatgggtctgggagatcttcggtccaaagtacagggctggcacgggggcacagagtgcccacgtaagcccggggctctgatagagaggtaggaggcccgttcttggtcacggttccattgcagaccagacttgctggcctgaccacaggggaggggctgggaactcacagncagnatagggacattc

SEQ ID NO: 616641 - DNA, 222 bp, Homo sapiens
ctgcagtggtgcagtcttggctcactgcaacctctgcttcccgagttcaagcgattcccctgcctcagcctcccgagtagccagtggcatgagccggggcgtgagccacagcacccaactcaaatttttttttttttttgaaatggagtctcactccacctaggcggcagaggaagactctgtctcaaaacaacaacaacaaaaacaaatttaaaacagctc

SEQ ID NO: 616642 - DNA, 376 bp, Homo sapiens
  misc_feature (15)..(15): n is a, c, g, or t
  misc_feature (46)..(46): n is a, c, g, or t
attatacccggtagntagctaagctacttttattaatattcttaangaaaaaatcaattccaacaacaaagtgaaagctaaaaaacaataaagtccatggcagtaaacaacgattaaaatgtatttcattccttacaataagtaaaataaaaacttttttttttttttgggacagagtctcactctgttgcccaggctggagtgcagtggcacgatctggctcactgcaacctccgcctcccgggtccaagcgattctcctgcctcagcctcccgagtagctgggaggctaagaaaatcacctgagcccaggaagtcgaggctgcagtgaaccatgaccatgccactgcctgagtgacaaagtgagaccctgtctc

SEQ ID NO: 616643 - DNA, 201 bp, Homo sapiens
ctgtctgtggaacttagcaaattaatcattttcttcagacttgaaggagagtgataaataaaatttggagtcatagtgatattgatgcgcacatttaaggagttaaacatttgttaatctaattgtgtgatgatggcgttattaaagtgttgacttcctagtataaaactgcaagaataaaagtaacttctccacctgtaa

SEQ ID NO: 616644 - DNA, 267 bp, Homo sapiens
cagagtgtatcttaagtacatctttgagtagaggggcacggactagagtgtgtatgtagagaatctggagacgtgtctgggttcagcaggaaatggttccatgattgatgggtgatgtatgtcctaagtgtggaagagggtgtggtcgctcgggcacacgccgaggaaccatacacacacacacacacacacacacgcggtcttaaaactgataaaaacagatactacactagatcttagccaaaaggctgagaagaaatatcagag

SEQ ID NO: 616645 - DNA, 645 bp, Homo sapiens
ggggcgcataagactccagagcaggaaagttgggacgaagttcgtcacctccaacacgcaggaactgggccaaggataacgtggctgtcgtcctctcagtggccaagaaatttaatgggtcctgagttcgccgccgcaaaccatatcttcacaccaagcactgccagagaaaattgcaggaattgaaaaacggaacgtcgcgtctttttaacaacttcctcactgatgctaagcgcccagctctgcctgagatcaagccagcccagccacctggccccgcccagatactcccacccaggtttgaccccaggactcccctacccacaaccagactccaccagggcctgatgccctatggtcagccccggcccccgatcttagggctatggagctggtactgtccgccctgcagtccccacaggaggccctccatacccccatgccccagtatggtagctggttcgagggaactatgatgccttcgcgaggccagggaggttatcctgggaatcctcgcaacaggatggttcgtggagacccaagggccagttgtggaatatcgggacctgggatgccccagatcgatgttgatttctctttgagccgtcccccgctcctcagtcctgatcatccatactggactaa

SEQ ID NO: 616646 - DNA, 340 bp, Homo sapiens
ccttcgggcacctcaggaaggcaccttcctctgtcagacatggccaccaatggtaccaatccgtcgtttgtggccccagggcctctcctcggacttctgctaggtctacctggtactggcttgacccccgagcgtgtccaagggcacgagggagtttcctttgcacggggctgagacccccaagaaccccttcgtcactctcttgctgagaggggccccttactttgtagcaacttgacagtcacttgattagtcccccagcctcctgaagaaaaatgcggccttccggaggacgtccccttaatcaagaggcagcatcggttggccaagtaggcatagg

SEQ ID NO: 616647 - DNA, 412 bp, Homo sapiens
ctcggtaccgaagcaggtatcgtccctttcatggcattttctctctcagacaaggcgacagacggctcctgttggagacagattgggagtccattttgcagatctgcgacctgatccgccaaggggacacacaatgagttagcggggcctgtgccctgatgcggaggagcagccgtgcactaagctgggctcgcttggtgcccgttgggtctccacgacgtagctgaccgtgttaggctcttatgtggaggactgcatgggctacatgctaggattttttgacatcttggaggattaaggggttttctctgtacagcttgcagatacctggttatgtttgtatttgcttcggggttctcaaagactaagatggcagacagacttttttttttaagacgagacctggctgccg

SEQ ID NO: 616648 - DNA, 145 bp, Homo sapiens
tcaagagttgcgaaactcaagctcgaaggttacgccgcaatcacgccggaggaaaattcatcctcgaggtggcttcaacaaggacagccgggggagaccaggcttgctggaatcgggatcagaaccaagcacgtgaagacccagg

SEQ ID NO: 616649 - DNA, 276 bp, Homo sapiens
aattgcctcacctgcctgggttaaaaaaccttggtattcaggcaacacccctggaactcaaggccattgaggtgctgcggggtcatcgcacttaccgctggctgtttgctgaaattgaggatgtaaagccggcaaaacccgtcaacatttagtgcctcctgagcagcttttggttttggggttttttgggtcggcccatgtggtttgagcacccagccaggcggtttttttaaaggatcctgtacccagttcccctattaaaacatttcaggttga

SEQ ID NO: 616650 - DNA, 257 bp, Homo sapiens
cctattccttactttgagtaaatagcttaaagtagatacaaaggaatgtagagtagttatctgaatagctgttactcatgtggtcttaagaccaatctttgatcaaccgggtgcacaaccgcagggggtgggggcggggttgttggcaaccaggtcaattaccctctagcagtgtttactcaaaacctttgtcatttaatctatactgaataaatgcaagcttcgctgtctgatggggccggctgccactccctacg

SEQ ID NO: 616651 - DNA, 1002 bp, Homo sapiens
tggcagaggggaggaggggggggggggagtgggggaagtgggggggggggggggggaggaggggggggagaggggggggggggaaggggggggggagggagggggcggggtggggtgggggggggggggggggggcgcgcgcggcggggggggcggggggagagggggcggggggaggcggcggggagagggagggggggggagggggggaggggggggggggggggggggggggggggggggggggggagggggggggggggggggggggggggggcgggggggggggggggaggggggggggggagggcgcggggggggggagggggggggggggggggggggggggggggggtttggggggatgtgggggagagagtggggcgccggagggggggtggttcccgcggggggggagggaccggggcgcccggcggggggagaaaaggaaagagggggggggccggggaaaaggaaggggggccgcccgggaggggggggcccccgccgggggcccccccccaagaaagggggcccgaaaaaagaaggggggtgaaaaacacagatgtgggaattgttcggcgggttgtttgtggggtggtgagaggggggagagggagtacggcggggggggggggggagtgcctctctctttataaaataaaagagggtgtgattttgtagaaaagaggggtgttagcccccccgctctctgttgtggcgccgcgccggaataccccgcgtgcggcctctttgttcccctccgcgcccctctctcgtgtgtgtgatatttttttttgtgtgttgtgtgtgggagagagagaatgtgcgccccccctctcccgcgtcggggtgggtggagaacccccccccgcgcgcgcgagagagagtagggggtagagagagagagagagagagagagagagagaggtgtccccccccgcttttttccacaggttattttttttcttcctttatggtttgtttgtttttgttttttta

SEQ ID NO: 616652 - DNA, 188 bp, Homo sapiens
  misc_feature (15)..(15): n is a, c, g, or t
  misc_feature (21)..(21): n is a, c, g, or t
  misc_feature (50)..(50): n is a, c, g, or t
  misc_feature (134)..(134): n is a, c, g, or t
ggctggctatttacnagatanacaaggagttacggtgcacctagcccagnaatggcccttagaagccaaaagtgttctctccgctgtaggccacatattagaatccatcttcatctttttccttctcgtaaagntgtcccatagttaggctggactgtgggactgtcttatccacaaacaggaagatc

SEQ ID NO: 616653 - DNA, 1562 bp, Homo sapiens
ttgctgggaagcaggagctgcgccgagtattgctcaaggttgagaacaaagaacgtgaacctggagattgtccccgggaagcctctcctgcggtggctctgacgcgttacgtggtgggaagtcttctgggggcgtacattgtgcgtgggcagttccggcgcatgtgcacgtgggtagacaagcagagagatcagattaccatgaatcgccgtccgttggacgatttccagttgagcacatctcagaatatgtgctcatcccagacatggagaggtcatccagtgggatggtattctgaaggcctagaataaaaggcccacagcacacacaaagaatcaccactgcacaagcactcacacctagacacagctgatctcatgtgaactggctggtgccacctgtgaagcgggaggctgcaaggggcgtgtaggtgtgatcgagagcttcgggtgtggtcccatgcgctcctggtgtccctggctcctgggtgtgcagggacgtctgggcatggaagcgtatcgctcctcgtgaactgccatcgatcttgcatgtagtggggagcctgaaagagttggtgcgactgttaagtctgtatcaacaatagaagacggagcagagtaagaaggggggtgagggcgtatgtgggttgaaagggttgtgagtccagaaaggatggaatgtctaaacaagcatgtgacctcgttgacaaaacaatgagaaccaggggcaaacaccgccagcatggaggacgacaacagggatatgaggttatgaccggggtgattacaaatgtgtaacgcgagatggcgaaccgggaccgcaattgggacattcgcgggaatggattggcgaagtccagcgcaagtttgtgtgggccccgacaaccaagttgggcctcgaaacgaaggtcggagcacgtgaacacggaaattaggggcgtacctggatgggcaggggggagtacatgcacagggtgaccggtgccgccaactacatgggggaactgtcgcaccaaaatatgtgggacagtaaaccaccacaggatggcaaaggcacccattcacggccagcgggggttggcggcaacaacacctgggtggtgacccgaagacacgggcgtggagttcgaccaaatatgggggcggtgatttggaacactccgggacatggggtgcgacgcaccttcgacaggcggggaaagaagaggttaacgggtgggacaaagaaaggaacctgtcggaaaagggacagtgtcaagcccgtgaaagaacagcgggtaccgacagggggaaaaggcaccgctgggggaacagacaaacgggggcccacgggatcaccagtggcagcgagtgtaaacaacagagggccacgaacgaacacaatataggggcacagaaagcagagctgccacacaccgaaggaagacgatgtcccgcagaacagggcccaggcgacccacattaaacagcgggccaggatagctggctacaggagaacacactgacggagacaacgagaccgcacccgaagaagggcaacgacaaggaaaatcaaacagagac

SEQ ID NO: 616654 - DNA, 505 bp, Homo sapiens
gtatagaactaatatatgagattagttgaaaaatatctgttcgttagaaaaatattgtggaatatagtaacagtaaagcacagaaacaccacattctattctcaaattggaagggcgaatgtagagatactaaattctggctgctggagttgggtctctcctcatgttttgggcgactgaaggctcaactactactaggcagagatcgatgacatcgtttagatggacgtgcaggaatgatagtcacacattttcactcgtgtatagtggaagaatttctcacttcacctgaatgatttactttcattcctatggccttctatcgtgccccttctggttcagaggagcagtcacataaaagtgacaagatggacaagactggtttggaacacatttgtgttcaatgtttgattcctttttccttgtgataaagccagaggcaaatgtacttcattgataaatctgtgtgcgcagaaccaaaaatacataaaattgggaaagaggc

SEQ ID NO: 616655 - DNA, 311 bp, Homo sapiens
tctaaacccacctggagaattggggaggtcagttgattatattctatgaaagataaacttcccacatcttcatgacaggaggtagttgtgcaacttggagccaaattcaggtacctgctgaacgtagggttttacttctctgtagaaactgtggtgccaggtgcggtggctcactactgtaatcccagcactttgggagaccgaggtgggtggatcacctaaggtcaggagttcgagaccagcctggccaatatggtgaaatcccatatctactaaaaacacagaaattagccgggcgtggtggtgcacgc

SEQ ID NO: 616656 - DNA, 155 bp, Homo sapiens
agtcccttactagtgctgacctctttcaggccgcatcttcgatcggtctggcttatcatcagcagggtaaatgcatcgtgcaacaggtacgtaaagtacgcagcccggtgtagcatgttgcggctgtcaggtgggtgtggcattggccgtcgctg

SEQ ID NO: 616657 - DNA, 456 bp, Homo sapiens
tcaagctcggacatctatagaaatccccgctatcgacgtcctgctgtgtttgctttcagtcacgtgaggaacagcctcccggatagaagcgtggtgctgtctgtacatttccataattgatacagaccccggcgggtctcggacctcatacactctatgctccagggcactcactgaaaacttcatcacgttgtcaatggtgaagcccgagctgccagtgcccaggtctttcagcagccgggccaggaggcccagctgactcattgccaggtgaactgaaaagtttgctttcaatggatgcaccaagtaagaatggcataatttgaagagacttaaatacttcaaacaaagcggcaataccgaaaataaaatttgcagttttgacgcagaggcgggcagaaaaatctccagttctggtgaaccaaaacgggactggtcctctccacacagtaacga

SEQ ID NO: 616658 - DNA, 198 bp, Homo sapiens
tttgaagtaggaaaggtttgaaaaaaaaagatgccgtggttcttgcaagttctgccttgtttggtaccagcacagagcatcactgtacactaagtgtgcccgggggagaatgctgagctgattggcgagtgtgtgtgtcgcctgtgcgaggccaggtctcacagtcccagaagaacttctggacggatctgtcttggg

SEQ ID NO: 616659 - DNA, 403 bp, Homo sapiens
attgctatttgatttagtattttcattattgaaactatatatcctgccgtgcttctaagtgtcagacttaccttaggactcatgctgaccgccgggcaccccggctcccaggtttaatcctatcactttgctaggccgacgcgggcagatcaactgaggtcaggagttcgagaccaggcgagacaacattgtgaaaccccgtactcgtggttataaatacatattgcccaggggggcgcggaatatgcgcgcctgtagttactgctgcccccggaggcttaccaaggatcgtgcgcttgagggctgaagccatagcttgcggcccgctgagatcgttccactgcactccagcctaatgtcacagagcatgactccgtctcaaaagccccggtttttgctttcc

SEQ ID NO: 616660 - DNA, 193 bp, Homo sapiens
tgtaataacagccagataaaaaaacaacagtgtatatagagcgttagtcactgctcatttccaggaagatcaaacaaaataccagcccagcgagactcacatgtgttatatatatataaagcaaagagccacacccacaagctagcagctgggtgaaatatcagctgtccacgcggggaaatggcgctcgata

SEQ ID NO: 616661 - DNA, 347 bp, Homo sapiens
aggcggggggtgttcaaacccccgggcgttaggcctttcaggggggggggggggcctttttccccggccaagaaatttttttaaggggggggggcccccctttcccccgggggggacccggacccttttttttggggtgggggccaggccccggaaaaaaacccccttaaaaaaaacccccttaaggggggggaaaccccggggtttttttttttcctttttccaaaaccccaagggatgggtttccaaaagggaatttttttgggggcccccgcttccccccccaaagggttggttttttgggaacccaaaaccctttcccccccattaaagggggtttatttgga

SEQ ID NO: 616662 - DNA, 717 bp, Homo sapiens
ggaggtttttttaatttacagatcatatttatttactattttgtagaaaattattaattttgatgtattttgtattttaaaagcttcttcacttgtgttccctaaatattcatatgctgcccaaaagtatgactgtggaggaaaaaaaaaatactttaaaaatccacacttttggttaagaaggaaacatttagcatttatatattggtgtatggaaaacacttgatattttatccctgtggcatctggtgcacagagcctctcctcaaagatgctacaaaacttgattataacacatttcgggaaggctggattaacctcgattctgtgtggtgatgtgcaatactggtttctaatggttggtataacacacaaaccagtgtaaaccctttttaatggcaactttatttttttccattgcatattttgcagatttttatccacagttgtcattttttacgtggtcagaaaaatgataccccctttttggtcaattggcacatcaattttttaaatttccagaaaactcttggtacctgactgttaccatgcatcggttacgctcattcgcgcactacgtgtttgtgcctaccccaaacggacgagacttttttccatgcattatttctaataggtcaaaaggcggttacattatatattcaataagtagttaacatcctgggcactcattttcacattctctgccttacttctttg

SEQ ID NO: 616663 - DNA, 324 bp, Homo sapiens
  misc_feature (36)..(36): n is a, c, g, or t
  misc_feature (57)..(57): n is a, c, g, or t
  misc_feature (93)..(93): n is a, c, g, or t
  misc_feature (127)..(127): n is a, c, g, or t
  misc_feature (180)..(180): n is a, c, g, or t
  misc_feature (243)..(243): n is a, c, g, or t
  misc_feature (310)..(310): n is a, c, g, or t
  misc_feature (312)..(312): n is a, c, g, or t
tattgtataggggcaactgtatgaaaaattgggganaagggggccgggcgcgggtgntcacgcctgtaatcccagcactttgggaggccgagncgggtggatcacgaggtcaggagatcgagaccancctggctaacatggtgaaaccccgtctctactaaaaatacaaaaaaaatttanccgggcgcggtggcgggcacctgtagtcccagctacttgggaggctgaggcaggagaatggtntgaacccgggagcggaggttgcagtgagctgagaacgtgctactgcactccagcctgggggacagananaggctccgtctc

SEQ ID NO: 616664 - DNA, 492 bp, Homo sapiens
gcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctgaagctgtagtgttgaacttggctctgcatgcccagcgatgcgcctccctgcgggatggcatcaccctgagaaccgtgagtggcccttggctcactgagttctgcatggtttggattggacaaaattgtccgtgacagtgaatcgcaaccgaacttttttcatcactgcaaacttgctgtttctcggagattcatacctttaactaagccttgctgtaacaattgtccggaatgataactgggcc

SEQ ID NO: 616665 - DNA, 723 bp, Homo sapiens
ggaccagaaagagaggaaggaagagccgggaaggaacggaagggaactcagagccgagggtggtggggttggggctagggatgcgcactgggcccggggccgcgcggcccaggcgggcactggccagtggatggcagggctgggcgagttagaactgagagcccggcttcacagcgcagcgcgctccgaggccctctgtcgttacctgaatattcattagactgaccgctctttatccttatctaacgtttatcttatcggcgagtttcgtttctcagtgtagttttaatcccgggctcccattcccccgtccacctggtcctgctccccgcgtccgtgccgcggcgctctgtgggccatggtcgccctgcccctgtacgcgcacggtcttgcagctgtctcgaggtgagggctcatctcgcgtcagctgcccctgtgtcccgtgttcgatccggaatccgccggctcgtcccggtgccagcgctgccgttcgcgcgccggtcgtgctccccacgcggcttctcccgtccttactatcacaaacacccgagtcatcattctatcactatctccatgctcttatactcataactatcagccaaaaaccctctgaccaacatgataacgcaataaccaatctacccatgtgccaatttcttcccaaacagatgtccccccatctcgtactcactcgtatagctcccaccacagattacccaaaga

SEQ ID NO: 616666 - DNA, 168 bp, Homo sapiens
tcggtatggggcttggctgatggagtgagcacttagagaaagcatgtgtcacgtggctcaggctccaagcaggttccttatatctcaggtgggactctaggaatagactccgtgattggatgcctgaggcaccccactgtaggtcaatgaaccacctatgttcctacc

SEQ ID NO: 616667 - DNA, 649 bp, Homo sapiens
ttatgcatgttaaataggataagagaataaaatgtaaagacaaacacgaaatatttcaaggattattttaaaaaaagattgactttgggcagtttttttcccccgcccggtctttcaaatgtcctaagggctaggtgccttattttggcttctgctcttggagagtaataaccaactgacttagagcttttactgaatttccagaatccaaaatagaaaatattaaacttaaagaaaaaaagttatgaccccttttggttagaaaaccaaaagtcttgtcatatgacatcatttttataatttccctctcatttcattttactgctttataatagtttaacctcattgaacatttttcttatggaattttgaatattattatttttaaacattttactgcgatgagaccatagtaataatcttgcatggaatctttaaatattttaaaggtgtttttgaagaatacctttaaaaattatccttagtagcaaaaaatgacattagcaatatgaattaattcactgctgatttattgagctagcagacagactgaaacactagcattaataaatacatgtgaccttcatgtatatattttactagtttgttaaaacctactaacaagtatccaaatgcaaccgaaatcagt

SEQ ID NO: 616668 - DNA, 314 bp, Homo sapiens
cccccccccggggttggtttttaaagggggggggggttttttggggggggggcccccccctttttccttttttccccgggggggaaaaggggggggtatttttcttttccctttttggggcccccaaccccccccccccccccccgggggccccgggtttttttttttttggggggggggggggggggccccccggttttttttttttggcccccggggccccccttgggtatggggggggtgtttccaccccccgggggttcccccctttttttggggggggccgggggggttttataattttttttggggca

SEQ ID NO: 616669 - DNA, 148 bp, Homo sapiens
attctatcagaccaggtcgggcaggtgctgacctgcagcctgaagacggggctgacctgcaagaacgacgaccagacaggcaggtgcaacactgtgcttcaacgtacaatcgtgcgatgtgcatttgctagtgaacgaactacatgcc

SEQ ID NO: 616670 - DNA, 1037 bp, Homo sapiens
gctcgactcttagcttgtcgcgggacgtgtaaccgggacccggtggttctgctcctgtcgccttcgactcctaatcccctagcccactatgccgtgatgtgcatctcacatcgcacgtgggccagagctggtgtccagcattggcaatgcctgcggggagctcaagtggctggtaacacggcatccagcccgatggtcagatgccaaggtgagaaagactcattgggggaggagatgcatgcccttcaacaaaccttcttcgagcgagactgggccgcgtggcaatgcaactgtgtgcccgtgggcgtgtgtatggtaacgacatctggaacctcgacaaggtccatttgatgaaggttcggcgactggcccctacccgccagctgcttccatccccctggagacaggcgtcatcactcggcaacggacagatgcatgccgagtacatcgtatgcccgatgggcgactagctgccatgggtccaggagcatcagttgcccttgtgtcggcgccgcaggtgctgccgctgtctgggccagtgccccggtctccacgggcttctcggtttaccaccaggcttcggtggcgggagccggtactgggcttcagctccctgccgcctgccggccgtctctcaggttggacttatggctacgccgtcccacgcttggagcttctccactacccatgccgcccaggctttcacagctgtacttgcgcctacaactccatgcggaacacccacgcaagccatggagcactctgcttgcgcctccggcagacaacggagccactatgagatcggcgcagaacccgaaatgagcgccaacctaacgtaacctaacgcctagtagccagacgggcccccaccggctccgcattgagacctcatgtgaccgacgatcaaccacggccccccccgcacacccggacaatgccctcctgtgcaccccacaccctccgacccgcctgtcccccggagccccgaccgtggcggcgggcccccgcccaactcgtgcgtgcacccggggcgcacc

SEQ ID NO: 616671 - DNA, 915 bp, Homo sapiens
  misc_feature (338)..(338): n is a, c, g, or t
  misc_feature (477)..(477): n is a, c, g, or t
  misc_feature (744)..(744): n is a, c, g, or t
ccgggtgaactacgacgaagagaactggaggaagattcagactcatctgtcagagcagaccacatcggccgatcccgtgttcagtcaaatcgggcacaggatctttaatgacgccttcaacctggtcctgtgcccataaggttccctgtcacttctggcgctgaacagacacccgtcttcctgcattgaagagatgacagatacatgacccgtgggaggtccgccctgatgcagccatgagcatacttcatagctgtcattgtttgacctgctccgagcgtctcatggccccactgaagaacctacctgtaagaacgcaggtcactaccccgtcttcnattcatgcttcagcaatataagtagccaatgcaatgctgggagcgcagcattcccagtgagaagacctgagttggcaccagtacacgccgacgcgttaagtgccaatcatgctaccagccttgctctcaatcgtgcatngttccgagaagtgctagagcgaagatgcgtcgtcttggccctttgtcaaggctagatggactgtgacgaagcccccatagtacatatacctcgatcacagcccagaccttggcggttccaactcgtcttacttgcagacgcatattcgcctcagggcctggggcagcgagcgcagtggcgactttctgccttgggcagccagttccccgaaattgcctacacgtggtcacatgaaggcttgactaaagcttccgggcagccccttgnccttgcagtcaaacgagttcgctggattccttgcaacaggtgtacccttgaaggcttacacccctgtggaaccccgggaactttaaattcccggggaaaggccaggggaacggcgcaaacctttctttaacccaatttcaataccagggcttttacccaaaaacaaacaag

SEQ ID NO: 616672 - DNA, 315 bp, Homo sapiens
agggaggcccctaaagcagacatggcttagatcacaacatcaaagtccttttgaatatctggaaggccttcccaagtagaatgggtacaaacgagcccagattgagaagactacaataaatgcctaactcttcaatgccccagcacccaaacatctacaggcatcaaaaacaatccaggaaaacatgacctcaccaaactaaagtaaggcaccagggaccatcctggagaaacagagatatgtgtaccttcagaagaattaatacctgttgagaacctaagtcagataccgagagaagacctaggtcgctgcact

SEQ ID NO: 616673 - DNA, 673 bp, Homo sapiens
  misc_feature (32)..(32): n is a, c, g, or t
  misc_feature (168)..(168): n is a, c, g, or t
  misc_feature (197)..(197): n is a, c, g, or t
gctaagattccatttatttaaaagttagatancatgtttccatccagcccactccaaattctcatgtcctcacatttcaaaccacagttatgccttttatacagtctcccaaagccttatctcagggttaactcaagagtccacagtccaaagtctcatctgagacanagcagtctcttctacctacgagactgtanaatcaaaagcaagttagttacttcctagatacaatgggggtacaggcaatagaaaaatatacccattccaattgggagaaattggccaaaacaacagggctacaggcctcatgcaagtccaaaattcagcagggcagccagatcttaaagctccaaaatgatctcccttgacttcatgtcacacatccaggtcatgctgatgcaagagatgggcacccatggccttgggcagccccgcctctgtggctttgcaagatatagccccactttccactgctttcataggatggtgttgactgtctgcagcttttccagatgcatagtgcaagctgttggtggatctaccattctggggtctggaggatggtggccctcttctcactgctccactaggcagtgccccagtggggactctgtgtgggagttctgacccaacatttcccttgtgcactgccttagcagaggttctctgttag

SEQ ID NO: 616674 - DNA, 857 bp, Homo sapiens
tttggccccctccccaaggccaacttcccacggaacacttccggataattttcacccctatgtataagccccaatctcccaaaagcttttgtttccgccacagcaaaacgcgtgtgagatctaaaagaagttcacacccctgtgaccccgagacccacaatttccgagcataaaccaactgtgttgccacccgacagaagtcttgtaccagtgttttgccggcggcatcctacaagtttaacttcgccggaacccccggcttctcaatattatttggcaacctcctgaatctacctacatctttgacgaccggccctttaccccaaaaaggagttcggcaaactcgtatgaaccacggccacagacgggggtgaaaagacacccgagttattaattttctgacaattcttctccggcccaaattttctcattcgccgccttatatgttagatacccaaggcgctccagtcaaaaccatttatgaatgccacgcaaatctcgcaccctcgggtaatacaaatagattcaccccctctttgggaataaatatttaacagcccctgcaacacggcttatgtcaatactgtggccccaccaaccgcatcagctgtacactctcctgacagccccccacaagagctcattctgtaaggtgcgtgacacatctccgccttacttttaagggtctcccaatagcatcatctttcaaagacgactccgttcaatacagaaccccggcgaacaacacctttgtaatcaacccccatcaagcaggcttccccacttccgcctctccaattaaaaaccccgtacctggagtttatcgggattctcccaaaaacaaacccccccacaac

SEQ ID NO: 616675 - DNA, 516 bp, Homo sapiens
gaatccagcctgggtgctgtgtgtgtggacctctgactggttggcttcagatgacctggctggcgggggctgtcatcacagccagagctatccagctcggtgcgctactccaaccttccagctggtggcacttgtccatgttgctgttggctgccagccaaacacgctaggatcagcttccccagcggccgagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggactctgccgctccctgagctgctgc

SEQ ID NO: 616676 - DNA, 833 bp, Homo sapiens
gcgccctgcgcgggtggcgattagacctggtctcgaggtggtccgtggctccccccagaggttgctgtcgcgggcgcggtatcccccggacgcgtgtgccggttctcgaggcgttaacgtcgacaggtgaggcttttgttaggcgcctttctaatgaagtaagctcaaaggctcggggaccgccggggagaggaggaccttgccccggtagcgggtgcggtgagtgttcacccgaccagcgatgttagttggacaggaagcgccaagaggttataaaaagaggggcgaaccatagaaataggtcctcccaaatcagaagttgtgttgggattttaagtgatggagccctctccctgcgtattgctcaggtgtgtggaagatactcggactggggagagccagatgctcagatgagaagggtagaagagttgctccagagacaaagtgacccacgatgtgggtagatagaaccccccgagctccgtgatagtcgtctgtaggagcaccccaatatgcgggggggaacagttgttgtaatagtgctccgaacgcgaagtttgatggtatgccgaggaaacagtataatgattcgcgcattaagtgttgaccgacccacaggatgtcgcaggagatatgaaaagaggctatcagctcttggggaccgacaagtgaagaagtgaagatgctgcaaatagattctcccccaccagtcccaggggtcgcggggcccaataggggaaggtttttttcccacagggccgatttttaaggggccaattttaaaaaaaaaaaagggggttttttaaaaaaaaatgaagccggggcccaaaaaa

SEQ ID NO: 616677 - DNA, 586 bp, Homo sapiens
gatataacagaaaagactctgaccagagatcgagacatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactctatctcaaaaagaaaagaaaagaagactctgacctgtactcttgaatacaagtttctgataccacggcactgtctgagaatttccaaaactttaatgaactaactgacagcttcatgaaactgtccaccaagatcaagcagagaaaataattaatttcatgggactaaatgaactaatgaggataatattttcataattgtttatttgaaatttggctgattctttaaatgtctggtttcccagatttcaggaaactttttttcttttaagctatccacagcttacagcaatttgataaaatatactttggtgaacaaaaatggagacatttacattttctccctatgtggtcgctccaga

SEQ ID NO: 616678 - DNA, 322 bp, Homo sapiens
ccatttatggagaaggcaactaaagttcaaaatgggtaaagggggtcccgggcatggtggttcatgcctgtaatcccagcactttgggaggccaaggggaaaggtttcccttgagcccaagagtttgagcccagcctggacaacagcccccgctttttacaaaaaataaaacaattagctgggggggggggggtccctgtaatcccagctacttgggaggttgaggcaggagaatcccttgagcccaggagtttgaggctccagtgagctgtgatcatgtccctgtactccagcctgggcaacagagtgagcccccttttca

SEQ ID NO: 616679 - DNA, 417 bp, Homo sapiens
tcgactctgaggatccccctcccttccacagcaggcaagccaagagccaaattataatgaactcctgttcacaactgccacaaaaagaataaaatacctagaactacagctaacaagagaagtgaaggacctcttcaaggtgaactacaagccactgctcaaagaaatcagagatgatacaaacaaatggaaaaacattccatgctcatgaataggaagaatcagtattgagaaaatgaccatgctgcccaaagcaatttatagattcaatgctattcgtattaaactatattgacattctttacagaatcagaaaaaaaaaaatttaaaattcacgtggaaccaaaaaagacctcgaatagccaacacaatcttaagcaaaaagaacaaagctggaagggagctgtggaagggaga

SEQ ID NO: 616680 - DNA, 1210 bp, Homo sapiens
aaaagtgcccaggggggcttaaggctgccagactgcacgcacatctacagcaacaagggcttctattccatctacaactgggatcgggggaaaagggagatgtaggagaggaaggaaaaaagaggggaaaaatataccaccaacccctcccccacaaaaaagagggaaaaaaaaaaatcccaccacggggagactctatgtggccaaggcataatgggaaagatgtggtggctcccccaaacagatgggttttggcacagggctaatggtcctggctgggtttcccttagagacctattttggaaaaatgtttaaaaaagacagggagaatttcaaaataatttcaactccgtggcagaaaatttcaaagcctccaaacattagggagcaaaattcactcctttcacgtgaatttaatctccttttctcctctttctcctcatttctcttataacacattttttactccattgttatatataagagaagaattctcgtataagagggtgtggcgtatgtgggtccccaactctcattatagggagaaggtggtagagaggagatcacgtgaactccattcagctactttggattgacccagggtaatattcccaagattcaccattttccagggtccccaagagttccctctaaatgtggcacaatcaagtcagcctatcgtttacattctccttctatggaacacagcaattgcccatggggtatcctcgtgaagcgtaacagatcttaggcggaattttcccaaaataaaggcacctggtggggcaatagaagacacaccctaacatgggagcaataaacggagacggcatcacagacatcaatccacattcaaaacaaagacaggggaacccacacaggggcccttccaaatcgtggaaacaaaggctgcgagcaggacacgggcctacaaaaagtggggcttacaggcggttcacgccacacacacacaagaaatgacggggggagagcccaccataaaagggcgccaaaaacgagcagccgacagcaaaaagagaaactaccacccacaaaaggatagtggtgcacacacagcataatgagacaaccaacataaaagtagaaggagccaccgagaaaaagaaatcacaacacaaagcaaaacatcacgcaaaatacacagaacaaagaggccgcagtgaggtgacctgcctggacgcgcagcaga

SEQ ID NO: 616681 - DNA, 122 bp, Homo sapiens
  misc_feature (10)..(10): n is a, c, g, or t
agcatgctgnaataaaaagctacttcttctataattgtcaggttctctccaatttctcagctggggcaaagcacatggggtgcagttgggtgtgccatcactgcacagcagctctggcaact

SEQ ID NO: 616682 - DNA, 432 bp, Homo sapiens
ttgtaaaacggaaagcgcctaagaatatgctgagaggggaacatagttttatggtagccacagtaccttccagtgacgggcaaatttcttggcatcagcgggcaggtgtggtgaatggaattcccatgaacagctcttacatccttcggctttcctcctacaggcctcggtctggtaaccaagggtgacctgctgtgaggatgtaaggtccatgaccctctagggataatgccttccactcaggacagaaagactgctgagaacctctagggatatctacagttaccttcacagggggagaatcaatggtggaggttaaccgacgaccatggaattttggcccctaatcaagaagggtatggccatcgtggttacattcaataactagtgggctcctctttggcagaaataacctttcctctagatacggaa

SEQ ID NO: 616683 - DNA, 380 bp, Homo sapiens
gcaggaggggagagaaggtgatatggacactgtgggctggctgcggttgtgggcatgagcacgcctggagaggcatggggtggtgacaagctctggcagaagacccaagaaggtctgatcctggggtctgatcagtgctgcggcactgggtcctaggcagaatgtctgcctggtgagacgtggcaggagccagtgtccgaagctgtctcaggacgtcagagagctcggtggccttgtctccaagcaagcatgatctatcagatgcagcctgttgtcggtctccacatagggctggtgcatgcacatggacaggtagctacaagggtagaggacgggatccccggtgtgggcaagctcctaggacaaccgtgtgcttcagg

SEQ ID NO: 616684 - DNA, 491 bp, Homo sapiens
gtagtatacataccatgagcataaaaatgggtgggaagatagagctatcacatggggctactacgactttattttttctggaaattaaggcctggaggatgtgaacataaatgtgggtatcataaaacaggtagtaataaaagcataaataatcaaatatcaggtgatcttactagggagaagaaaaaccaatatctagttacagatgaaaaaatgtttaatacaaagagctgaaaatgtagaaatggagtaatctccccttggcaaaatttttacactttaaattagtaatccttggttggcaaggttttcatccctatgcggtggttttctactaccggtataactctggtacatacggctactttcccaggtttcctatatgcctcccctatatgggagaggataactcgcgtttacatatgtgatagtaatgcttaatactaatccacagagtgggctcgatcatttggagatcctagtggcttaat

SEQ ID NO: 616685 - DNA, 237 bp, Homo sapiens
ccacggtagaattatctgttgtgtttaagtcaccagatatttgttccatcagtttagcccagagatagacagtagaatgcaataccttcctccctaaactgactggacggctggcagtgagtgcccaaaccagtgcccatgcaaagggacgtggtttcctttttctcctctctctgcatctgcgctttccagataagcccgaagacagcaacttctccactcatgacaaatctaccg

SEQ ID NO: 616686 - DNA, 234 bp, Homo sapiens
aggaagcaggtagtaatttcatcatctattgtttcctgcagttgattgtaacagaacagttgttcaggtataaaactctgtcatgtaaatgaaatcttttgatatttcatgcacgccttgtattcacactagtgtcagtatcgtatgataaagaaccttgaaatctataaataattggcttatcatccttaaggacatttcagcctatatccacaatacttgatttcaactgcg

SEQ ID NO: 616687 - DNA, 208 bp, Homo sapiens
gcagaaagacttcatcttagttcagaaccttgttgacctctggcatcacattcttgccgtctaccaggatggacgtgtttgaccggatccgcaaagccacgtgcagcacggctcgaccctcggtgtatttgatcttctcaccattgaacatccgctctcgggcggcctccacgcccctggactcggccaagtccaccagcattcgcat

SEQ ID NO: 616688 - DNA, 401 bp, Homo sapiens
aatgggaccagctcctacacagtcccttctcccatccagcacaggatcagccgaggtctcctgtgccttctgctattttcagaccaatcccgtatgtattgattgcccagaccaaccctgtagcagggtctcagtccctttcctctggggcagtggcaacgaccacgtcctctgctggtgatcacaatggcatgctctctgtccctgccccgggggtgccccactctgatgtgggggagccacctgcctctactggggcccagcagccttctgcattagccgccctgcagccagcaaaggagcggcggagttcctcctcgtcgtcgtcgtcctctagctcgcagctctggaagggggagctctgcaaggggagctctgccaaggggagctctgccaagggg

SEQ ID NO: 616689 - DNA, 655 bp, Homo sapiens
  misc_feature (1)..(1): n is a, c, g, or t
  misc_feature (81)..(82): n is a, c, g, or t
  misc_feature (357)..(357): n is a, c, g, or t
  misc_feature (384)..(384): n is a, c, g, or t
  misc_feature (390)..(390): n is a, c, g, or t
  misc_feature (431)..(431): n is a, c, g, or t
  misc_feature (434)..(435): n is a, c, g, or t
  misc_feature (447)..(447): n is a, c, g, or t
  misc_feature (490)..(490): n is a, c, g, or t
  misc_feature (521)..(521): n is a, c, g, or t
  misc_feature (542)..(542): n is a, c, g, or t
  misc_feature (641)..(641): n is a, c, g, or t
nggagtaagtccccaggctcctgccccaaaccccttgaggaaaagagaaacaggtgttgggcaggaagaacagcaccaacnnggaggagagagaggggattgggtcccggctctaccacggaccagtcactttccccaggactcagttttgtcacctgtataatgggggaagcacaatccttgccttgacttcctttccaagagccttcaattttaggctttcggtgagagagttgggttattggaagagcttttgcaaacttgttaaagttgcagttacacacatgcaggctagcggttggccctggggcccaggcccagcggggcttcttgcggagttgggttacagttaagttntttggcaattgaaaacacttgcttgangctgantctcttggccctttgagcaccctcaggtcctccacatcttnttnnctcctctcaggntgcccacaacttccctggcaccttttaccctgggtggcttgangcctgggaagatgaggcgctcccggcctggnctggccctgcctcccactctnaaccctcttgtcacctctttcacctgatgatgtatgaacaaattgcagacctggtgtgtaggggagcagccgttccctgcaccctctttttccctagtnatcaccctttccat

SEQ ID NO: 616690 - DNA, 110 bp, Homo sapiens
gtcatggtcactctccccaaatattatattttttctataaaaggaaaaaattggaaaaaatttccaggcgcattggagcctataatagggccatttccctctcacacata

SEQ ID NO: 616691 - DNA, 600 bp, Homo sapiens
ggattgtatatagtcttctctgttagagagttttacccaagaaaaaaagtatctataaagaacataccagtgaggtgccttatatgtcttggaggaagtacactgccctagtgcccataagataatggagtgccacgttagcgctcgagcaagacagatgaggatatagtctgtcgtccactatgcagtagtgtcccctcgatgggagggagtgggaggcaggtacaaggtggcgctgccaggtgcccgggtctattggaggcgccccaatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggt

SEQ ID NO: 616692 - DNA, 2151 bp, Homo sapiens
  misc_feature (230)..(230): n is a, c, g, or t
  misc_feature (434)..(434): n is a, c, g, or t
  misc_feature (502)..(502): n is a, c, g, or t
  misc_feature (525)..(525): n is a, c, g, or t
acacgagtccgtcgcattcgaatatggagacttggggactaacggactggggacccccatattcctcctcgaggccacatgattacgctcctatggacatccccttggcatcacagagcgcataccccacgggggcgccgagtccagacctgtcaactgtgcctccgcatcctgcctgcgcgatgtgcgactatgcgcgcgtgtgtcctcgagcctcaagggatctcctngaagtctttggggcgcgtacttaggaatagctacgaggagaagctagtagacgcgatgaaagaagacactggcctgcttttctgaaagcgaccgcatctctctcctcaactatgtattctcttctccatctaacctgtctgttcgtgtgttatgtatcatatgtcttcttgcgcatgggtgatatggtcctcctggcgagaagngtcgcctgtcccagcgcgtgacgaggcgcaggcgaatgagacaaactgcgcgctcgacgacgacaagntatggtgacttggcagccgtcantacgagacggtaatggtagtgggagagcttgactcaagcgggctacaacgttagggttacctaaggatatacacatggagcggcctatccgatgaacagactgcttggacgtgtgtcgtagtagtacatggcctcaacctggtacgaacatgttgggcctttcctctaccggaggcccaattgggccttgcgagtgcagcctgactcataaaagtcttgaagtggggggcggcgtgggggggactctgcacggcggctcggtggaacgacgcacgaggcacgcaagcaaggcagggcgccctccaggaacgggcgggcctaatgcccgaaaaagggcgggcgcggtcggccatttcacactcttgcggtgaagcccatggccgggcaagaggaggcccccaaaagcacggggagagcaccacccccaccacacactcaatcaaacaaaaggctcgctcccaccggagcacccgcacccacacgtcccacgaccccattctcaccccccattactaccccccacctaaacaggcacgcaccactaccacccacccacgcacgcatcctcacacaccaccccccactaccctcatctactactcacaatataataataactactcatcacaccaactacacctcgatacaaacaacacatactatcagccgatcactctctaacatcacacctcaacataactacacaacctcacaccaccaccctacaccccgacacattcaatcccccacttataacttcaatcagatattatatattacataaattcaataagactcaccaacacgacaactaacaacgaatagcaacaaacacccaacagacccgaaccaaacaaataccacattatgacttataatatactcatattcaccacttacttcgtaatcactacacgtcagagcaaactacactgatatgttactagcttccaactcatactataccatcattcacacaaccatcgcatagaaaccgatcctatacaacgcatcacaatacaacgcacacaacacgttatcaactgacgtaccatagaagacgactacatacactcccatacattacacacatccatcacaaacaccatcatcaatctacaaatccagaatcgagcacacacccatcccacacacaacccacgaccagacactagacgtatcactagaacacccgcacaagagcccagacataacccaattcacacacaaacatcaccacactcaccacacagtccaccacacccaacaccacactcacacaaacaaccacaacgaaatatacaatcaccacccacacaccacggacacacacggcagcaagaacgacaggaaagaacgagaaccgaactaagagcagcaagatcgagataggaacaaagcaagaagcaaagagagacacacggaccagagacgggacgatggcagggagcacgacgcggaaacagcaacaccagagatgcgacaacacgccaagccaacagacacagacacaccgccgcagcacagaccaccggcgagaggacaacccacaccaaagacacacgaaaaccacgacaagaccacagcaaggagccacaaccggcggacacaacaagatggagacga

SEQ ID NO: 616693 - DNA, 860 bp, Homo sapiens
  misc_feature (14)..(14): n is a, c, g, or t
  misc_feature (21)..(21): n is a, c, g, or t
  misc_feature (612)..(612): n is a, c, g, or t
  misc_feature (719)..(719): n is a, c, g, or t
tcgttaagtaaccncagatcnttggtttagtcagaccatcatgtctatctgaatggagctctcaagaacatgcatctgcttaggaagacctggctggaaacttattttaatcacacccatgacaaactctccagaactgcccaccatcattcacgaaaacaacccctagtggacggcccaaaactgagcaacaccctcatacatcacccatcacaaccacccactctgctccgttcatagaaccacacaaccaacaacgacggctgatcactcatgcacacaccaaccccctgaaaaaatcacaacaaaaaacatcaatgcacagcacaacaccccaaccgaaaaaccacaaaacccctccacatccaacaacgccaacaacccacatactactcccaacaaccatacaccccaacctttaccaccataacacataacccccacaaaaaacaccccaagacaaccccacaccgaccaccagatcgcaaatcaataaacataaccaaaccataaacaagtacacaacataacaccaacataagacaaacaacaacataccaacacacaaccccatacctactaccaccacctcaccacgacgacaactaatantaatcataaaaagaagacaacacacacacccatcaacataccgaccattaacaacaccagaagcagacacacccaacaccaatacatatcacgacgacaacaacccncacccacccacgccgacggcaccaccacaccccccaccacccactaccatacccaataaatcttacgaccaccaaaacacaacaatccaacaagcacagcaccacactggtagatacataaaatacaaaacgcaacaccct

SEQ ID NO: 616694 - DNA, 292 bp, Homo sapiens
cggtctttaggaggtgatagtcatcgctgtcgaggtgtatacaccaggtgtcgggaaatactcctgaggaagcggagggctccagacagactcgatgagcagagggagatgcggagcagctctagattggatttcgtgtgcgtttcctccatgtaggagggtgtcggaatagagtctgagaagcagaaggcggtctgggagtcatgcaggaatgaatacttctggtcctttgggatataggtttcttcaaactcctggtaggtgtcaatggccagctggagggggccgcgcg

SEQ ID NO: 616695 - DNA, 989 bp, Homo sapiens
  misc_feature (195)..(195): n is a, c, g, or t
gttggaatatgtgcccgcgccggtggattttctcactgtcccggggctgtttgggaagggtggctgtccgtctgcgcgagaagccagggattcttcggcgtgggctctccccaattctgcggtggtggctcccccgatgggggcccgctttttgttcctctgttggactttttgaagcgccggcgccccgccgtngctagtatgggccgccccacggggacattggtcgtttctgctggtgcggaaacattcagttctggccccgcaaggtcgccctcctcgggtctgcgagatgacccccggctttggtagccacgaccggccgctattttcgggcctcttcttgtgcaggcgaaggtcatgtgccgggtcgtcgcgtctgctcaacacagtagagtccccttctttggggccgggaaattacgcaatggggggtcctgtagagaagcatgtcttgttctgactagggaagtcctatattccctacggttcgtggtaggagaagccggtggagctcatagacggcgtcttttcttgattggcagtgtatgaaaaagtcggcgctgggggccgtcatagataaataagtcaggccgcgtgatatatgacgccctcccaccagtcggctggcagtactggcactcattccccgcccgtgtgtagggggtgttgtgttcttcagtaagcgccccggaggtgtgggaaggcccctccttctaatgtgtgtttatagaaaagaccactcttgaacagcagagatgatgctcgtggtagatgaggttgcttagtcacttcataaagtatgctaacaatatcgtgcagtcacaggttgactgcgtgcgaccccgctgccatagggcccccacgcccccgcactgcgcttgagtccaggggttttaaatcccccattaaaggttgccgccatatgcctggccacaacgttttcacgaaggttcgaagcaaaaaaaggaaaacccccccacaaaaca

SEQ ID NO: 616696 - DNA, 308 bp, Homo sapiens
  misc_feature (17)..(17): n is a, c, g, or t
  misc_feature (122)..(122): n is a, c, g, or t
caacggatgtgccgctncgcccgtgctacccacgttgaaggtggacccgacctgatactgcggttgcattcatcacgttcatggaaggcctcgtccctttcacgagcgatggcaagattgangccgaacgttgaagcgtgaaaagtcattttatttcattcgcttaagtacatcccctcctctcctcgtacgcgcggaataggaaatatttaccgtctttatgagactggtatggcacatcctgccgccagaccagcatgcgcgaaccgatttgagaacagctgcatcccggagcggcacatccgttg

SEQ ID NO: 616697 - DNA, 201 bp, Homo sapiens
  misc_feature (81)..(81): n is a, c, g, or t
cggtctgagggcggcggtctacgactcagactggggtcgggttatgacagcgcgcaacggtgagtactgtctctcggctgncacacaggctccggctgcgtgcctgtgtgtgtgtgttgtggtctgtgctgtgcgtggtggcgtgttgtgttgcttttgttggtggctgtggtgtgcgtgtgtgtggtggtttcggtggtg

SEQ ID NO: 616698 - DNA, 134 bp, Homo sapiens
caagtaaatcccccctttaaaatttttttttttagcaaagccctgtcattttttgtgaaaaagggtatgtttatttattccaaaactgagtcatatataaattttcaataaaagcagaaacttttttcccttta

SEQ ID NO: 616699 - DNA, 464 bp, Homo sapiens
ggtatcgtgcatccaaatcaaaatcgtcacctggtctaaaatctggccaggcacggtggctcatgctgtagtcctagcactttgggaggcgaggtgggaggatgcctgaggcaggagtttgagaccagcctgggcaacatggtgaaacccatctctactaaaaatataaaaattagtggggtgtggtgggacgtgcctgtagtcccaactacttgtgaggctgaggcaggagactcgcttgaacctgagaggcagaggttgcagtaagttgacatcacgccactgcaactccagcctgggtgatggagagagacctgtctcaaaacaaaaacaaaaacaaacaaaaaaaattccaaataactaaatgtaaaatctaaaacttttgagcactacacatgggactcaaacgaaatgctcactggagcatctcggcattccagattctcggatttgagatgcttaac

SEQ ID NO: 616700 - DNA, 200 bp, Homo sapiens
ctgctcgaattcaagcttctaacgatgtacggggacatggtggtggacacatcaaatcccagctactagggaggctgaggcaggagaattgcttgaacctgggaggcggaggttgcagtgagccagtgcactccagcctgatgacagagcaagattcagtctcaaaaataaataaaaataataaaacctccataagcaaa

SEQ ID NO: 616701 - DNA, 357 bp, Homo sapiens
gactcccctatgggtcgactgcagcgtgcgtgaattcacatagatgattaggtgacctgtcaacgttggagcaatggtctgaatttgatccgtgagaagctactcacatagctagaataaatacagcgactacgagcactagtgctgattgcatccgataagctgcacagtgcagtgcaacaggttcgtgggacgccacaccgcgaacaagggtggcgtgttcgtgctgctatttcgtctgcatgcgccagaacacatcacggcaaaaggcatctgaacgtttccgcttcacccgtgttgtacgtttgcgtacctttaggccggctgataaaattctgcacagcttgaatcataaca

SEQ ID NO: 616702 - DNA, 431 bp, Homo sapiens
  misc_feature (21)..(21): n is a, c, g, or t
  misc_feature (52)..(52): n is a, c, g, or t
  misc_feature (69)..(69): n is a, c, g, or t
  misc_feature (279)..(279): n is a, c, g, or t
tgccccggacagtgatgggtnccccagccttcatccccatgtcccccctccnaaagggccatgaacccncatcccttttatgggcctgccataggtattcccccatgggtttatatggtgccccacattttccttcatccccagcctatcattgatggggcatttggggttgggtttcaagtctttgcctattgtgaatagtgctgcaataaacatacatgtgtgtgtgtcattacagtagaatgatttatactcctttgggtaacttctggttctagntccttgaggaatcaccacactgtcttctataatggttgaactaatttactctcccaccaacagtgtaaaagcattcctatttctccacatcctcttcagcatctgttggtggggaacgtaatttatttgagccactgtgaaaagcagtttgg

SEQ ID NO: 616703 - DNA, 375 bp, Homo sapiens
  misc_feature (3)..(3): n is a, c, g, or t
  misc_feature (43)..(43): n is a, c, g, or t
  misc_feature (303)..(303): n is a, c, g, or t
agngatttaattggcttacagtttctgcaggctgtactacaangcatggctaccagcagctgcttctgatgagggcctcaggaagcttacaatcatggtagaaggcaaaatgggagcgagcactatcacatggtgagagagggagcaagagagaggaggaggtcccagactctaaacaaccaaatttcacatgaactaagatctcactcatcacccaaggtgatggtgccaagccattcatgaaggatttgccccatgattctatacctcccacgaggccctacctccagcattgggggttanatttcaccatgagatttggaagtgacagccatccaaaccatatcagcaacataacaagacccccaactctta

SEQ ID NO: 616704 - DNA, 235 bp, Homo sapiens
gacgatagaccagcgcagtgaaatgcgcagcttgcgcattacccacattacactttaccctcattgtgagtcagtcctatatgagcgagctgtcagacacttgtcacatggttggtcttggaggaatgagtctggccttctctccctgaccagttgggatagacacctgactggaatccttgacactggcaggtgtttctatgaacatagaggactgtgcctacgtgtccggcca

SEQ ID NO: 616705 - DNA, 943 bp, Homo sapiens
atggcacatgtcagtcgcaagtatggtcctactaacgaacgctacttcccctatcatacgaacgagcttatcacctttcatgatcacggcccgtcataagtcatgtatcccttatctgctatcctaggtcctgtatgcccttttccataagcagctcacaacaaaactaactaaataactaacatctcagacgctcaccgtaatatacgtagaaccgctcctggaacttagtcgcttgcccgcggcgcagtgcgaatcgctagatcgctcaattcgcgccctccccctataccccgtgaacgtccattccgtctttatccataaaccatgcatcgaaagagttcctaacagactcccgcatctcctttaccctattcagacatgcgaaattcgtgtcacacccaaatgggatgacctgaaaccgctaactgaagggtaacctatccggaaccattactgggcccgagacctatcagaatttcgtatgcctaatcgttcccttggctaattaaccttttccgcgcgctcaaattaaattctcgctaatgtgagacccccaaggggaccggtacctcgtgcggaagtttgcccatgtgtgaacggggtctgagagccaaatccgtgagaatgagctcaacagtccacccgaactctgggaataagtcgccgcacaactgtccggttcatgtacattgaaaactctttaccaattccagacgaacagcgaatgactccttatgcgacatctcttgcccagttgccaggcccttgtttttcccccgcaagcagttttgagaggcccctttgacacaccagtgcgcggcacgttgcccaaattttcccccccgcgataattgatgtgcgtaaaacagaccagaacacaagccccatcttttgtcaacttcggtcgttgaccaccaggacccccgagggggggttatta

SEQ ID NO: 616706 - DNA, 782 bp, Homo sapiens
gatgaacaggcatgctcatggaacagctgctggctgtggtgtgcgagagggccagctctgtgcgcctaaggtacgtccgccgagctgcccggtgccttccccgaaacgttttatgggggagagctccgggtctccgcggattactcgtgcagacggtgtatataatgctcgtgaacgaaagcgattctgcaaagacgccatgaggtggattcctaatcagcctcctcaccggggaaagccgaggagtgggtggtggcctacgatcgagatggatagccccatcctaaggtgattacgggccttcctcgatgagatgaaacagtgcttggctgggatgacgacgaagacgagagacgaagcagcaggaggcatgatctattaggccctcgacctcggccttcggggggaaggtgcctgcatgcggacacccccctccccggaagccttcaccgcggcacaggagccatagttctaccccattgcacttccgggtcgcctttagcttacccggcgccccgggagtgctcttacaactacgttcattgctcccgaagttggttcgccttttgtacccatggaataagcgcacacaaatacttgctagataggggtcgcgcgctggaagccttcacatcagtcaggaaggtgagtgggacagtggaatctaccgtggcatcccggggatcgtccctggataatttgaatggtgtcttgcaccccagattattggcaggcctgatacacgagcgaaaccataacatcgttggacatgactatggaag

SEQ ID NO: 616707 - DNA, 300 bp, Homo sapiens
gtcgacaaaaaataaaaattcaaacaggctaggtctggtggctcattcctataatcttaacactttgggaggctgaagtgggaagatagcttgagcccaggaagttgagaccatcctgggcaacatagtgagaccccatctctacactctcaaaaaaattaggtgagtgtcctggtgtgcacctgtggtcccaaatactcaggaggctgaggcaagacagaatgcttgatcctaggtgattgtaccactgcccttcagtctggacaacagagtgagactctcttaaaaaaaaagtcgacg

SEQ ID NO: 616708 - DNA, 142 bp, Homo sapiens
aatgtcagtactcccattcagtaaccatcggggaagtgagctggaggagccgtggagtccacaccctacacctgccttccccttgcaggttattgggccaaatctcagctccttaagctacatgggaggctatcagagcgtg

SEQ ID NO: 616709 - DNA, 384 bp, Homo sapiens
ggagcattaaggttaagctgagaagaaagattgtatacaatccactgcatggataagaacagttggttctagaccatggtcttgtttagaggaaacatcccaccaatgaactactctgttgcggcgacgttcgaaatatcaggcgtcgtagtcaattagggataggagggttgttcatgcttgctcaacttccaccggcattgcagagcctgcatctgccgctgcggctgaaactgtgggacggcaaccagttcgatctggggcctagcccgcaggtcaccatcctggtcaaggaaccacagctcatcagccagttgacccatccaagcatggatcagctaggcaccgcatttgttgaaggcaagctggagctggagggcgata

SEQ ID NO: 616710 - DNA, 139 bp, Homo sapiens
ttcatggcatgaagacatcagctacgaggtcatcgcgctttatcgccgccgttccacgcatcagcgtcggttgaagaagggagtggatcatcaccccgtgagtgcgagatcaacaccgagctctaactgtcttgcagtg

SEQ ID NO: 616711 - DNA, 240 bp, Homo sapiens
  misc_feature (38)..(38): n is a, c, g, or t
  misc_feature (59)..(59): n is a, c, g, or t
  misc_feature (153)..(153): n is a, c, g, or t
ccccaaccaaaacccgaggaaacctaggcgtaccttcnggactgggcatggggcaaagnacctgaatccccaaagcattgcaacaaaagctaaaatggacaaatgggatctaattaaactaaagagcttctgcacaacaaaagaaactatctncagagtgaacaggcaaccaacagaatgggagaaattgcaatccatctgacaaaggtctaatgtccagaatttacaaggaacttaaac

SEQ ID NO: 616712 - DNA, 249 bp, Homo sapiens
ccccggggtttggggggggttttaaaggtttggccttggggccccccccccccctaggggttttccccccccccccgcccgggccctttggggggccccccgggggggttttttgggggcggggggggcccccccccccattgccgccccctggtttttttttttctttgggggggttccccccgcctttttttccccgggggggaaaaagatttttttttttttggccctttacttttccccattgga

SEQ ID NO: 616713 - DNA, 576 bp, Homo sapiens
aagcagacaaatccctcttaattggagtgttcaaacatgggtatgagaagtacaactccatgcgagctgaccccgcgctgtgctttctggaacgagtcggtatgcctgatgccaaggcacatagctgccgagcaagagaggaacagacatgctagccagatggtggtgacgggggagaatttgatagagaagatgaagacccagaatataaaccaaccagaacaccgttcaagagatgcaaatagcatgcaattgtgcaaattctccttcagaggatcaggcaagaatccatggaaatacatgccacaggcaagcacagtgagagtaatgcgtgagttaggcacaacgtttacgtggacgctaacaaattcaagcccgtgacgtacacgatatgcgccaggatcgattactgcctatcagcgcagatataaaaagggaacaagatgaggcaagaggccctaatgaagactgaccggcgcagacaggcgcgcctcgagaggacagtgcagagctctggaagcggaaagggaagctatatatcatctgagaagcggcaacaagtggaccaagaagaga

SEQ ID NO: 616714 - DNA, 104 bp, Homo sapiens
gggtctctatgtccctgtaagactcttgaggggacccacactgggttgaggccagtgtctcctgttgtaaattcaagtggatgaccctctccccaccctcctct

SEQ ID NO: 616715 - DNA, 370 bp, Homo sapiens
  misc_feature (13)..(14): n is a, c, g, or t
  misc_feature (17)..(17): n is a, c, g, or t
  misc_feature (38)..(39): n is a, c, g, or t
  misc_feature (93)..(94): n is a, c, g, or t
catcctagaacgnnggntgaggttctgttgcgggtagnntagcactcaggactagaaataccaaagattgccaacaccaggaaccaaatcgcnntatgctagcaatgtcaactattcttgagatactaatacatatatttcttctggtgaagggtaaaaatgacttggcaagacgaatttgctaaataattgttaacccaaattgataatgttaccatcgtcttattactggaatttcataatggatatgtaaaatgtaaggatggaaaaataacatctgtattgtgcacaattagagatttttagagaatggcatttaaaccttgaacctccaaattaattcactaaaatacgtttcttctaatacaca

SEQ ID NO: 616716 - DNA, 337 bp, Homo sapiens
  misc_feature (86)..(86): n is a, c, g, or t
gtcccctctcctcttctcccctcacccagcaggcacccccggttcccgccaggccctcctgccatgtcggacccagacgtccccangggctcggatgtccccgcatgtggccccttgttccacggggatgcctgagccccttcaaggagccccaagccaggccccaagctgtggcccaggcctgagccccagggaccatgagcgggggcaagaagaagagtagtgttccccaaaaattccaaccaaggcggtcagccggacggagctactgagggccctgggagcccaggggcttcggatcccaggagcccacaggcagaacgcggacgagaaccca

SEQ ID NO: 616717 - DNA, 1504 bp, Homo sapiens
cggacgcgtgggttaacccgctctaataaaattaattaagccacgtgcactcatcgtacctcacccagccccatccaacattctctcgccatggattgatagagctttcgtgcgtcactccttgggcagcctgaccttgatacctccaatatacagccactagggactatgtcctatgcccgatgacagctactgcaccacgacgcctgcgaagcctggctcttgttcagtcaatacgccactcgatcattccagcgtcgatgagcgctagcattgatggcatgaagtgcagtactcgctacctctcacggccaatggacgccttcaaataatttcttatatctcgccatcttcactacacatcgggctgcagggcgctgagtatctacggagtcactttcctcgtacttcagaagatcctgacatatcactcggcattgattcgctcctgcttgcaaagctattacgacaacaggccttcactaggcatatgtcctcccgtgaggccacaaataatcgagttctgaggggggacccccaggtacatttacgccaaacctttactcatactcgcgcgatacccattatacttgttggagcagcaagcgaccattagctagccagatgaaattcttggagggagtgcctatctacaagataagaatgaggataccccaaccccttcaagcaacgaatatcttttgacccttgtaacgtctcagtctttgtcccttttccatgtaattgggcagtccgcttaagccagtcaacttcgccaccattcctaaattccttggcaacgaagaaaccgtggaattctagaacaaaaccctccgcgtaagtgtaagtgcatcaattcccccaattgctctgaattaaaatattccacccttttcccaaccccgtttaacttaacaccaatgttcacactgaacgtccccattcgtggttttaacatatacatcttacccatatcatctcccttataatgaacaatataaagcacctaatttcttcaaacccaggaaccttccttaatgcgaaaacccaaggaccacaagttgattacccccgtaaaggccgcaaaaccctcgtcttatagagcgtaccccggttcccccacaggagtatcaaggggcccgcgaaaggaatatattagccgtaatattgccgataaacaaaaagttgttcccgcgaaacccgggcccctatagacaaccaaaggagaggggaggcagatgcacccaagtaaaataatcgcccagcccgacccgctgttaggacagaaagaaccccccaagcgcgcacctatatattcaaccgagagaaggccgaatcaatttagcccgcccgcaacgacaagcacatatatatagcgccacaccacagcaaaccccctctacaaccacacacgaaggggagagacagaccaagcggcatacatccacaaggagaagagcaacgagaaccacacaacagcaaccacctcagcaaaaagagacga

SEQ ID NO: 616718 - DNA, 389 bp, Homo sapiens
gcacgagagcacacagagggataaactggctcgcgtgtggacactctccggctctgtggccagacgagagcgcacatgagggacccagcactctagagacacaacacacatgtgtagctgctattggctgagtgtgtatcctgtgaccaatggcctgtgtggctggacgatgccttggcttgagcttttttggtgctggttagttcccgcccctgtgaaacctgtggtaggtggaggttctgtcttaactcgaggggcacctgggattcaggacgcttctaaggggctctggctgtccgcgttaatgaaggacaacgcgtttgcgagcaccctgtgctgtgtcttgtgtagcggccttccagagccttgctttggacctttggacgccc

SEQ ID NO: 616719 - DNA, 219 bp, Homo sapiens
gaaggcagagcttgcagtgagctggagattgcgccactgcactccagcctgggagacagagtgagactccgtctcaaaaaaaaaatgtcgtcttataacaaattaaaagtctgccaatttcccttttacacagaactccaaatttggagtacccttggaaaagaaaggaataatctggatgctctccagatcctacttttctgcttactttggcactgt

SEQ ID NO: 616720 - DNA, 199 bp, Homo sapiens
  misc_feature (140)..(140): n is a, c, g, or t
gacagagtctcactctgtcgcccaggctggcagtgtaactgattgcgactactcggcatcactgcaacctcaatgcgcatcccggaggtcaagcgaattctcctgcgcgtcagcgctcctgagtatgctgggattactanctgtgccctgccaccgactgccccggctaatttttgtatttttagtagagatcggggtt

SEQ ID NO: 616721 - DNA, 124 bp, Homo sapiens
cacgaggggcataccagccgtatgggcgttgacctggtcttgacatccttggtgtcgtataagttgcaggccaccgtgatgtgcttggctacgcacggtcgcttcctggaaattgggaaattcg

SEQ ID NO: 616722 - DNA, 169 bp, Homo sapiens
tagactgcgttctcctatccaggtaaattagaagaaataccacagtattcacgacgtttcctagtttttagacttcatctgcagtattggataaaataaatgcaattgtgctctgcatttaggatgcttacattgtcataagcgatgtgttgggaatgtcaacagagca

SEQ ID NO: 616723 - DNA, 871 bp, Homo sapiens
tactaatctccctacaaatcgccttaatgataatccattcacagtcatagaactaatcatattctatatcttcttcgataagccacaacttatcccctaccttggatatcatgcacccgtatgagaggtcaaacacatgaccagaaacgtccatgagacgcaggacactattactatacctattgcatacaacctagttaggcatcgcacttacccccctactcatcggcatctaattatgatcactgcatcaactactcctagggcatctaacctaaatatcatgtccttactattcagtctcagctgccaagaacttatgcaagagtccatgagccaatcagacctgaatatgactagcttatcacgagagcttggatagtaaagatacctctttatcggactaccactttagtgatccctaaaagcccaagtcgaagcccgcatcgactgggtcagaagtatcttggccgagtagtctctgaaaaggtaggcggtaatggtatcaatacgcctcacatctgcattctcaatccctctgacaaaataagaattaggctagccccttgcctatgtatctatccctatcgagggaatagtttataacgagagtcgcatactggtctaaagaacaaacagaggcgtaaaaatctgctccattgcataatcttgtcagatgcaagcatcaataagtcctccgttagtaaccagacagattgttcattcaaaaccccttgaaggtttaccggagcagacattcatatagatgcgccagggggttacatactcattacgaatatggctaaaaacccaattataacgcaccggaggagatctgagcccttcaggttcagtctatccctacacttgg

SEQ ID NO: 616724 - DNA, 199 bp, Homo sapiens
acggctgctggtgagcagattatgtgaggtccaagtttgagactatgtctggcaacatggtgaaaccctgttgctactaaaaatacaaaaattgtgcgggcgtgctgctgggtgcatgtaatcccaacactttggcaggctgaggcgggcggatcacgaatgtccggacgatctgagaccactcctggcccaacactgg

SEQ ID NO: 616725 - DNA, 881 bp, Homo sapiens
tcctagtatcctgctgattgagcgcgcgtgcgcacctttcttttgtggacttggtcatatgtgttctcgagcatatgctgtttctgcgcacttaggtagtgacgcatctcgacagacctcttgacaagactcgtggggcatactcgaacgttgtgatacataatcttcaatggagttcaggagcgcccttgacctggattctgtcgtccatgatgctcaaaacgagctcgatatcaaatttagatcctcgtgcatgactaaccatccagcaccacttaaagttttaaaaagaataacagacaagaaagaagtggctgaaacctaaatgccatatggagaagacagtaattgccacatctcctctttggtctttcctggtacgcagcataaagcccacagatgaggactctgcacattgctgttctctctgcctggagctctatggtccagatagaactcctgccaactccttcgctgtgtccaagttaccttcattacattgtcagctttaaatgtgtgcctactttttggcctaactagaattggagacctcttcacaatgtgtcccattcttccttaacttaagccactttattctcattataaagcacattatcttgccttgattttatcataatcgtacgcataaacgtatattgcattaacttcggtggatacctatcggctgttctgtgcacaggatgttaacccccatgaagacgagaatctggacgtcatcatgattatgccacggttggaccagcgccatatcattctgaactacgcaactaaaacttagcaagcggaccggggaccacgggtgactgtccaacaatgtcacctcagcgcactcccgtaaacaaaatgcccgcaaaacacgc

SEQ ID NO: 616726 - DNA, 484 bp, Homo sapiens
  misc_feature (484)..(484): n is a, c, g, or t
gttttgggggacacttgaacactgactttggtgttttcccctggttgaggatggccctatggatactgagtttcctagaactaggggaccctaaacattcattgtaatgaaagcagatagattgtgagcataattactcccagaatgttgatgtaaagctgagagtaaatgggtagtttcttacaactaattgttcagtgtcaccagcacacctcactgagggggaaactgtccacccagcacgctgcatccagccctgctctgtgagaccacctcattcccattcagtctctttgttggccaggagtccataatggtgtgtgcatgtgggggagggggatcttttcctgccaatctacaaacctagcctacaaagcttcacctctacaatatgtactgaaagtaaagtgataaggaataattatgattgagattattattggccaccctaatataatgtacataataaactttatcatcatan

SEQ ID NO: 616727 - DNA, 205 bp, Homo sapiens
  misc_feature (195)..(195): n is a, c, g, or t
cgtgtcggctagaaagaattacaactaggcaggatttagccactgtgggagggtggacaggcgagtggttcaggtggcctggctgttggtaggaactccaagtgcccaggcctcttgggtagcttagggccctgcctctgtgtcatgatgcatgggtcatttgtcttgggtgtcatatcccatatggagacgaanggggctctaa

SEQ ID NO: 616728 - DNA, 434 bp, Homo sapiens
ctggtaaatgtagatactgtgggaggtcaggagtttgagaccagcctggccaacatggtgaaatccgtctctactaataaatacaaaaagaaaaacaaaaaaaaaaataatctggggcgtgctggcttgctcctgtaatcccagctacttgggaggtctgaggcacaagaatcacctaaaccctggagttagatgttgaagtgagctgagttcatgccactgcaactccagtctgtgcgacagtggaagactcgtgtctcaagaaaaagaaacaaggtgatagtttgggtttggggggtaatcggtttggtaggtcttggtacctgatgaatctactcagatttaacgggtatgtggctttccttttagtttggtcttcttatgcttgcaatacagtttcaattccatcaaagcaacagtgcttagcacagtta

SEQ ID NO: 616729 - DNA, 433 bp, Homo sapiens
tccatgtatggtcaccaggtgagagcaccccggcgatcattcgcgtgccacgatcactctctctgcgaacagcagcaggcgtcaagaatccgcgtggacattctagcaaactgctatcatacaaaagcttgtccggacaggtcaagggagcgtagatggttgtctttgccatcgaaaaatctcaaaagtgtatatatcctattatccgtgctcagtcggctcaacaatatctgcagccaagccatctcttcaatccccccggattctcatatgctcactggaatgagatcttagcatctttgtgacacccagttcaatttcatttcgtctgtaaaatacttcatgaaacactgaagtcgtataccttctggggtgcagagtaccttcagtggcgaagcagatatcccacagactctactcattgccaaaatca

SEQ ID NO: 616730 - DNA, 92 bp, Homo sapiens
ggcacgaggcaggaagtggaaaaattcactaagcggctggtgaaagtcactaagcagcacaatgatgagtgcaaacatctgctgctcggccc

SEQ ID NO: 616731 - DNA, 1333 bp, Homo sapiens
ggataaaaaatgaactccattaatattattttcttaagacagatcatgcatcatgatggccctaggcatggagtgctggagatgcaggtggaggcgccatctatcaggtcatcaacaggacctctcgtgcacttcaccggggttctgggcagaattatccctgcatcgagacctccatgtagatatgcatgggaattagtcatggcttgaggtccatctcatgcctcattgatagattgggattagtagtatttacggtaagagcatcgtgggattatctggacagcttggaatggtggccgatggtctgtgttcatcgtaaacttcacttgcatgctcgaaagctgtactctcgaacagcagtccttcagagagcatacccctgtgagggttgcttgcagtaattggcaagggccgtgaagccaacgctaggcgcacaaagcacaagaagatttgatagctcgccttatatgaggactaggaatttgtgcgtcatgatagaccttggagacttatcctctatcttagaggtatcacgaatgagtcgttgccgaagaattgtagtttatatcaccgaccttttaatcaataacttttaaagtcaagattgggcaaagttggccccctgggggaaagaaagtcagggggttcaagtaggatgtggtaagacacggctttcacgtaggggcgtgatttttaggcgtcgggcccataggggcgccattcatttcatcccgaaggttgttattcctccgtaattttacatatacaggacctaggttccaaaagaaatggacttttaactattttgggcccgaatattgggctaccggtttgtttcatacaggcgtggggatgcaattttctgggagagttctttgggacatccacttagcgggggtcctctgtgtgtccacagaagttcacaaaatggcttaatccctctcgggagaaaaatttgggccactttcgagacgtgggaaaatggcctgtggagacaggttgaggggggaggcatattgggtaagtaggcgcgagctagtcgtgggaaggttagttgccacagagtttgataccaccctgaaacacgacagggtttccggccgtgcgagttggaaaggcccttctcttttagaggccactgtgacaccgattagggtacccagtggggtctagcgcgacgccaggcaacaccgttggccaaaaccccccttttccaccaggaagtccttggtctctcccttttggaagcccttaaagaaacgggttagggctttaaatggtaaactgcccccttcctgggtgtcctgttgaacgccataccttggggtgg

SEQ ID NO: 616732 - DNA, 948 bp, Homo sapiens
gccgggggctccacaagaggagaaccaccttgggacatggagccgcaaggggtataccccaaagttttctcgccgggggacaaagaaaatccggggtagagaggaacccgagtgttctctcccctaatgaccaaagggcgcctttggagaccagcgaagacccgttggacgatattgggtccacgaggaactcgaaagaaaaggcccaagacctgtgaggattgtagaaagcagcagggggacacacgggggtccactcccagaagatattcccctgtaagtctcctaagcgccttccacaacgggaagagccaacctggatgtgaagatggaggaagctttcccagagccgcagaaatttacaggatgagggccccgaacacagaaagaattctgggacaaaagaatgtgaataggaaaaataatcgcaacatgggcttgataaagagaatccagaactgcctggaggaaagaggaaagaacaatttgtgacacatcgccacccaggaaagaagactgggaggaaaattgtgccaacacgcccatcggatctaacacccagagtgttacaccagagatggccagggagagccaaccacaggagggatacctcgggggagtttcctggtggtggaggctcctccctctggtggtgcttcctcacggggccaccccttgagagaggttgtgatatagcccacacagtgtatgagtgtacgcactgttgcacacaattaaaacaatttggaggggccttaaatttgtagcaaaattttgtggcagtttttaaaaagttataggctgctatttgtaaatttctgggcattttccataattgatatgggaaaaattcacacgggggaggaaattaccttgtcccttttttaaccctgttttgtaaatgggaaaagccaagtttttaattaaactattttaattggcccccca

SEQ ID NO: 616733 - DNA, 121 bp, Homo sapiens
tgtaatagttatctcgagtgatggcctcctcgctggtctggccagcagcaacaaggctgtaaatcaactgttcggcatttcctactcaggatatgacactccacaatcttggtttcctgtt

SEQ ID NO: 616734 - DNA, 541 bp, Homo sapiens
  misc_feature (480)..(480): n is a, c, g, or t
  misc_feature (536)..(536): n is a, c, g, or t
cgggattgacatataactgggctttaagcattcttttttttgagaagtctcgctcttgtccccaggctggagcgcaatgccgcaatctcggctcactgcaactctgcctccgggttcaagcgattccactgccccggcccccctgagaagctgagattatgggcgcctgccaccacacccggctaatttttgtattttttggtagagacacagtgtttcaccatgttggccaggctggtatcgaacttgcgacctcaggtgatcctcttgcctcagtttcccaaagtgcttggattacaggcgtgagccactgcgtccagccgatgtttcttaagtgtttgctatgtgccaggccttgtgctgagggccttgtggatatcttatctcatttaattcactcggcactcaggcgtgaagatgaggacactgagggagaggcttgtggagctggcccgcctctccacaacccaggacttcganctgttttccttcagcacctctgactgtatgtggatgcttcttagccaggacccggncccac

SEQ ID NO: 616735 - DNA, 148 bp, Homo sapiens
agacatgtcgagcagcgggcaagaacacactttgagggttaaagaaggtctgagctgggaagatggctcatgcctgtaatcccagcactttgcgaggatcctttgagcccagaaattggtgaccttcctaggcgacagagagagaccc

SEQ ID NO: 616736 - DNA, 294 bp, Homo sapiens
  misc_feature (114)..(114): n is a, c, g, or t
  misc_feature (132)..(132): n is a, c, g, or t
aacccttgtgggacattacagacgtgataactttaatggcttaatattttgctacattaatatgcagaggtgatagaaataatctatgaattttctcataaagataagaacttnagttctagtagaccacangatataattttgcatgtacccaatgggcattcaattttcaatgctataaagcttctgtcctctgtcattctcatgattatttatgctataactgtaaacctaaattattgacattgagaagtgcgcagagactttgtggcacacacgaatctccttataaga

SEQ ID NO: 616737 - DNA, 178 bp, Homo sapiens
gccggacacctggatggcacatcatcagaaggactgctcgctgcatatgctacggaatccaaagaatgcatggatggtgcaggagcagtgtctgcacatgccatgctgcaggagcttgcactgtgccactgggaatcacgcctggccaacgatgcaggacctgctgtgccacgcccca

SEQ ID NO: 616738 - DNA, 123 bp, Homo sapiens
gaccacagtctagatgagaggattctttcccaggggagagcaagagaatcaggaaatgaggctggcagaaagagaggggctaggtccatggagggtctcacattagaagtgtggcaaacttca

SEQ ID NO: 616739 - DNA, 220 bp, Homo sapiens
catttttcataagtagtttatctgcgagtggggcagggaaggaatagttcagcgccacttcgcgcagcttgacgaaggaggcatcgaggatattctggcgaggctggtgatcccacggattttcattataaaccatggtgtagctctggtatgatacggggatatcgttcggtgcgaatgtacgggtatcttgcagcatccgaccgtaagcatcgtatga

SEQ ID NO: 616740 - DNA, 592 bp, Homo sapiens
  misc_feature (24)..(24): n is a, c, g, or t
  misc_feature (62)..(62): n is a, c, g, or t
  misc_feature (74)..(74): n is a, c, g, or t
  misc_feature (105)..(105): n is a, c, g, or t
  misc_feature (134)..(134): n is a, c, g, or t
  misc_feature (139)..(139): n is a, c, g, or t
  misc_feature (147)..(147): n is a, c, g, or t
  misc_feature (160)..(160): n is a, c, g, or t
  misc_feature (167)..(167): n is a, c, g, or t
  misc_feature (186)..(186): n is a, c, g, or t
  misc_feature (209)..(209): n is a, c, g, or t
  misc_feature (211)..(211): n is a, c, g, or t
  misc_feature (220)..(220): n is a, c, g, or t
  misc_feature (231)..(231): n is a, c, g, or t
  misc_feature (258)..(258): n is a, c, g, or t
  misc_feature (264)..(264): n is a, c, g, or t
  misc_feature (288)..(290): n is a, c, g, or t
  misc_feature (293)..(293): n is a, c, g, or t
  misc_feature (297)..(297): n is a, c, g, or t
  misc_feature (299)..(301): n is a, c, g, or t
  misc_feature (328)..(328): n is a, c, g, or t
  misc_feature (336)..(336): n is a, c, g, or t
  misc_feature (340)..(340): n is a, c, g, or t
  misc_feature (342)..(342): n is a, c, g, or t
  misc_feature (347)..(347): n is a, c, g, or t
  misc_feature (363)..(363): n is a, c, g, or t
  misc_feature (365)..(365): n is a, c, g, or t
  misc_feature (372)..(372): n is a, c, g, or t
  misc_feature (374)..(374): n is a, c, g, or t
  misc_feature (380)..(380): n is a, c, g, or t
  misc_feature (385)..(385): n is a, c, g, or t
  misc_feature (392)..(393): n is a, c, g, or t
  misc_feature (407)..(407): n is a, c, g, or t
  misc_feature (430)..(430): n is a, c, g, or t
  misc_feature (447)..(447): n is a, c, g, or t
  misc_feature (452)..(452): n is a, c, g, or t
  misc_feature (455)..(455): n is a, c, g, or t
  misc_feature (457)..(457): n is a, c, g, or t
  misc_feature (462)..(464): n is a, c, g, or t
  misc_feature (467)..(467): n is a, c, g, or t
  misc_feature (478)..(478): n is a, c, g, or t
  misc_feature (487)..(487): n is a, c, g, or t
  misc_feature (493)..(493): n is a, c, g, or t
  misc_feature (496)..(496): n is a, c, g, or t
  misc_feature (503)..(503): n is a, c, g, or t
  misc_feature (518)..(518): n is a, c, g, or t
  misc_feature (522)..(522): n is a, c, g, or t
  misc_feature (530)..(530): n is a, c, g, or t
  misc_feature (589)..(589): n is a, c, g, or t
aaaagcaggtaacaccaaagaacnaaaatggtatccatattcgttgcaaaaatgataattanctggaattttcnaaacatcataatgaagggggatcaatggttnccactatcgttttcaaccaatatacaganttcgntcaaggtntaggttttatttntacatantagtattcacatgagttcnctattctgaagtattatcaaaangnggacccttnaaggtcgagcnctgcttttttcttgactttatgtatgntacttntctgtccttaccgtagtaagcttnnnctntttntnnntcgtttagaaattattgatgagaatgncggaaaanaacngnggttnttttataagaaaattnantatttantntttttncaaanatgtcgnnggttttttcttccncactagggtaccctgacttgctntattttttctgtgtgtnttganctngnaaaannnaangaacaggaaancaaaagggnccccantcngatgagntccatgtttgaaggngttnaattttcnattagaccccaatcttaagtgctttggaggattgtagttattgtttttgggtgtgtggngtg

SEQ ID NO: 616741 - DNA, 105 bp, Homo sapiens
aaacagtatagaggaaatgaaggacagatgcgggagctacaagatcagcttgaagctgagcaatatttctcgacactttataaaaccggcaggttgaaagacgca

SEQ ID NO: 616742 - DNA, 184 bp, Homo sapiens
  misc_feature (65)..(65): n is a, c, g, or t
gtataagaagtgatgggtgctcaataaccacatgtggctagtggctaccatattgaacccacagnagatacagaaaatgtgcgtcatcacagaaagctctttgtatggtgttatgaaagagctgtagcatttggtactcaggtttaaggtgtcaggaaacaaatatagctgaatgtatccatgg

SEQ ID NO: 616743 - DNA, 110 bp, Homo sapiens
tggaccctttgaacgcagtcggccctacagccgctgattcccccgcatcgcctcccgtggaaggcccaggcccgctttggagctttctcctttggtctataaccatgtcc

SEQ ID NO: 616744 - DNA, 159 bp, Homo sapiens
caatcgagccggtaccctcgattagggccaaatacttagtccagtgtcacaccaactttaagccagtcaagtggagaaataacatgttcaagaactgtatctgcatgggtgggaacatgtaacttgtacgactggtacgaagataggacatttgagatg

SEQ ID NO: 616745 - DNA, 270 bp, Homo sapiens
tggatgggtagttgtcacctcaaattgaccttagtgtatcttcaacatagttgtaatgtaaggaacccacagtttgaagactaataacttgggtttgaatcttagctccatcatttattgctaatttaactttgagcaagtttcttaaacttctataccttggtgttcccatgtgtaattgagtacttggcctttggagagattggtaagtgccaattaaaaccaattcctggccaggcagccagactgctctttctagcccagcctccc

SEQ ID NO: 616746 - DNA, 683 bp, Homo sapiens
cgcgtgagctgcccccacagtcatctgccttattacgtggccttctcccatgctgctggtgccgtgagctatgagtggccagtgacctggcgcgtggctcgggttgtaccgaggcggcattgcctgggagagctgacctagcagttcaagcgcgcaccccctctagcatggtcataggcctgatcttcctgcatgggaaaatgccctgctggttaaccgtgtcttcagtgaacgaagctaaactgcacccaccaaggttcctgcatcgggtctagctagcacaatctttgctgctcgtcatcgccctgtgttggcttggtggcggtgttcgactaccacatggacagaacgggctacgctgaccttgtacatgcctacacagtcttggtgcgggggactccttgtccttttgtccttgtactttgtgcagttgccttggtagggctatcagcttcttccttgttccccggagcttcattctccctgctggaggccgctacctgcccacagcacattcttcttgaggtgctaccatcttcctcctttccgttgggcaccgccttggtgggccctgaagggaggcccctgctgttcaacctcgggggcaaagtataggcgcattggagccccgaggggtgtcttgtcccacgtgttgggcctgtagctggctgatatacgggggg

SEQ ID NO: 616747 - DNA, 256 bp, Homo sapiens
  misc_feature (205)..(205): n is a, c, g, or t
cacgaggtgggatgccaaggcaggcggatcacttgaggtcaggagttcaagaccagcctggccaacatggtgaaaccccatctctactaaaaactacaaaaatgtaatcccagctacttgggaggctgaggcacgagaatcgcttgaacctggcaggtggagccgatatcgtgccactgcactccagcctgggtgatagagcganacgtctcaaaacaacaacaacaacagcgtatctccagtgagtaacaagagt

SEQ ID NO: 616748 - DNA, 383 bp, Homo sapiens
gaactccgtagcaagtgtgggtctggggttggaagggctgtggagtgagagtgaggaaggtagatagggccaattcactgggaccagttttatagcaggcacatcatattcattatttctaatccctggcaacacccatacggttaaacattaactcaattttatgggatggaaaaggtggtggctctaaggacattctctaactcacccacagggcaggtaggctaatacattcaaggaggtcaggaaggtggaaacctcgggtctggtctcacagggccatggccatttcctcaatggccaggtctggctaccaattttcttcctggccctattttccactatttaattggcataaaccctttggctgtcacctcctcttc

SEQ ID NO: 616749 - DNA, 1814 bp, Homo sapiens
atgatgccatcgatgtcgaaatgtcgacctgatattgggagaacacgcagtctgtactatgtacggaggtgggccttctttgaagggccgctgtagctgaggctctcgtacctatgccattgttgaatacaagtattcgggacatccagttaaatctgcctcgcgtcatattaacataagaggacatgaacataaagcgaaaacaactaatatatggacgagaaaaatacgctatagtggacttgtgaagtaagtaggtgagtaacacactgatgtaaaattgctagaattacaaatttgtgtatcagcacaagaactaattgtaaactgatgatcttcaaataacaaaggtgaacacatatggcggggaagtagatccctacttaaacacgctcaccactaactaccaataactattaggcggtctcactgggacaacatataaatacagtggacaatacgaacgacaacagacgcactgagttgttcgcgagctatccgcgtgtacaacggcacatgagaatatacaagtaaacacctgaggcccgcccgatcaagaccacttcgccgcgcaacgacaaacacgcggccgaaactccgcccgttgctcactatctcacctacctgccgcggaagacaagcagactatcgggggattttgacaccacgagtacaataccaaattacgagggaaatcccacgagacccgttcggatgtaacacagccaccgactacatcatcacaaaatcgaccgttccgcacctgctacaaccagaaggggggcttaccgttggcatcccgtaacaccgttgatagggcgcacaaagagatccatcgaggaacatactacacaaccaacatgccgcggacaagggcaccatcaaacagtaagctctgcgtagggacaacgtagggaaagtaacaataacgacgagcactacatcgtgggcaagacagaacaacagcgagtgaacgacagcagtgtgcagaaaaagaacatccccttctgcaataaccgataccactaatacgagacagccctccccttagtgtgcacgccagaaagacaacgtaagatggccagaacacaacacagagcaactcgacccactaacaaggtctggtgcgacgccacggaaacgcacccaatataacgcgcacagaatcgacactgcggcaactaccgagtgcgccaacacacacagtgacgccagagcacagcccacccgactggccgaaccgacaccaataaacaacggaacacagtgtaccaccaaagacaataagtcgcacaaaacaaacaaatatgtgaatatgcacaactagttgtgtacctctgtggtttatataggtgaaatatttgacgaaaagaagatattattgtaaatactactaatatctaatagactaatggttttgatgttttgatcacataatgaacgtgcctcacgacaagagtgacagaatcatcagccattgacacactaaccacaccatcaacacgatgaaggaacaaggcagcgcacaatgtagctctaacgactcgagtgctacatcgcacctgacgactaccacactccatcgattcaaccagcatacaccacatgaggcgagagaccagtagcccagccccacgcaccgtgcgacgacacaacaaacaagattcgacggctgagcacagcgcgtagataacaagaaacacagtcgaagacgcagatcagcaccgaccatctatagcttaatcaagacatatgaataagataatacacacataagaaagaaagcgtgacgtgtcatgaccctcacctcaatt

SEQ ID NO: 616750 - DNA, 299 bp, Homo sapiens
tcgaggatccccccccctccccgggtaacagcacgtgacataacctgtagcaataaacgaaagtttaactaagctatagtaacttcagggttgggcaatttcgtgccagccaccgcggtcacacgattaacccaagtcaatagaagccggcgtaaagagtgttttagatcaccccctccccgggtagaggtaaaactctcctgttgtgtcaaaatctactgctgacgcagatttaacttctatggtcactctatcatttctacccacactgtagctagaacccccactgtgcttagact

SEQ ID NO: 616751 - DNA, 908 bp, Homo sapiens
  misc_feature (110)..(110): n is a, c, g, or t
  misc_feature (857)..(857): n is a, c, g, or t
gggggtttgggggcctggagcttcacagtctatcttgctgacatgaaactactttttatgttcaaaatcatttttataggttatgctattaattgctagattggcattangaatgttacacttttagaagtcacttttttaaaaaaaagtatttgggacagtatagtttgttaggtgggtgtccacgagtgactagctgtctttccataggtctggtttggtctgttgtattcacaaggtccttatgcctcatggacagtgtgaattaaagttctattatctagaaaaggactgactggtgtgctgatggaaagtcatctaaactgatttgatagcatgtatgaagtaccttgatgagacttcctactctggaatcttatgtgtatatttaacaaaaaagaacaatgtagtttctttttgccacttcagtctgggtttatgccttgtaaatgagtttgctgtgacacagagaatgtgaaactgctattttgtcaggcagtgttcctaaataagcatttcagttgcactacatatatgtgggttacattccaataaaccttatcatatgttgagaatatcgtaagtcaaaaatgcatttaagaccctggaaaacccattagaaagtcaaaaaaattgtaagtcaaaccatcataagttgggtaccatgtgtattaaggaaaaaaaatcaagaaaatattaatggttgtttataatcttaacatatctgctttaactttgaaattttcaaaatttacagtgagcatgcattttataatcagaagatgttaataggctaatttaaatttgttagatttttaccatttttaagattatgtttaaaaacctgtatgagagancatatttggagacaggaacaaaaatatggcttggaacagaaacagtatgtg

SEQ ID NO: 616752 - DNA, 487 bp, Homo sapiens
gtacaacaggctgcccgccactgttatttaccactggacgacggtcacattacaccatctagtgtcggctggctcaatgcaagcattggtcatctctgctacagaaagctgctcatggtatgctttctcagcctagatagacaggggcatatgtgactcagattggaaggtaggatgccggggtatagcaaccaggtaggtctgggagattctgtcagtgtcaactattcatcgctccctcacatctctaggtagcattgatggaggacacaatctggctaataaggtgcttagggtcaacgtaatgtcgtatgctcgatctcgatgttactatgatagatgtaatacattgcctcattgtctaccctgaacggactatccgagtgctccaggctggagtgggtgacgaggatggagtagtaaggctcaactacaggtgtggtaagcagcggcgccggttaactagagaactccagattgtatttct

SEQ ID NO: 616753 - DNA, 1183 bp, Homo sapiens
acgcacagctacgtgtctccgacgggagcctgcgtgtacaagtgcaggcaacatctgcaaccacgttcttcacccgaggcttccttaaggcggtcaccagggagtttgagcctttgctgaagccacacgtggctgtgaagaaggtcccgtatgtggatgaggaggggaatctggtaaagccgctaaaaccgaacgggactacaagactggacgacacgttatgtgtattgactgtgttccggtttgctaacgaacctttgctgccttggaacgtgctgcgggacggaggaccttttccccactgacacgaaccgcagacgccagaccgacagggacagatccccgcaccgacatcgcacaggccctgcatcaccacagacacataccggatgggacatctgcgggccggggcaccgaatatcctggatgcccaatggaggcctggactcccagagctgcaccagattgcccccaaatggagaccctccggacatctgtgagatatcgcccattggatgtcttacatctggagagggttaagaagtgtacctgcaaaggccagggaagtcccaagtccaccgactcaatccttggatgaagaccaaggccaagggagccgcaaactgcaaggagatacatgaccacgaccaggaacatgcacaccgaggaacaacacaacggagaacaagaaagaccacagagcaatcctggacagacacaccaaagacacaaacaacacacctgaacagagcacaagaaagaaccaggagcaaggacgcgacaaacaagacaaagacacactaaaacacatgaacaaaaaccaacacgacagcacaacaagaggacaggagaacagaacaaaaaaagagaacaagagacagacacacacccccaaaagacaaggaacaaggcacgacagacaaacgcgaaaaaacaagacgaagccaaaagcaggaaacagaggacacgaaccaacgcaagagcagaacaaagagaagaggaacagagacaaagaccggagacaatgaggacaaaacacacaccaaggaaaaaaaaacagggaacagagcaacgaggagccgaaagaacaaacaaagaggaagacagtgagagaaggcccgcagagcagcgagaacaaacagggagcgaagagcagcagaaaacgggacacgcagaagatgaa

SEQ ID NO: 616754 - DNA, 150 bp, Homo sapiens
tttgagagacttagtgatattctgcagtgagatacacgagttggtactcatgtctggggaatggaactgggaatcagagtggatgaactcttcatcatggatccttcatgttgtttgaatttttaaccagtgtgcacatattactttttc

SEQ ID NO: 616755 - DNA, 191 bp, Homo sapiens
gcttacagtctgcgttgttactcggaaccgaacttcgcgctaaacatcgtttaatcaccgatgtttaggtctggtctgaattcctttacccaacgcagattgtacgtcacggttctaggattcagaccggcactatcgggcgcgggttaccacttcgtgtagtgcgagacggtagtcctgccgtgatgcct

SEQ ID NO: 616756 - DNA, 143 bp, Homo sapiens
tactgttctcctgtaccatcattgcctgctagcaaaaaaatgtgtgtgtaacaacccattcttacaagctttacctaagagcgagactataagctctttttatagactctgatatgtataaccgacaagtgtgaggggggtgg

SEQ ID NO: 616757 - DNA, 186 bp, Homo sapiens
gagcctcgtctacaaccatcgagagggacggaaaggcctactcctcctcccgcacgcctccatctcccctgtgcgcgtgtctcccaacaaccgctcagcaagtgccccagcttcacctcgggacatgatcagcctcaaagaaaggaaaacagactacgagtgcaccgggagcaacgccaactacca

SEQ ID NO: 616758 - DNA, 1431 bp, Homo sapiens
ggagctcgggccaatcagagggacggccccagaatggcatggtagatggaacgcagctgagaggtctgacaagatgtaccaggtcccactaccactggatcgaggatgtggacccatgagatacaggaatccagcttcaccactggtgagccctgagtcaacggtcatgctgtccacattgatcgcacttcactcttctgcaatccatctggtccctgctcattccacattcaaaggagacaaacagagaccacacaacatgatgggagatgccccaaatatacctgacccatcgagatgcagcatcaggccatcggacgtgggagagtgcccccagacgcttacgatgctggccgtttacatggcatcgagcactgccacatccgagcggaccatccggaataatcatatgagatgagcccatatcagacatcacatggagaaaacaacatacacattcaagcttgcaacacatcacacacgattgattacactgactattccggacacggcatcatggacaggccatcaaagatatcgagaccataaacaagtacaggtggacagaaaaccactcagctactttagcatacggttggcatacacactatattgattcatacacataccaataccagaagggaccgatacaccccaaatacaaccgaaacacacactgcattacccaacacggtggtacacaatctgccccttccagtcccacatccggcgagacacacatttggagaacatcaacaccatggcacattacctccttggagccggagactgggacccgcacaaggacaagaacaacacagagaaacacgagcccacgagacaggaatacgacaaaagatccaaacacacgacatggagaaaaaccagacgggacgcaacaacaacaaacacgacaacagcgaacgccagccacccaccaaccatacgaggccgagcagagcacggctacacaccataaacagcgcgacacaaaacatcgcacactggctcaacagcgccggaacaacaggacacacaacaaaacagatgagcacaaccaggaaaaatcacaacgaatgaatcagaccaacacacacaacggtgaatccaacagtcacagggcacagaagtgagaacgaacgcacaacacagcagagacgccagcgacaacacacacagcgacacacaggcacgaaacagcagacggaacacacaaacaaaacgcaagagagcaagaagagaagacaagagaccacacacgacaagaacccataagagacagccgagacaaacaaagaagaaaacaggcgaaggaaagagacgaaaagacagaacaagagacaccaacaggagaacaacatcaaacaacaacggaacacgaaaacgacgagacaaaaagcacaaacggcgtcgcaaaaccgaaacacgaca

SEQ ID NO: 616759 - DNA, 295 bp, Homo sapiens
aacaaccctcccccacatagccatagataactattagtcttctttttgtctatatagatttgcctattctggatattttctataaatggaatcatataatatgtggtcccctgtgttctttcaggtagaataatgttttcaaggttcatccatgttgtagcttgtatcagtatttcattttttattactgaataatgctccattgtatggatatacaatttatccattcatcagctaataggcatttggattttccaccttttggatattatgaataatactgctctgaacattc

SEQ ID NO: 616760 - DNA, 792 bp, Homo sapiens
  misc_feature (294)..(294): n is a, c, g, or t
  misc_feature (316)..(316): n is a, c, g, or t
  misc_feature (361)..(362): n is a, c, g, or t
  misc_feature (405)..(405): n is a, c, g, or t
  misc_feature (421)..(421): n is a, c, g, or t
  misc_feature (440)..(440): n is a, c, g, or t
  misc_feature (450)..(450): n is a, c, g, or t
  misc_feature (453)..(453): n is a, c, g, or t
  misc_feature (463)..(463): n is a, c, g, or t
  misc_feature (465)..(465): n is a, c, g, or t
  misc_feature (477)..(477): n is a, c, g, or t
  misc_feature (479)..(479): n is a, c, g, or t
  misc_feature (481)..(482): n is a, c, g, or t
  misc_feature (486)..(486): n is a, c, g, or t
  misc_feature (493)..(493): n is a, c, g, or t
  misc_feature (496)..(497): n is a, c, g, or t
  misc_feature (516)..(516): n is a, c, g, or t
  misc_feature (518)..(518): n is a, c, g, or t
  misc_feature (524)..(524): n is a, c, g, or t
  misc_feature (536)..(536): n is a, c, g, or t
cggcctattaaacttgggatttttctggttgattcaatggcagtatgttctctctgattccaagtatggtatcttgttgtagaaacctagtagtcatattgatttttaagacgactttatgttctatcttaatcatgtgaatttgtacttcttgagctgccttgaatgcaaggtcatttatattttgttaagaggaaataatcaagatcactcatatgcccaactgaatctgaggttttataaatccctcataacgattgctgagagcctgattgtggaaagaagtgagatgcnccttattttcaagaagtcctgngaagcgctctcctagcacgtccatttccaggaggagaagcaagcnnatgagaggttttccattttgtcatccaaggtagctgtgcactngccttgttgctgaagntccaataatgtgaaaaccnaagtagaggnttntttcttcttntnttgctttctatnantnncacntataccnaanngtctgaaagtatgaaatgngntgcttnctgagttatatnaggctacttcatgaccaagaactgctctatggaatacatgcagcattgttgttactacataacttcagatcactcatgtatctacatataaattcagattatacctaaattttccaaatagctatgtgggaatgactgattttcattttagtaacgtaagctggaaacattttgcattgttacaatagttctcaatggaacaatggaaattttcgaaagctgagtatatgataaacactgggtcgtgtatgtattc

SEQ ID NO: 616761 - DNA, 723 bp, Homo sapiens
  misc_feature (701)..(701): n is a, c, g, or t
ggctttcgagtgcatgacattctagcttctgaattgcgtgcacacacacacgcacgcacacactctggtcagagtttattaaggctgtcgagtcatgacattatagcttttgagttggtgtgtgtgacaccaccctcctaagaggtgtgtgcttgtaattttttttttcagtgaagatggattgaaaacctgttgttaatgcttagagatattatgctccaaggaaattccctcgaaccgtgtcaattaaactgggttatatgactcaacactaccagcagatgattattaactctattcttggctctttttaggtccattttgattaagagactcttggctggatcattcagagctctcttctagcctacccttggatgagtgcactcaatgaacttcatattttcaaggacctgggagccttccttgaggctgtgttagaaggtgtggggttgggggagtcctgctacacgccagctctgtcgtagctgtagaggaagggatgaaaccagctgctgttgcgaaggctgcttgtcattgatagaaggactcaccgcctcggatagactaagactaaacatggagttggcaaactttcttcaagcattgagttctgctcactgcactggacacgcgatttaagggtagaagacgagagctggcggtaggggacagacttggaggtggctgttcccactgtntcctccctaattcggtgcactg

SEQ ID NO: 616762 - DNA, 956 bp, Homo sapiens
tttcccaagtgctatagcaataacagttgatactcatttaaggtaccaaaccttatgagttcaactgatcaaaccaaaggcaccacagctgttgctcagagaaacctcggggaacaaggtgaaaaagacaaacacactggtagtcaattgagcagaaaacaattaattctcatatactgtattgacttggcaacccagactttactctaacgtagaactgaacttggcctaggaacaaaagaaacaactgacatgttaagtcacttttcctaagactgtccattttgaggcttagctcagctcttattgcggaaacatgtttaagcgattcatctccattgcctaattcagtaactcattattactgtatgtttacccctatcagtcaagactatctcaccacatctttacgctctcttcatacgtgacctgcacacaggactctcatctattctacaatttactaccatgctgttgctcagatcaatattctgggcctttccaaggcataattattaaccctcttacacctttccaaatatgctttacacatttactagccggctcaacttggtcactacgcgtcatatcctactctgggctggtaaatcatctaaacagacccataattatactctggacacccaagccaacaacctataggggcctttcggcactaaaatttaattaacagggagccaacgccttcggaagattaaaagattaaccgcccaaaccctttcaacttttctctcccccacacccaaatcagaacaccttggttccacgacctaagctcttgggacccttggaccattctacatcctcgcttcgaactagcttaattcggtaaattaccccatggacatcaaaacctaacttgcacccaaacgaacaaattccactatctcatacacgcaccgttctccggcaagttatgaccttaatcatgcaac

SEQ ID NO: 616763 - DNA, 1356 bp, Homo sapiens
ggaggagagagagagttttttttttattttatttgaaggaaatttggtattattccaattattttagatgtacagaaaactcaacgtgtgtccatttaccccagtttaggggcaagtccttatacccttgtgccttttcaagcttggcgatacgagccacagacttaggacccaggacatttgccaccccagtgacgggggatctcatcgtatctgtcatggtacatgggtcctgatagctaccaccagccttagccaaagcgccttgagtctatccgagtttcacctgtgtgaaagcgcgacatggtggttgcacggtctctccgtggtggaccataaagcgtcccaggtcttgtgcctttccctttgaataatgtgcagaaaggtgagacccccccagtttgtacgaacaacagagtgcaggcaaagaagagacaacccaggtgtcgaagtggaggactcccaccgttcgttgttgcaaatccaccacacagtcttgagcttcgccttggtatctacacaccaaagggttgggtccgaccggttgtaaaactccctgtctccagaatggaccactgttggtcactcctacactgtatagagagacctgtcccctcttatggcccaggaaagcactgttctctctcgaggccccggggcccaaacagagtcctacggagataccatctcctcatgaggaattgaggacctccgtgagcacagtagctacactttgagtgggggccaacggtttttaacaccaggtgtgaagtataagcgtgatttgtggggggggctcccagcgcccttttggatgtgaacaccgtgggtgaaaattcggcgagagacgggcaactttttcagacccgagtttttataacaagggaatgggcctcatactgtgtcagggtgcaaaaacccgtggaaaaactatggcgggcgggacccaattttagtcacgacaaagccggggcgaagtaaggactctccatatagagggacgactaggaaattgctcactttgcttcccatgagtcgccgaaacaagttgtcattaagagggcgtttgttctctcacgacgggggggaatttcacgccagttgtgagttagtacgcctcccggtgatgttgatgccgggcacaggtgttgtggccagcggaagcccagctgtgttttcttcccggttggtgcctgtgtgttagccttttgggggcacttgatggggtggcgtaggcgacgtgcgccctgtcgtggttcgtccccgcgtggaccacagtggtgtgtctggcacacacacggttgttgcgtcgtccccgtgtgtgtgcagccgggtgccgcggagcgagaggcgccc

SEQ ID NO: 616764 - DNA, 140 bp, Homo sapiens
attcaacgcgttgtgagctctccatattgttactgcatgtggcggaatcactataattgagctgaggaggagctgactatcgctggttcatggcatcgacgtctcatagtgtgtctccagctcgtgctgcagtatccggc

SEQ ID NO: 616765 - DNA, 126 bp, Homo sapiens
ccctcagcgactcaacctgctttttctctccctgtgtctttgggaagctgccatcatttgctctgtccccaagtctggacaccattttaataataataataataacaacagcaacaacagttaaaa

SEQ ID NO: 616766 - DNA, 457 bp, Homo sapiens
cgatattatctttgatctgtgagaaaccctcttggtcactactagatagatatacaactattgtttctccgacatgtacactcgcacgccaattttctaaaactagtcctccttaacacaaatagtggtggtaacattcaaccataacctaatcagtgtgtccattatgcttccacgactagccagtcttctcacacttcttctggtttcaagtctcaaggcctgacagacagaagggcttggagatttttttccctttacaattcagtcttcagcaacttgagagctttcttcatgttgtcaagcaacagagctgtacctgcaggttcgtaagcatagagacggtttgaatatcttccagtgatatcggctctaactgtcagagatgggtccacaaacataatcctggggacatactggccatcaggagaaaggtgtttgtcagttgtttcataaa

SEQ ID NO: 616767 - DNA, 159 bp, Homo sapiens
attctctagcgtcgcctaagacgtctgttgagaatacagtgttaactgtccttaaggctgagaacgacgagatgttcgccgagggcgtctttgattgtgtagtactgggtggaacggtgatttcccgtagtgcgaggttattcctaagggggtgtatgg

SEQ ID NO: 616768 - DNA, 278 bp, Homo sapiens
tggtactggtacaaaatacaggcacatagaccaattggatcagaattgagagccccaaaattaggctgcacacatacaaccatctgattctttacaaacattacaaacttaactgagaaaacacttccctattaacaaagtattcaggagaattaatcttggccccttcctttaccacatttcaaaaaatcaactcaagattgagttaagagcttaatttaaacccaaactataaaatccctgaagagcaacctgggcggatcccttttgagcatgga

SEQ ID NO: 616769 - DNA, 310 bp, Homo sapiens
aaggggggggggggggaaaaaaaaatgtaaaggggggggttttttcccgggcggccccatttttgttcttcccaggggccccaaataaaagaagggccaacccctcccccccccttatgttttaaaggtttccagtttgaggggaaccaaaaaagtgttttttggggcccaagggggggggttttcccaaaaggtaaaatttattttttttttttctttgggttttggtttttcccccgcccccaaggggggccttggtaacaaatcagaaatttgccaatttatgttttaagggggggtttgcccccca

SEQ ID NO: 616770 - DNA, 110 bp, Homo sapiens
caggatttatatggacctgcgctcgcgatgtgctgctccctctccgacgcttctgctcttcggccagctgcttcaccctgcagctgactcctgcatggtctgccaggctc

SEQ ID NO: 616771 - DNA, 337 bp, Homo sapiens
acatcagggagtcataaggaccattatggctcattacacacagtactttatggaaaggattatctaacactatgcgagagaaccctgctagaacatcatgaaagtctggaaggatcacagcactgaagatgccatcgatacacaaaaagctgtgaaagcgttaaacccttttcaacacacttcccctgtggaggaaactgtgtccagaaggtgcgcctgacttcacaagattttcaattcagcccacccaggggattaccaaggaaatcatgtacaccggaaaaagggtggtgaggtgaaggttttcaaatattcaccctggggaaatttgggagcc

SEQ ID NO: 616772 - DNA, 417 bp, Homo sapiens
  misc_feature (46)..(46): n is a, c, g, or t
ccttcctgagcccctagtaccacccatctacttcggttctagaatntgactactttagaacttgatataagtcgaatcatacactacctgtttttttgtgactggcttacttcacttagtataatgtcttctactttcatccatgccatacagcatgtgacatgacttccttacttttttatgactgaataatattccattatatgtatatatcacattctgtttatccattcatctgttaataggcacttaagttgcttccatcttttggctgttgtgaatagtgctatgaaaatggatgtgtagctctctctttgagagcctgctttccattcttctggatatatacccagaagtgggattgctggatcatttggaattctgttcagttttctcgggaacctccatcctgttttc

SEQ ID NO: 616773 - DNA, 274 bp, Homo sapiens
gatgggtcagatggacgtggaagtcactaggaacgcacccagatattggccaaaagccagtcgtataaagcataccgaagggagcgaaaatagggtactcatactacccggagataaggttgagctaggataggcaatagtggacaatctatgtaggccaggtacttatacagcaagcagatgggagcggacaggaactggagtagtgcaggggtctagtaaaagtacggcatacgaagccatccagcagctcaaaagtccacgatagaaaata

SEQ ID NO: 616774 - DNA, 517 bp, Homo sapiens
atctggcgaggcagtctcagctgagcctagcccagcaagccagtattgcctgaataaacaactgtggggagagaaggagaatgtacaggattgtggtaccggacccgaacaaaggtgtgaagatgtatatggcatggcatgtttctgggaacccactgaagtggccagtgtgtaagtgacttgactttgaagctgggagggcatgctggcaccacataaaactaatgctaaagagtttggactttatgtcataaccagtagagaatcaccaaaggtttctgaaccagactaggacataattaagtaaatggtttagaaatataagtatggcagcaatatggcaaaaggactgggaaatgaggaagcctgaaggcaaggtgagcagttaagaagtttttttttatactggtgttaacaatatcctcggcacaatgatttccttatcatctatgacaagatgatagcttctattaacaaatcaccccaatatggatactcccattgagacagaacccac

SEQ ID NO: 616775 - DNA, 205 bp, Homo sapiens
  misc_feature (6)..(6): n is a, c, g, or t
  misc_feature (40)..(40): n is a, c, g, or t
  misc_feature (104)..(104): n is a, c, g, or t
  misc_feature (125)..(125): n is a, c, g, or t
  misc_feature (136)..(136): n is a, c, g, or t
  misc_feature (200)..(200): n is a, c, g, or t
tgcctntggcccgcactcatagaaacattcacacaccccntgcctcccctcttttccctctccgcctcccccttccccccctcttgttatgaagacccgttggnaggagaggggatgaagatggnggacgcgaagnagaagcggaacgagcagttgaaacgctggatcggttccgagacggacctcgagcctccggtggngaagc

SEQ ID NO: 616776 - DNA, 229 bp, Homo sapiens
tcgagccggtcccacttcacatttagcatgttgttaacaacttttcacagccaaccctgactttcaggaagtgaaatgaaaatggcaggacttatctgaagatccacagtctagaaaaagcaaccactgctcttttgagggctgccatttcagtggcatcactggaaagtttgactgcctgacatattggtaaccagttattgggggttaggtcccaacaggtgtctgg

SEQ ID NO: 616777 - DNA, 294 bp, Homo sapiens
  misc_feature (44)..(44): n is a, c, g, or t
ccccgcccacccgaaaccaggatactctactggcacctctccancgggctgaggaagcacagcagcatcttcaaacatgtacaaaatcgattggctttaaacacccttcacataccctccccccaacttatccccaattatccccacacataaaaaatcaaaacattaaactaacccccttcccgcaaacacaacaaccctcttaaaactaattggctttttagaaacaccccacaaaagctcagaaattggctttaaaaaaaacaaccaccaaaaaaaatcaattggctaaaa

SEQ ID NO: 616778 - DNA, 412 bp, Homo sapiens
  misc_feature (259)..(259): n is a, c, g, or t
ctttttaggccctctggtaatttattaagtatgcacacagccagaattaaccttttcaaaaagtataggtccaggtaatgtcattacccctgcttagaaccttccagtgttaatcagtaaaatccaatgacttggtcaggtgtggtgactcatacctgtaatcccagcactttgggagactgaggcaggatcacttgaggccaggagttcaaaaccagcctggccaacatggcaaagccctgtctctacttaaaatacnaaaatcagctgggcatggtggcaggtgcctgtagtcccagctgctcgggaggctgaggcaggagaatagctggaactcaggaggcggagactgcagtgagccgagatcacaccactgcactccagcctaggtgacagagcaagactccatctt

SEQ ID NO: 616779 - DNA, 362 bp, Homo sapiens
cataactgcatggttcaaacctaatgtttgttgcctactgaccccacggcctcggtcaggttgtctgagctctccgtggtgtttttctcagttgtaaatgggataaccagtgttcttctgaggatttgcagtgcgtggaagccttggcctgacgtgtcctacggtgtgctcttcactgctgctctcaggatgactatgatgatacctttaatgtttcataaatggacatagtgtatagggttcttgtagatatttttataagattagtgaagtttgtatctattcttcagtgtttatgttgtaggtgggtattgcatgctttgtttgtttgttttgacagagtgaatccgtctttaaaaaaa

SEQ ID NO: 616780 - DNA, 329 bp, Homo sapiens
  misc_feature (77)..(77): n is a, c, g, or t
aatggcttcctgcctgtaaatccagccagtttgggaggcccgacgcaggcagatcccctaaaggtgaggagttccanaccagcctggccaaggtgatgaagaggctgagacaggagaatcacttgaacccaggaggcagaggttgcagtgagccaagaatttgccactgcactccagcctgagcaaccagggccaagcttcgtctcaaacaacaacaacaacaacacaacaaccctcttaaaactaattggctttttagaaacaccccacaaaagctcagaaattggctttaaaaaaaacaaccaccaaaaaaaatcaattggctaaaa

SEQ ID NO: 616781 - DNA, 172 bp, Homo sapiens
gcaggaagccaaccagcacaaaaatagagaattaaaccaccaaagccaaggaccctcacggagtccactacacccctttgccacctccaacagaacaggtactggtatccatggctgagagaaccatagacccacatcacaggactctgtgtagacaactcccagtacggcg

SEQ ID NO: 616782 - DNA, 278 bp, Homo sapiens
caagtagtgagacactgagcaggaatccaaaaatgagtcaggtactatgcttcagtgtgacaatatactgcacaggctatcactctgacagctactgatgtaaggacaccctggttaatagccttaaaagcatattctacttggtagagccgaccctcgggtgaaaaaatggtcatgtggcggtcaaaaccggcgctggaaccacgggacatgtaggtagaagcactactttaaacacaatccctgggccccgtagctcccgcaccaggcacccgcga

SEQ ID NO: 616783 - DNA, 275 bp, Homo sapiens
  misc_feature (158)..(158): n is a, c, g, or t
gcacacacagcctcacacaaacatcacagcacgtgggtctcatgggcacatgcaaataacacacacggacttcacagcactcacatgggcttcatgggcacacaaataacacacggatgtcacagtgcacagcctcacacacagaatcaaagcacacntgtgggcctcacacaaacatcatggcacacacaaacatcacacaccgatgtctcagtacacatactggcctgcacggatgtcataaatgccacagcacacatgtgggcctcacaaac

SEQ ID NO: 616784 - DNA, 489 bp, Homo sapiens
aggctacaagacgtataggaaataattaatatggccatagtaagttcttccctgtcagtaattattttaaatgcaaatagattaaagtccccaattaaaagacagagattagctgaatggactaaaaaccaggatccaactatatgccatctacaagagtcccactttatatcttttcaaataccaaactcttgtggccaggtgcagtggctcacgcctgtaattccagcactttgggagaccaatgtagaaggattgcttgaagtcaggagttcaggaccagcctagacaacatagaaagactcttgtctctaaaaaagttttttacttagtaggcatagtaacacacacctgttgtcccagctactgtggaggttgaggtgggaggatcgccgtgagcccacgatgttctaggctcgcagtaggcatatcataggtgccacgtgcactccacgttggtgtgacatcagcaagacacactgtctctta

SEQ ID NO: 616785 - DNA, 165 bp, Homo sapiens
tcacgctttatacttcagtaaagaagaaatagctttggaggatttgagatgcaagaaaaaaatgacaagaaatgtgtttacatatggtaatctaagtggtctgtatgttaaataagaaattagaagaaaaatgtcatttgtgggtctgtaaaaaaaagagaaaat

SEQ ID NO: 616786 - DNA, 271 bp, Homo sapiens
  misc_feature (128)..(128): n is a, c, g, or t
  misc_feature (131)..(131): n is a, c, g, or t
  misc_feature (149)..(149): n is a, c, g, or t
  misc_feature (152)..(152): n is a, c, g, or t
  misc_feature (163)..(163): n is a, c, g, or t
  misc_feature (174)..(174): n is a, c, g, or t
  misc_feature (187)..(187): n is a, c, g, or t
  misc_feature (206)..(206): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (241)..(241): n is a, c, g, or t
  misc_feature (246)..(246): n is a, c, g, or t
  misc_feature (248)..(248): n is a, c, g, or t
  misc_feature (251)..(251): n is a, c, g, or t
  misc_feature (270)..(270): n is a, c, g, or t
gggaaagcctttgtcagtattaatcccttaattgacctaagtatactcacactaggaaaaatcctgtgtacatgtagcaaatgtgggaaagactataggcaatagcgaaatctcctcgcgaaaaactnccntaccagggagaaaaaagnttngtatgaaatgntgggaaaactnttagaaaattganagggaattttttccagttnccaaagtngncatncccttaattctaataggaganataananctnggagacaaaatctcatttna

SEQ ID NO: 616787 - DNA, 120 bp, Homo sapiens
  misc_feature (2)..(2): n is a, c, g, or t
tnagaggatcctaaagaccaggctgagcttaggagtaggaagagttcttaggctaccttcatctactccacaagtgaaaagcccttagcgtacagaaaattccaggttgaaggtctcttt

SEQ ID NO: 616788 - DNA, 1071 bp, Homo sapiens
  misc_feature (225)..(225): n is a, c, g, or t
  misc_feature (247)..(248): n is a, c, g, or t
  misc_feature (258)..(258): n is a, c, g, or t
  misc_feature (262)..(262): n is a, c, g, or t
  misc_feature (272)..(272): n is a, c, g, or t
  misc_feature (312)..(312): n is a, c, g, or t
  misc_feature (368)..(370): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (420)..(420): n is a, c, g, or t
  misc_feature (427)..(427): n is a, c, g, or t
  misc_feature (441)..(441): n is a, c, g, or t
  misc_feature (466)..(466): n is a, c, g, or t
  misc_feature (484)..(484): n is a, c, g, or t
  misc_feature (488)..(488): n is a, c, g, or t
  misc_feature (514)..(514): n is a, c, g, or t
  misc_feature (526)..(526): n is a, c, g, or t
ctctgcacaggccagttagccagctcaagttcttttgcggagaaagggacttggccatgtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggattttctttttttttttttgaaacgganaactcactctgttgcccagaannggagtgcagnggcncgatctgggnttactacaacctccgcctccggggttcaagcgatcctccngcctcagccccccaccagctgggactacaggcacatgccaccatgcccggctaatnnntggantnanagtagagaccaggcttcgccatgtgggccaggctggtctcnaaccccntgagctcaggtgantccacctgcctcggcctcccaaagngggaaaggggctcatttncaanggggcaacagggataccatcccgtgnactccggggccnggctcttccaatgcccaaggcatggcatggtgggcatgttggtgcccccgcccatggtctttgggagcacagatgactctgggggcagaggtggggctctgtttaggagggcagtgagaccacccagccaaatggtttctcaaccttagaaaaagccttgggccaagagggaggtgctgttagtggggcagcccttctggggttcagagaccggggtggctcaagacgggtctcatctccatggcctaaatgccaggtggccaggagtacccatgcacagagcttgtgcggtgtgggcatctccggggtggtgtcttggtaaaatccgttagaaatactgtatgaggaccccgtggcggacctgacgttcacggggggcgtgtgatttcacccggcccctgcgtagggctgccaaggaaggccatgggggtggaagccccgtccaccaatgttaaacccgctctgtcccaagagggttccggctgcccaataaagacccgaaaaagagaagggcccaacatctcgggggcaacaggaccacgttc

SEQ ID NO: 616789 - DNA, 486 bp, Homo sapiens
aaggatgaagacgggtgccttctgggatagcatgggtcacaggccacctattcaaataccaaagagaatgggatcaatggagagctgacctcagctgacagagaaacagtagaggaggtgtctgctaggatagttcaagtactcactgctgaggctgtaacagtcctgaacggtgaacaagagacagaagctcaacatagagagcggactgtagctctgcctttagtgagctgacgaaagagctaatctgcctccttctccagccccatcagctgcctcagaaaagactgtcacagtgtaggaagatttagttacaggtctcggaagatggagttccacgatcagtaggaatggactccctctatagctgagccttcagatcacaaggacctggagtcagagaagcaaagtcagcctggtgaagaccttaaacatgctgccttagtttgtcagccagagacaactaaaacttagcctgtgggaaag

SEQ ID NO: 616790 - DNA, 190 bp, Homo sapiens
gagcgtaatggctgcgctgactttagtttcagcttagttgaaaaaaacaaaaacaaagttaaaaaaaaaaggaaaaacaaaaaacagtcacaggaacattccccgggcacaatgactttcagtgagctctcaacaagagggatgtggacacgagctggaaggagttacctcgacattacaggtgctattt

SEQ ID NO: 616791 - DNA, 120 bp, Homo sapiens
attcgcagataatttttagcttaggggcctggtggctatggtcgggttctctcctttccagtctggagacctcttgccgcaaacatgctccgccagatcatcgggtcaggccaagaagca

SEQ ID NO: 616792 - DNA, 122 bp, Homo sapiens
gatcgaaggcgagatggcggacgtgctagatcttcacgaggctggggcgagatttcgccatagatgaggatagggacgagagattcacaactgaaagaaaagcgagaacggagggtcgcgct

SEQ ID NO: 616793 - DNA, 784 bp, Homo sapiens
ggctcctccttgagtcgacggctcttggctgtgcgtgacggtccagaaggcaaatagatagccagggttatcaacgctgttagccaggatggtctcagtctccagacccagtgatccgcaccgtgctcggactcccaaacatgttgtggatttacgaaagtgtgacgcacaccgtgactcgttggactcggagggctcctgtcctgttctactgcaggatgcgcggaagggtcacctctcgtgacgagcacacgtaggtatgtagcctgttggtgtgagcaattgatcatatgtagcatagtattaacgcgagtgcacggagtcagtgcgcgttcttatcgaatcaactgaatgggtcaacatcatgggccgtgccccgactactctggtccacgtcgtgcatagcctagcctgatgtgaagggccaaggtccaataaagaatttgtggggccccgggctcacgggacactaacccccgtggtacttgagctgcgtggtagttgacgaggcgtagacgacgcacctgcaacagatgtctgatgcgaggggcaaaatgggtcttggttgaattccccgccaatggggccaatagaaaggcgcacgggggaaacgattgcccactggggaagacgccccccccttgggccatgcaccagaaaccacgcaagggagaaaagggcccggcgatcggccctcgagatggaacttccggggggtctatcgggggcccccccggagttgtgtcacccctttgtttcccctttcccgttgggggactccttc

SEQ ID NO: 616794 - DNA, 194 bp, Homo sapiens
acctctgttggcggcacgtcagggtgtgagtgggggtgaggtggcataaataggatggccccaggcctatatcactcctggactctgtgtctcccggccaggtgtgtgggccctggaaggaaatgggcccagagtgaagaattgagcatactggattacacgcgcagtgaaaagcttctagtacacagaacctc

SEQ ID NO: 616795 - DNA, 839 bp, Homo sapiens
caaatcatgctgctgttattttctacatttgtattttatccatagcacttattcacatttaggaaaagacataaaaactgaagaacattgatgagaaatctctgtgcaataatgtaaaataaacaaaaaatagattaacacgtctggtttcaagggtcgaccggagaccatttttattccaccaacaaggggttttggggttttatattttttgcccagtgtttcagaacagtgggtgatactagtgaatattaagtgttgaccagcgtgccttcttatgtggggcttttggcagtattcgtagtataacgttccggcaagtgtgagcaaggctgatgatgtggctgtgatttccgacgtctgggtgtgtggacgagtactggcattgagcagagttcttctattataaaattaccatatctggccattcacagcaggtcctgtgaaatacgttttatactggagttgtctttaaaactgacggtggtctctaagacagtgtgctgaataatgtattggtgcgggtgacctcttcgactagtgagtgtatctcttactgtttggttaacgcaaatgccgatgtgtacctgaagaagctgattcggggatgcagtggtctaggtcgtgagatgcaatccctatagagggggggggggacccctgaacaccatttgggtcaataatactggaacctttattatactttccaaggggatacaacacccagggatgcccaaaaagttttaaactccgggaaccacgtcccgtatctgaagaccggaatgcaccctcaatacttgggaaaacatggtttttgaaaggccaatacctatgaacca

SEQ ID NO: 616796 - DNA, 298 bp, Homo sapiens
tctacttcttagaaagtgatttatacaatgatttagaccctttattaggctgggagtggtggctcacgccggtaatcccagcactttgggaggccgaggcaggtggatcacctgaggtcaggagttcaggaccagcctggccaacatggtgaaaccctgtctctactgaaaatacaaaaagtagccagttgtggtggtacatgcctgtagtcccagctactcaagaggctgaggcaggagaattacttgaacccgggaggtgggggttgcagtgagccaatattgcaccactgcactc

SEQ ID NO: 616797 - DNA, 823 bp, Homo sapiens
  misc_feature (120)..(120): n is a, c, g, or t
gctgatttgacaacaatttgtagcctacttcagtatgaatcaaagtattgttttaaaaggagagattccttctgacattaaattgcgttggggcgagaaccagcaacatcaaccatccanactttaattatggaatcacaggtgcaactgcgtatctcctcagtagaggacaggaagatttgcgtgactgggactttatggatttggcatctcctgcaagatgtgtgtccaactcctgggagggctgtggcatgattatagaattggtttctattgactggtttctgtgtggtgctctttcataagttaagtatcttggatttcaaatctatagggggacacttttggttataatttcttatttaaaaaaatgggtaaatatttctatattaagtattttttcaaactatttgggcttggtatggggcagatggtctctttggattgggtatttgtggaggggctaaaaaggatcactaagacattgtggagtataacagagggagggggaagccattgtactgactactttgttatcagttaacagataccgagcttttatatttagtgatcagaagagggcggtaaggcgtctggcccttacacagacccgccccgcacgcgctctcggtagacgcactggtgttcgatccggtttgcgcgccgaacgagggcgcgcgggccgacccgcggcaggcagggtgtagtgcgcgagtggcggggaggggcgccggcgctgggtggccgctcgcggggcggacgggtcggagcgcggggcaggggccggcggctgcgcgcggcggggtccaggggccccggaggg

SEQ ID NO: 616798 - DNA, 1057 bp, Homo sapiens
  misc_feature (828)..(828): n is a, c, g, or t
agcggtggtgagaacaggatctttccatgctgaacaaagtcagacacagcagcacagtacccagtcggctagaattggagtcaaagtcccaaaggacatgccgcttgtgtgaatgtgctgtgtcacatgtgctgctaggggacgccctttgtgtacactggctgctgacatgggcttggtgtcgctttggggtggaagtggcctggtggtgtgctgggacatttgagagtccctctacctgtccagcaggatacacgtcgtctcttggatggacctattattgtccaaatatagctgatccagagtactatgtgctatcttcagtcaatggtgatgccacttgtcgcttttccgagtatgtcgatctcatgggagatcgtgcctctgttcttcttccttttatggtgcgtcctcctggctggactgtacggctttgtacacctacacgcgcggtccagttcatggcatgatcttgtgtgcgaccttcgagaccgccagtctgtgggcccggggctgagccgcaactggttctctgggggttcagacgggcgagggcgttccaagatggctctacatccccgctctgttctgttggcagcgtgcctgtgtcctcgtttgggacaatatgggtttggtgctttcccggacaaggtttgtgttgcttttcgtatgccctgaccgtgttgtggcctccgtggttgtcgccgtgatctgctgtgtctgtgtccgtttccttgaatagcgctggacatctgcagtttatttgccttgccccagttgaaagctctgcagtatggccaggttcttgtgatgatccagatgtgtggngggccgcatggaatgtttgcctggcacagttgaggctccagctttttgtcactgtaaatgttgttcaaatatgtccacggtgattgggcatttacagggtgccataggggtccgcccatagaaggagaaaatagcgtaaaatgaggggacatataccgaatctttataaagaacaacaagggacaccagaagaactatatgaaacgaaagtagccattttatcagagaa

SEQ ID NO: 616799 - DNA, 199 bp, Homo sapiens
ggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccggccccagagcccggccagcaggagca

SEQ ID NO: 616800 - DNA, 238 bp, Homo sapiens
tacaaaaaatttttaaaactagttgggggtagtggcgcacccctatagtcccggcgaattgcgggggctgagaagggaggatcacaaaaatttagctgggtgggtggtgtgtgcctgtaatcccagctacttgggagtttgagccaggagaatcgcttgaacccatgaaacggaggttgcggtgagctgagatcgcgccattgcactccagcctgggtgacagagcgaaactcgtcca

SEQ ID NO: 616801 - DNA, 946 bp, Homo sapiens
  misc_feature (310)..(310): n is a, c, g, or t
  misc_feature (328)..(328): n is a, c, g, or t
aatttcttggcccatgtggccccccaaatatgggcccgtggaccctggctcttctctcgtggttattctggcccaccccgcccttttcccctccgggttccccccgattcgagggtccccacgcgccacctttagatgaaaagttccttgggttgtgcagaaagaaactgtgtctcctcctcttggctgttaacctggcgagaatgtccccaaaatttttgtgacattcttggtgaggcccgccccatctgtgtgaacagggtctccgcggcgaaccccacccatcgtctgttggggaaccattttcctnacgcctcctacgccaccnctgtgggtgcgccactctccccgggtcgcaggataactaccgaccccaccacaccagttcccgcgcggtggggggttctactcgcaacacaccacaaggggcacgcacaacaaaggacgctcgctcatgagctctgcacgaaatgcttcccccaacgtacttccgccccagcaagagctctcacaggagacgcgagctgattcaaacgatatgtctacccctctaacacacgccgctcccaccgcccctctgctgagacaccactcgggtgcgaggaagacaccgcgccctcgcaacagacgcttatctgtgtctccaacactggcgccaccttcgagctctatgattagctatgacagaatgttgtgtctcagatgatgacccaatagcgcattgttatgacacccctctcccaagcgcaagagtaaagatctatttgtatgtggcccacccatgatcgttttgatctgctgtgggcgcaccattctttacaattgattggtttctattaaacacccgtcatctttgtttacgggacacccacgtcggcaccccacaatgtcgacgaccacgaattttgggacccccttacacaaaattaaaaagggaaacaaaaca

SEQ ID NO: 616802 - DNA, 210 bp, Homo sapiens
gcctacagcctcctgccctctacatcacattgctcatccccaccttgagctctgctatgaacaaatggagctttcttttttttttagagacagggtctcactctgttgcccaggtggagtacagtggtttgattgtagctcactgcagcctcgaactcctggcctcaatcgatcctgttgcctcagcctttaaagccgctagttgtacaa

SEQ ID NO: 616803 - DNA, 1199 bp, Homo sapiens
  misc_feature (1199)..(1199): n is a, c, g, or t
ctggatgcatctacgtcctgccgagcccctgtggtgcgaagagtgccgcgtcctgccttcatgtttgtgtgcctggtgcttctgcccccttgacccttctgcccccaaagaccatgctctatctgtgatgctgcctctgtgcctgcctctgccccatgcctctgtacagcgcctgccatgcctctgcccatgcctgtgtgtcctgtgatgacctctctgtggtcctgttgtcccattttgttgtgtgcacaatgctcatgctgtgtgtcgcatgtgctttgtgctcatgatgttgtcacctacttctgtgctgtcctgatccccatgtgccccctgactgcttcctgtgtgctgctgctcctgtgcaacctccagtgtgctctctgctgtggtccctgcttgtttcactgagcctgtgctgagagtgtggtggctctagctgtgccccttgatccgcactgtggaatgctgctgctctgggacgtgcgtgtgtgagacccctgtgctctgtgaccctgtgagcactgtgcctgcctgcctatgtctggggctgcgtgtgcttgtgctggcctgtgctggcccttcgcgacctttgcgtgcttcctgcctgccaccgtgctccttgtgcctgttcgtatctgcctgctgcgctgacgtgcctgccttggtgctgcccgggtgcccagactgcccgacgtgcaccacgcttgctggacgggcttgctatgcttgacgctgcgggacccctgaagcatgtgcctgggtgctgctttcctgtgcctgggcacgtctggctggggctgctgcggacccttgggtgccgcgttctacatctctcgcgcgcgtggtgccccccttggcactgtcacgctctctcctttacaagccaatccgctggactgggcccccccgcactcgccaatgcgaatcgcatgccttaccatggtcctttccaacccaaggtcgcagcatgcgcgcttggggagacagcacccctcacaacgcctttggccaactattaccattcgaaaaaccctttccaaatgcgcaacgcgcttcaacatactgtgactgttcggcaatgcatcccttagctcccacgacgtgtttgccaaccctctgttggagacacgtgacccgcaacttgtcctcgagcagctgacgcccaaactctccacatcatcatagcccctagggcn

SEQ ID NO: 616804 - DNA, 1672 bp, Homo sapiens
  misc_feature (1025)..(1025): n is a, c, g, or t
cacctattaatagacgagcttatggacacttgacatgatcagcgcccttcataatcatgtgcacttatgtgctgtcctcaggtcctgatagtgcccgttagtgccctatctaactctgcaacgaaatacttaactgagatacgtaacactcgtcagacggctcgaagcaatatgagcaatactcgtctggaacctaattccctggcgccggcatcagtcgctaggtcgctcgatcgctcgcttccgcgatcgcctacgtcattctcattctagcattaacgaggatcgagggtctaagcggagttcacctacccttgacgcaatcaagattcaactctggccacccaagtgggtacgttgacacgccttgcgtagggtgaccacgcggagggtgacgtgaccggacacatcatatcctgtgcgaagcgtaccgtaaccaatcactgtcacgcgccacatgtgatttcccgtcagcgacaccggaggactggagccgtgccgacacatcccatctgtgagcggtctgggagcaagtcgccacagataggctacactcgcacgatgtctgacacggaccaccacatttctgcggtgaatacaggtaacatgtagcaggtacaccagaaggacccgaatgcgtttgggcaggcgttcagatgcaagagcttgtttccgcccaggcacgtttaaggggccctgtacacaaacatcacagaattgacacaattttgccgcgccgggaaccctgtgcttagaggaggcccaagaacattcgaggctcttttaccattcgcggtcttgtagcaacttggagtcggcggggggggggcggttgattcaaccttcaatcgggtggttgccccactttgacgttctttggtaacacccaattcctcaggtcgtgaacggactaaggagacccaaatcacaggtgggtttcagtaggccccacaaattgcggttggccttaggcagatttgtacactgatcgcccaccttaaaaatgagattgtcctttgttgganacaagttacgggggggcctcggggtgaaatttttgaacccccattaagttaggccaaccccgccgtggctaaaccgcccctttcataacgggaagtccgacatgggaccttggggaacactacatgtgggtgggagggggcgcgcgacatgcaaccaataagagaggtgatccccccacggaccgacgtggggtgccccgcagattgttagacacgcacgtacacgaccaagccatggacctgctgtgggtccccacgagaggggggggcccgcacaagataaggcgggagcaattcgcgaacacatagcaaagggagaacagcccaactggagcccccctccgaattgtgtcaaaaccgcgggctgcggaaaggtgcggcaaacaaaagctggttaacaggggggaccacccttgtgcggaaagaggaacccaataatgcccgggggcgggggggcacacaccaatgggcgcacacacaaccacgcgacgacagatgatctgagcgacgccacagccggtcacaacacaacaaccagacgggcgtcaagaagcaggacaggaaccgcacacccgaaaggtcacgagagacgagaaactgaccaacgcgtgatcacaatgacaactacccgagacagagagagatgg

SEQ ID NO: 616805 - DNA, 116 bp, Homo sapiens
atactcactgtctcggcctcccaaagtgctgagattataagcgtgagccaccagcacccggcctgatttatttttaaggttagctttcctgaaaatgccttcttctctaactcctg

SEQ ID NO: 616806 - DNA, 660 bp, Homo sapiens
  misc_feature (483)..(484): n is a, c, g, or t
gctgacatggagcaggagaggacgggtttcacatgtgttgggcagagatggtctcgatctcctgatccttgtgattcgcacccagcctcccgacctcccagagtgctgggattacagccctgcgtgctgaggccgcggccctcgcgccggccgctgatggtgggtggccgcagccagggatgatgcaagacgtgacccagggaagactgagcccggagagctatggagccgacagcctggctctggccgttggtgctctcgctggggctcctcactgtgcccacagaccagagcctcatcctcgagacctcttttccgccgctctgagaagcggaagggccatactctagatgtccgccgtcgaccgttcgtgtcgtcttcgttcagccttccgacgctgaactccttcgaatctcgccctgcctcctgggtatccatgcgcacatcggtgcattatatcccgaaacaacgagagctatcacnngtaaggagacattgccgagccaggcagactcagtcccaggtagcaatctttcaagaacttcccttcgtatcagacatcctttgtcgctggtccttcgttccggcgttcctctggacggtgctccctaggactagtgcccgtgcgtgcgggctcgcgggcagctgggtggcgtgcat

SEQ ID NO: 616807 - DNA, 440 bp, Homo sapiens
  misc_feature (35)..(36): n is a, c, g, or t
  misc_feature (38)..(38): n is a, c, g, or t
  misc_feature (52)..(52): n is a, c, g, or t
  misc_feature (55)..(55): n is a, c, g, or t
  misc_feature (59)..(59): n is a, c, g, or t
  misc_feature (64)..(64): n is a, c, g, or t
  misc_feature (67)..(67): n is a, c, g, or t
  misc_feature (71)..(71): n is a, c, g, or t
  misc_feature (73)..(74): n is a, c, g, or t
  misc_feature (76)..(77): n is a, c, g, or t
  misc_feature (80)..(80): n is a, c, g, or t
  misc_feature (83)..(83): n is a, c, g, or t
  misc_feature (93)..(93): n is a, c, g, or t
  misc_feature (96)..(96): n is a, c, g, or t
  misc_feature (106)..(106): n is a, c, g, or t
  misc_feature (108)..(108): n is a, c, g, or t
  misc_feature (116)..(116): n is a, c, g, or t
  misc_feature (120)..(120): n is a, c, g, or t
  misc_feature (122)..(122): n is a, c, g, or t
  misc_feature (139)..(139): n is a, c, g, or t
  misc_feature (148)..(149): n is a, c, g, or t
  misc_feature (153)..(153): n is a, c, g, or t
  misc_feature (192)..(192): n is a, c, g, or t
  misc_feature (202)..(202): n is a, c, g, or t
  misc_feature (216)..(216): n is a, c, g, or t
  misc_feature (252)..(252): n is a, c, g, or t
  misc_feature (254)..(254): n is a, c, g, or t
  misc_feature (258)..(258): n is a, c, g, or t
  misc_feature (260)..(260): n is a, c, g, or t
  misc_feature (263)..(264): n is a, c, g, or t
  misc_feature (266)..(266): n is a, c, g, or t
  misc_feature (293)..(293): n is a, c, g, or t
  misc_feature (351)..(351): n is a, c, g, or t
  misc_feature (374)..(374): n is a, c, g, or t
  misc_feature (420)..(420): n is a, c, g, or t
ccggaagtggcgccctgggctcgcggcggtgcccnngngatggcgggagccnganctgnagccnganctcncnncnnacngcngcgggggtcnacnctccacctcncnatccaccncccncncaccgcgcacatcctcnccaccctcnncctnccgctcagccctcggcccgcaggatggatggcgggtcanggggcctggngtctggggacaacnccccgaccactgaggctcttttcgtggcactgggcncnggcntnacnncnctcacccatcccctgctctacgtgaanctgctcatccaggtgggtcatgagccgatgccccccacccttgggaccaatgtgctgnggaggaaggtcctctatctgccnagcttcttcacctaccccaagtacatcctccaactcgcatcctaanatagggctgttcccaggcct

SEQ ID NO: 616808 - DNA, 329 bp, Homo sapiens
ggcctactgtacctggatggtgactcttagctacataatacaactcgggcgcataaagtgtggtcttctcttcctactactggttgtgtctgtatctgagtgtgaccactcggccgaagccacgaggattcgtgacgggaatggacgcctggttgcgggtttgctcctttttcttgctttgcgtgctcagtttttacagactgtaaaggagatgtgttgtttgtgaagatggagcggagtcaaatctgtgcttctaactgagatgagagtgtattaatcacgtatcgcagggctccagctgttttagaagccacatcatgttaaacatc

SEQ ID NO: 616809 - DNA, 899 bp, Homo sapiens
  misc_feature (1)..(1): n is a, c, g, or t
ntgttagatcgtctgccgctagcccttgctgctgtctctgtctggtcgccgcgcatgttctccccctcaattggggttctcatctgcgcgcgacacagcctggttgtcgcaaaagacgcgcttctttgcgccccctacgcgtccccatgggcccaacaaacaccccctgggcgtcgcgtagtccccggtgtcttcccaggactttgccacaagggtcccgtatacaatgcccccctcttgtctatattcatctgggggccccgctcccgcggcgcgtgaatcaaccacgcctctcttggattcttgcccccgcccgtttcccctctctaatttcaccttcggggtctcccatgggtcggcaccgaccacccccgccccttcgtcaaggggtccagatattgccggcaagccctggccctccctcgggcggctacccccgcctggtggttgtcgtcccccctgttgcacagctccttcgcaacgcaagatctgatcttctgaagctccaccctcggggcttttctatgttgaccctaaatttttcttccagcggcgtggggcagaaattcccccacgacccaatattctcccagccgctatatcgttccccagtagccccttgccacatcacctgtccgccggacattctaacacgcccgtggtgcacgccctttccctgcgcccagcacctgggtggacgcgtcgtccagacaacatgcagggccgaaagaaccctggtgcctttgaacagggggccccacgcggccccccccccaacgtggggggttctcgtccggcagttaccatgaggcccccagtataatgtttctccccattccccccgtctgcgcttaaccaatacttcccccccgtccacctaaacccttttccacatccca

SEQ ID NO: 616810 - DNA, 892 bp, Homo sapiens
  misc_feature (807)..(807): n is a, c, g, or t
  misc_feature (820)..(820): n is a, c, g, or t
  misc_feature (823)..(823): n is a, c, g, or t
  misc_feature (836)..(836): n is a, c, g, or t
  misc_feature (890)..(890): n is a, c, g, or t
tttgcgttgtaagagaggggcagagaacgcgagaagaaagcaggcagaggggttctcccgcgtcattgttcaaatatacgagagcatcgggctggttttccctcgcggtctttcacgtttcagagtgacagggagagtcttccgcaaacctgccgtggcctgcaatttcagacgttaaccgaggtcactttcttcgggaaacacacccctgtaagccttttagaaaaggcctagttgccttctcagagtattcgcctgggtgtggccgcccatcttgggaccaccttatccaccagcccccctgccagaaatgatgttttatgaaaacccatgaggctgctgcccactcccagccagggaaataatgcagtttccctgtcttatttaagaaaaagagaaggctctcttttctccccttgtcattgccgttcttttccttacacgccaagaattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccnctggaaagaaccnccntctgctctaaccntgtagacttattgcggcctggtttctctgttaccataaaattactgtagacccnaa

SEQ ID NO: 616811 - DNA, 2430 bp, Homo sapiens
gtcgccatccagggcatcgctaacaaggacgccacccagggcatcgctaatgaggaggccgtccacagcgtcactaacgcggacgccgtccagggcatcgccaacgaggatgccatccagggcatcgctaaagatgacaccgttcagggcatcgctaacaaagatggagtctacggcattgctgaggacgctgcccagggcatcgctaatgaggacgccgaccagggcatcgctaatgaggacaccacccagggcatcgccaacgaggaagccgcccagggcatcgccgaggacgccatccagggcatcgccaacgaggaggttgcccagggcatcgccaatggggtcgccgcacagggcatcgccaatgaggacgccacccagggcatcgccaactgggacgccgtccacggcttcgccaacggggacgccgtcctcagcttcgccaacggggacgccgcccagggcatcgccaacggggacgccaccaagggcatgggcaacgaggtcaccatccacggcatcgctaacgaggacgccgtccagggcatcgctaacgaggtggccgcccagggcatcgccaacgaggacgccgcccagggaatcgccgaggatgtcgcacagggcatcgccaacgaggacgccgcccagggcatcgccaacaaggaggccgcccagggcatcgccaacgaggacgccgcccagggaatcgctgaggacgtcgcacagggcatcgccaacgaggatgccgcccagggcatcgccaacgaggaggccgcccagggcatcgccaacagggtcgccgcccagggcatcgccaatgacgccacccagggcatcgccgaggacaccgcccagggcttcgccaacgacgacgccgtccagggcatcgctaacgaggacgccgtcctgggcatcgccaacgacgacgccgtccagggcatcgctaatgaagatggagtccacggtatcgataacgaggacaccgcccagggcatcgccaactgggactccgtccagggcctcgccgacggggacgccgtccagggcctcgctgactgggtcgccgtccagggcctcgctgacggggacgccgtcaagggcatcgctgatcgggacgccgtcaagggcatcgctgatcgggacgccgtcaagggcatcgctgacggggacgccgcccagggcatccctgacggggacgtcgtccacggcatcgctgacgaggacaccatccagggcatcgctgacgaggacgcagtccagctcatcgctgacgaggaccccgtccatggcatcactaacgaggacgccgcccagggcatcactaactaggacgccgcccagggcatcgctaactaggacgccgcccagggcatcgctaacgaggacgccgcccagggcatcgctaacgaggacaccgtccatggtatccctaaagaggtcaccgtccagggcgtcactaacgaggacgccgtccagggcgtcgctaacgatgacgccgtccagggcgtcgctaacgaggacgccgtccacggcgtcgctaactgggacgccgcccacggcgtcgctaacgaggacgccgcccacggcatcgctaacgaggtcgccgcccacggcttcgctaacgaggacgccctccacggcatcgctaacgaggatgccgtccacggcatcgctaacgagaaaatcaaatgttaaccagcagtgccctgcttcaacaccatcatcggaagtcataagttgaactcttttttgatgtttaaagcctgcataatattcgctgtgttattattcagcctattactatttccttcatgatggaaatttggtttatcccaattttctattctatcaaaacaccgctacataaaaaatccccatgcacatatttctcctaattgtggaaatattttacctaaaagactctagacatgggatgaaattcccaggttactggaattttaaaatagataggtacttccaaattgacctcttacaaattatatgaatttgtaagcttccaactgttatggagttaccccttttgagaaatctgtgctaaaaggacccaaacaatgctgatgacaatgatcaggataataagtacgctgggaagagaacaaaatgatttagatcttagacaagtcattctaggtgtctccactgtttcagttctcgcgttcgttcattcttgtgctttttcgttttaccaaataaaatagccccttgatgtcatatgaatccacgctatgcttaatgagtattggttagtaaaatgcctataactagtaatcttcatctatgcaattaaatattaattcataaaacacttcaaatgtaaacaataattagtaaatgaaaagtacataatacctcgattagaaaaaaatcactccattaaaagacattatttgtgtgataaaaaaaaaa

SEQ ID NO: 616812 - DNA, 549 bp, Homo sapiens
gtacagtaaagcatcgtgaagcggtgtagaggctcaactagcagttgtatgctggataaattgaccgttgtgtctccacctcgtgccatcgacctgaaccgacaatgttgagagagtgtctccccctcatcatattcctgaggaacagacttaagtatgccctgacaggagatgaagtaaagaagatttgcatgcagctgattcattacaatcgatggcgcaggtccgaactgatataacctaccctgctggattcattggatgtcattcagcatagacaagacgggagagaatatccgtactagatctatgacaccaagggtcgctacgatgtacatcgtataacacctgaggaggcaagtacaagttggcaaagtgagaaagatcttatgtgggcacaaaatggactccctcatctgatgactcatgatgcccgcaaccaatccgctaccccgatccactcatcaaggtgaatgataccattcagattgataaagagactggcaagattactgatatcatcaagttcgacactagtaacctgtgtat

SEQ ID NO: 616813 - DNA, 387 bp, Homo sapiens
gctaacatcacaccaagtgaggaggagctgaaagtctttcctctaagaactagaatgggaaaaagatgcccacgttcaccactcctatccaataaaatgctggaagtcctatccagggcaataaagcaagagaaaaacataaaaggtaccaaattggaaaagaggaagtaaaattattcctctttgcagatgacatgctcttacatctgcaaaaacttggaagattcataaaaaaattcttagatctgataaataaattcagcaaatttgtaggacacaaagtcaacatacaaaaattagtagtgtttctacacatcaatgatgaactagctgagaaagaaatcaagaaagcaatcccatttacaatagctacaaaaaataaaatac

SEQ ID NO: 616814 - DNA, 93 bp, Homo sapiens
ggatttgctggtgcagtacaactaggcttaataggggttagaagcttgaattcgagcctcgaattcagcttctaacgttagaagcttgaattc

SEQ ID NO: 616815 - DNA, 285 bp, Homo sapiens
cttggttctcgcttatgactcctacagcccttattacagtctttgttaaatgttaggagagctttaggccactgattctctctgactttctcctgcccttctttcacccgcttctttttctccccaaggcaggactctaatcttcccctcttcccattaaaatgttctctgacctaccttgcctgattgtgggttggaagacttccattttaaaaggggtcctgccctatatcctggaagagggaatgctgcacagagaggccaagaagcatctgcacaggcctt

SEQ ID NO: 616816 - DNA, 290 bp, Homo sapiens
  misc_feature (21)..(22): n is a, c, g, or t
  misc_feature (24)..(24): n is a, c, g, or t
  misc_feature (26)..(26): n is a, c, g, or t
  misc_feature (108)..(108): n is a, c, g, or t
  misc_feature (235)..(235): n is a, c, g, or t
gaattcggcacgagctcgtcnntnanacgatgatgtcgatgcctttaattttattcgcaccattgcggtcgcgcggatcatgatgccaacctcttacgtgcgcctttntgccggacgcgagcagatgaacgaacagactcaggcgatgtgctttatggcaggcgcaaactcgattttttacggttgcaaactgctgaccacgccgaatccggaagaagataaagacctgcaactnttccgcaaactggggctaaatccgcagcaaactgccgtgctggcagggggggccc

SEQ ID NO: 616817 - DNA, 192 bp, Homo sapiens
atagctttatgtctagaaaactctagtacatcttcattgaaaactcctgctaaacacctgttgtgatcataatgaggactcagcaagtaggaacctatactgttgtgtagggccttgcctgaatgtcgatgggctgctgactgatcagggcggtagtcgttcaaggttgctattgaaacttctaaaactagg

SEQ ID NO: 616818 - DNA, 139 bp, Homo sapiens
  misc_feature (19)..(19): n is a, c, g, or t
ctactaaattcgcggccgngtcgactgaggcagacagctggttggcggggagcggaaagagagattagaaccctctcgcgggcatcccagtcgttatggcgacgggatgtgcgctggatcactggctctcgcctgaaag

SEQ ID NO: 616819 - DNA, 138 bp, Homo sapiens
tggtagtactgtctggggtactgaaaatgcgctagattgtggctgcataactccatgagtacatgaaaaacactgatcaggtgttaaatggatacattgggtggtatgggcaataccaattaataaaaattgttatga

SEQ ID NO: 616820 - DNA, 105 bp, Homo sapiens
ttttttgccttccccacctagactgtgaaactcctcaagggcagatactctattttatttgacctttatatcttcagtgcctgggacaatgcgggtaccgagctc

SEQ ID NO: 616821 - DNA, 366 bp, Homo sapiens
ttttggggccctttttcccagggggcccccccccccttaccgggaagggggttaagggcccccccccccgggggaggggtttgggggccccccactttaaaggttttttaatttttttaagggggggaaatttttttgcccccccaaaaaccccgggggggattttcctggggggcatatccccggtaaaaatttttttggtggtttttttggaaaagccccctttggggggggtggttccgggtttccccatttggtttttcggggtttccagggggggggggccctttccccccccccctttttccgggatttaaggggttttttttaaaaaaaaaaaaatttttggaattggtttttttttta

SEQ ID NO: 616822 - DNA, 184 bp, Homo sapiens
atgtgtaactatgtgtacaatatgacagaatgtgagggggaagttgcacacacagaggaggttgtgtgtgtttgcatgtgtttgaattcacaaggaagaaattatttatcttgagctatttcctttgttattcatgtatgactgtttgagaattattaatgataataaaatgtacacacggtca

SEQ ID NO: 616823 - DNA, 262 bp, Homo sapiens
attctgaagcaaggaagctaggaatgacaggagaggtcacctgatggttacactttatcccctcactatcaattctattcttatactccattaacttagttatgagagctgattttccctctctccaggttgaacgactacattaggccacttctgtccgcacgtcggcactgtctcagcacctcattgaaaccctcacagagcttgatgtcaccctggttctgggcacactccagaaactgtacgatctcatagaggcaag

SEQ ID NO: 616824 - DNA, 664 bp, Homo sapiens
ttatagcaagtcatgcaaatttttgatttcccagtgcatatacaagttatattcacacgatgctctagtctattaggtgtgcactgaatcacgttatatctaaaaaacaatgtacataccttaattttaaaatactttattgctaaaaatgctaaccatcacctgtcttctgccagtcatcatctctatgctggtggaggtcttgccttgatgttgatggctgctgactgatcagggtggtggttgctgaaggtggaggcagctgtggcaatttcttaaaataaggcaacaatgaagttcgctgcagcaatgaactcttcctttcatgaaagctttctctgtagcatgcaatgctgtttgatggcattttactcatactagaacttctttcaaaattggaaccaagactccccaaccctgctgctgctttaccaactaggtttatatagcagtctaaatcctttgttgtcatttcaagaatgttcgcagtatcttcaccagggaatggatgccatctcaagaaaccactttctttgctcatccaataagaagcaactcatctgttcaagctttctcatgagattgcagcaattcagtcccatctttcatatcccatttctaatttgtggttacctggtattccaacaacattgcagttgtgcct

SEQ ID NO: 616825 - DNA, 300 bp, Homo sapiens
acgaaaatcttgagcatagggtgtctgaggctgagaccaccctcctctcctgaaggaaaagaacccctccccattcaacgttaaaaagtcacaaggggcccggtgcagtggctcacgccagcaatcctagcacttgaggaggccaagatgagcggatcatttgaagtcaggagtcacaaggatctaccaaataaaactgatattattgtacacagagctcctgttcaaaactttaagacttcttcaaattaaaatggaggagaattacaaacggataagcatggattttgttctctctct

SEQ ID NO: 616826 - DNA, 316 bp, Homo sapiens
gggcccaagggagtagtcagcgtaatcccaaaacggttttttttaatccaattttaattttgaatgtttggggtgggcttaatcccatgtttattaatataaaccctcgatgatgagagagttacaaagaacaaaattccagacccaaccctccaattttttcagcaaaagcattttgggtcgttgagttgaggtgggttttgggatccatagggggccgcccccccacagcacgtgttgtgacgatggttgaacggaaagtgtcccctgttcctgaatattgaaataaaccaataaacttttaatggtttttgca

SEQ ID NO: 616827 - DNA, 560 bp, Homo sapiens
tgatgaatggccggaacaaatttgaaggggaggtcaccaaggagaacctgctggactttatcaaacgcaaacagctgccccttgtacatgagtacaacgagcagacagacccgaagatttaaggaggtgaaatcaagactcacatcctgctgttctatgcccaagagtgtgtcttgactatgacggccaactgagcaacttcaaaacagctagccgagagcttcaacgggcacagatcctgtatcatcttcatcgacagctgaccacaccgacaaaccagcgcatcctcgagtatctatggcctgaagaaggacagagtgcccggtcgagcgcctcatacacacctggaggaggagatgaccaagtacaagcccgaatacggaggagctgacggcagagaggatcacagagtactgccaccgacttcctggagggcaaaatcaagcccacacctgatgagccaggagctgccggaggactgggcacaagccgacagtacaggatgctcgcacggagaagaactcagacagacgaggactacaggatgcgacacaccaaca

SEQ ID NO: 616828 - DNA, 480 bp, Homo sapiens
acgtcacgtgacagcgagtccagcgcccggggcctgggagaacaaaggcggctgacccgtcacaggagctgcacggcaatgcatctgagaccatgcggtgtcaccttcacagaagtgctctggcacagagactccagccttgccggcctctcgcctcccaagcacagaagcctccagaacgctgcttcaaggacaagcccaggagacctgccatgctcatgcgtgtctttggaaacagaagccggacaggaattgatcacatccactagtgaaggctcagaaagtgacaagatttcatttggaaatcgtacctgtgtccttgggaacatcctgaaccttgggaagcatcagctcatggagttcctattaactggataaatttatattctagattgaaatggaatggaattaagtaggcccacggttttgcagcacgtacatttgaagaatcattaaaaatcatcatagaaacaatttaaa

SEQ ID NO: 616829 - DNA, 437 bp, Homo sapiens
gctcatgcgtgtctttggaaacaggttctctaaattttgcttgtggtttgttaaaaaaaaaaaaaaaatcagaagtgtaatcaaagacttcaacaaacgaagcaccaaaacacttcagctttgaaatgtagaattgcaatgactggaaacacggctcgcaaagcaaaagacattaaaattcagtcatccctacagaagccggacaggaattgatcacatccactagtgaaggctcagaaagtgacaagatttcatttggaaatcgtacctgtgtccttgggaacatcctgaaccttgggaagcatcagctcatggagttcctattaactggataaatttatattctagattgaaatggaatggaattaagtaggcccacggttttgcagcacgtacatttgaagaatcattaaaaatcatcatagaaacaatttaaa

SEQ ID NO: 616830 - DNA, 327 bp, Homo sapiens
  misc_feature (218)..(218): n is a, c, g, or t
  misc_feature (239)..(239): n is a, c, g, or t
  misc_feature (258)..(258): n is a, c, g, or t
tccacctaaacacaacattagggcccttaatgcctggattattccactttgctcattatatgtataaaatcataattaatgtcacttctgtttattcagaaccacagactaaatcctcttaactagaatgaacgccaaggctaacaaaaggagggcagggcaaaaaggaaagaggacgtaaaaggaggacttagtttctagtgcagtgcctgacactncagggattcaaacattcaatnaaattctttcaaaaggtgnaattgggcaaatgtcgcaaagctacatccctcaatcatgagagggctattctgaaaggacaggacaaag

SEQ ID NO: 616831 - DNA, 1269 bp, Homo sapiens
ggaatgggtggcagagcagcctccccaactaagcctgggtcgccgcctcgtgtgaatggggcctgcggggccgagctgcggtgaagtgtgcgtccagtcgtgtttttgggcatggctgatgatgccatgatgcgtgagaaccctcccactggctgatggggcaatgcccttgatgacttgtgactatgcatatggtcgtgagtctctctgtcagctcttccgcagtctgaagtgggctgctggtgtgttgcgtgggaccgtgccctgaactgtgccaagtctccctgctccggaagcggaagttgcaatgcactgcgtgtggtcctgatccagttgtgagcccgaaccgatgctccagtagattccaggccagctggtcaatcgatgcccttatcccacttgccggtgtccttgctccgccatgtccccggcacaatgctcgcctctaggactcttctctggaccagatgtgcgggcgggatgaacaacgcgggcacgcctctcattagtcacagtacctagattttctggacattgatttgtcctcatcgcgacaacataattgcatcatggaagggcggtcttaacctggcgtcacaatcacgctttgagacaagtggatcaagcttcccggacatcgactcggctgagctgaccatccaagcgcgccaggcccttgtcacaccctgtcccatctaccaatactcggaaaggcacgcatccttcctcgttgacgctgcaccaaactctgaagctcgcacggcatccccgagtacgcaacactggggggacggacacgccgctgggcactgtcttcgcgcacagacgcagcctagtcaccggtgtacacagcacgacagacacttgcccgtaaatagtgccatcaaccccgagagcacgcctctgaaagcgagcactctacaagtggaaaatatgccacacacgcgatggcggcactacattagccaaggctacttgaggaacgcgaacaggcgcacgcacatcgatcacgaaggcccgggagccgcacacgcacccaggacacgggaccgacagaagaagaggcgaactggtgcgagacaaactacgggaagcaagcaatgaacagaacacaagcagtggagagtaagagaggaaggacaaagccaaggaggcgaacaaccgagaagcgagacagcacacagggccaaaaccacaaagacaacaccacagcccacgctggtagaacgcagaaacacagtacgacaagacgaaggcaagtaggagaat

SEQ ID NO: 616832 - DNA, 195 bp, Homo sapiens
  misc_feature (13)..(13): n is a, c, g, or t
  misc_feature (15)..(15): n is a, c, g, or t
  misc_feature (71)..(71): n is a, c, g, or t
caaggcacgagtntngctacacgctagtcgagctggttgatgatgcatcatgaacgacacgtaactatcgnctagaaagttcatgaccaaccgactacttcagaggaaacaaatggtcgattgatgtccttcaccccgggaaggcgacagtgcctaagacagaaattcggcgcaaaaacttagccccaaacatgt

SEQ ID NO: 616833 - DNA, 145 bp, Homo sapiens
atctcacgaagacactctgggcagtctggacacacggcttctggcgcgtattctggaactgagaatggcacattgtgtgcttaactccgtggctggcactgtctggcatccccggtggcattgaataatggaaattcaaagggtt

SEQ ID NO: 616834 - DNA, 998 bp, Homo sapiens
  misc_feature (243)..(243): n is a, c, g, or t
  misc_feature (321)..(321): n is a, c, g, or t
  misc_feature (336)..(336): n is a, c, g, or t
  misc_feature (346)..(346): n is a, c, g, or t
  misc_feature (766)..(766): n is a, c, g, or t
  misc_feature (789)..(789): n is a, c, g, or t
tcattagagcttatcttgtcagatcgtccattgcctttccaagggttcattttacgcttagaagtttgttgatagaaccattagaaactgccttttctcggtgcttgtattatcaggtgtaattactcgaagcgtccagcccatcacctggattcagaatgtcttgacgacattcacatgcacatcgcacccattccatcgagctgttccagcttctgaacacatacacgtagcacttagatnacttgtggatattttaatcaatgcgtggatatgactctagctgcccattagattcgctgcgagaatagtcctccactnctgcactactctagnattgtgattncgctgctcacttattctgtgaagttcctaccagaaggttactcctctacactgtttccagatgtgtgtgctagtgttcacgtgaaactggattgttttacccatcttcagaaagccccctagtcgattaagatgtggtgcgacatagaagagaatagtatagagaagattataatataacatagcaatagcaaagctgcgtacagagatccacacattatacagagaccactaggagaccatgagttgggcctcatccaagaacgaaacctagtgaggcttgctaccaattactgtcttgcaggcgttttgcccgcgcagtctcgattgagccacgttgacacattctggggaaactggccttcttgttagtagtagccctgcttggaaataaacttcgtatcgcccagatgatgtgccnacaagtacaagtaggaccgcgtnggattaaccgccccgtccaattcggggtaacctcccccagggaggaaggttgttccacgagaagcagggaccgggcaaaggaacaggcagcttaccaggccttcagccagcatccttgaatgcctacgcccggcgcagggagtgtcgaagaaaacccaaagttcttacgccttggaaagtcaccccattcagggcctgaactccgccgg

SEQ ID NO: 616835 - DNA, 568 bp, Homo sapiens
  misc_feature (39)..(40): n is a, c, g, or t
  misc_feature (54)..(54): n is a, c, g, or t
  misc_feature (56)..(56): n is a, c, g, or t
  misc_feature (115)..(115): n is a, c, g, or t
  misc_feature (177)..(177): n is a, c, g, or t
  misc_feature (212)..(212): n is a, c, g, or t
  misc_feature (252)..(252): n is a, c, g, or t
  misc_feature (272)..(272): n is a, c, g, or t
  misc_feature (279)..(279): n is a, c, g, or t
  misc_feature (281)..(281): n is a, c, g, or t
  misc_feature (283)..(283): n is a, c, g, or t
cccgaggatcccgagacgaccttagagaggtttagattnntgttttttttggtncngcctcaaagctcagtttatggaagacattggtaagctatgggatcatcacttgaatcangatttggactagtgagcttaatggtccatttcttacaatttcaaagttacagtctcagaaanggttaattttaataactgtcctatcataaattaangtgggaataaatggaggtggtggataaatacttcatgaanactaaagtctgaaataaatnactggtntnangtccaatagctactacatttgatagaacagtttggaggaacataccattctggaacgcagcatctgacgtggttctcagcaagtgggaatagtaaggattatgggcttgtttcgatgagtggaagcggcaggtaggtagcatacaagttattcaataatctggtgctgatgacctaaaaatatgtcttacctatccatcaaggaaagcctggtgaagccttaactggtaactacttcaacagttggaattagtagctctattaccctgatgaaacaaaactatac

SEQ ID NO: 616836 - DNA, 232 bp, Homo sapiens
cccaagaaagcccctttttaaagaaaaaacaattccctgagctctcaactccaagttgtaaatttggggttttccttgttcttactttaaaaagtcatgtgttaattttttttctgccgggatttgtatgcaaaatgtcctctatttgctattaaaaaaaagctacgtaaaaccctccattgtaaccttttaagtaataataaataaaaaaaaatatattgccgttaaaaaa

SEQ ID NO: 616837 - DNA, 446 bp, Homo sapiens
  misc_feature (35)..(35): n is a, c, g, or t
  misc_feature (62)..(62): n is a, c, g, or t
  misc_feature (100)..(100): n is a, c, g, or t
  misc_feature (108)..(108): n is a, c, g, or t
  misc_feature (126)..(126): n is a, c, g, or t
  misc_feature (138)..(138): n is a, c, g, or t
  misc_feature (169)..(169): n is a, c, g, or t
  misc_feature (184)..(184): n is a, c, g, or t
  misc_feature (245)..(245): n is a, c, g, or t
  misc_feature (269)..(269): n is a, c, g, or t
  misc_feature (356)..(356): n is a, c, g, or t
  misc_feature (358)..(358): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (412)..(412): n is a, c, g, or t
gggggccttgccagctccagcggccttcttgtccnctgctttgttgaccccccccgcaactntctgtctcatatcacggacggcaaagcggcccaaaggnggatagtntgggaggctctcaacacncatgggcttgcngggggccgtatcaccaatggcagcctcaccngacttcaagagtttngggccatcttccagctttttaccagaacggcgatcaatcttttccttcagctcagccaacntgcctgccatgtgagccgtgtggngatccgatacgggggcagagccggcgcttatttggcctgggtggttcaggatactcacctgagcagtgaagccagctgcttccattngngggtcatttttgctgtnaccaanaangttgccacgacgaacatccttgacaganacattcttgacattgaagcccacattgaaaaaaa

SEQ ID NO: 616838 - DNA, 591 bp, Homo sapiens
  misc_feature (521)..(521): n is a, c, g, or t
  misc_feature (568)..(568): n is a, c, g, or t
gaaataaaaatcttttagcaagatttctgcgtgaaaatttttcattgtatgaaaaccctgagtttctctagtgaacaaactagaacccagtcagaataactagaccagcagatggcactaaaaggaaaactaacagtctcagattttcctagggcttaaaattatagaacgggaagattccaaagtgaatataaaatagattgaaatctatatttctgattatatatgtaaaggcaaagaaatagattttgggaaaagcaatataaggcttatgtctactttttttttcattttgaatgatcggctgtggtacaaataagttttacacatcctaaagattgtttctagtcaacaaatatattgtctcaagttatcattaaaatgattatgtagagatattattataacagttgttctactgggaaaagcagcaggtggttaacgcttgtaagaaacgaacagcatctcagtgggtggctattgcaaggggcagtttggggtcataagatttttgtgacccnctgcttgccctaccattgaggatttgtgtagacaacacttgtaaagnagaaacagttttaccattaatga

SEQ ID NO: 616839 - DNA, 749 bp, Homo sapiens
tcggcacgagggcgagagagaactagtctcgagttttatcttgttctgtcttttaaaccttcccttatgagcatgcctgtgtggggttgacagtgagggtaataatgacttgtgggttgattgtaaattttgggctgttaattgtcagtccagtgtttaaatctgacgcaggcttatgcggaggaaaatgttttcatgttacttatactaaccattagttcttctatagggtgatagattggtgcccacatggggtgtgaggaagtccagttatatgttggggatttttaaggtagtgggtgttgagcttgaacgctttcttaatgggtggctgctttaaggcctactagtgggtgttaacattttttactctctctacaaggtttttccctagttgtcccaagagctgtcccctcttgtggactaacagttaaatttacaaggggatttagcagggttctggtgggccaaatttaaagttgaactaagattctatctgggacaaccagttatcaccaggcttcggaggttttgtccgcctctaactataaatcttccccactagtttgtgctaaaaataaacgggatgagccccattaagcatatacaaaagaagcccggcaagataacagaaggacaaacataggccccccttcacagatattccaaaaaaatcacaattcacagagataaggggaaaccctgcaaaaaacacgcggaacaaaaacaaaattccacagaaaaaaaaa

SEQ ID NO: 616840 - DNA, 93 bp, Homo sapiens
tgcaaaaaaaaaacgccgtgttggggtttaaaatttgtgtggccccccccccaagggggggcgggggggggccaccaagggggtggcccactc

SEQ ID NO: 616841 - DNA, 179 bp, Homo sapiens
tctgagttcggaagcgacatggacgatagcattttagcgtgattcgagcccctgggctattgtagccagactctggtctcccacactttgtcacagaacgaaacatcgagcccccgagatgcgcaggctggccatggtcagattcatgatgcccgtgtcactccttcagccaatgctat

SEQ ID NO: 616842 - DNA, 293 bp, Homo sapiens
cccccttgcccccccccccctggggggggaagggggtcccatgggccccggctgggggggggggggcaagtcaagttgtttgaccctgggacattagggccccccattgaaacccccccccccccctggcccctttttccttccccggtttgggaaaaaaattgacaaggggggccccatggggggggggggggggggggggggggggggggaagggggggggatttgggtcaggggtttggccccctttggtttttggaaacttgaaggttcaaaaaaaccagggggtttta

SEQ ID NO: 616843 - DNA, 269 bp, Homo sapiens
gagattacatcccatcccttacccactccccccgccaccaagacaggttctcactaccgttccccaggctgcagtgcattggctcaatcacggctcactgcgggcaagacttcctgggctcagctgatcctcccacctcagcctgccgagcagctgccacgacaggcgtgtgccaccacgcccagatcattcttgtgtttttagcagagacaggattatgccatgctgccgatgctggtctcaaacctctgacctcagatgacgaaccc

SEQ ID NO: 616844 - DNA, 1036 bp, Homo sapiens
gatatccaccttggggtgtcactctttattagtgtccccttccctttttctcgagttctggttggcatttctcaggctggaacccaggttttcagggtttttccgagatccttaggtagaaggcagataatagccttgttaaagactgtacgcatgtgaaaagttagctccatgaccaccatcgtactcggggattactattaagttcctgagagagtcgaagaagccgtcacctgaaggctccctccaaaatcgccatccagaaaagaagagactccgcactcttcttttccgaaaagaacccagaaaaggagaaaagtttgaggcctaaataaagtcttttgtgataattattacttatagacaatgtgacattgcacatctagataccacatttaagtttgatcattaatatgcaaatggtagatcagattgggggatgtagcacactggacttttaagaactggaaagaggttttacaaaagaaaaactttcagactcatctctcatttctatacgtccagaaatggcttttgaattttaagcaattactagttgttaattagctctgccctcatgaagtaatctattataattcaccatgaaacagcttatctgtgctgaatttacttccaggccttctgcccataatatctgttagaaagcaattgccagtgagcaagtgagaattttttatttcgtgcaatacctgcttcacttgataatcatattataattttttgatcatgattattgactatattttctggagtcccattgtttcagtgggcattcacagaatgctttccgaaacttctaagacaagaatctacttagcatatagtatacatctggcacataaacttgttttgaaacaagttctttagagaaaagattcatattggaattttattcaccagtataaaatttcctcacctgaagtaactttgtttgcccaaaaagttgctttaataaactataagtttttgaaaacttccttttttattagtctagcaagcccctatttttcaacga

SEQ ID NO: 616845 - DNA, 150 bp, Homo sapiens
ttgctgcggccgccgcgctccccggcccgaggcgatggagaacggagcggtgtacagcccactacggagaggacccgggccccgccaagaggcccccgaggcggcttcgttgcttattatttaatggccgttccatattgttccgcgcgc

SEQ ID NO: 616846 - DNA, 168 bp, Homo sapiens
gcccccccccccccccccccaaagtaaaagccgaaaaaaaataaaaaaaaagggtattgccccgggggggaggtttggggcccaccccggaaaagaaaacccttttttttggtcggggtttaaaaacttttaactgggcgggaaaaaaaaaaaacaggggggccctta

SEQ ID NO: 616847 - DNA, 910 bp, Homo sapiens
  misc_feature (532)..(532): n is a, c, g, or t
tcctcgggggtggttggctctcattcttattcctagggggcccacacattcacacgcaccaaccgcttggttccctcaaagaagggggccttttctatatattcgcgggagttattatttcccttttcttgtttgttttccgccccccccgagaagagttttttttttttttctcccccagcgaggatttttttgttgttgagaacgccctccttgtctaaccaccctccgcagcactccgcttttgtgcccctctctccccccccctcccactttatagagagggggagaccctcttgtggccccccccgctcagcggggtgttctcacccccgctggtgatgtcccttctagtgaggtgtcccacctctccttggtacaaccaccaccacttcggtttgttatcttcgcgcttcaccgcgggtgtatatcacttatcactcctcggggggtgctccccctacaggtgtgtgttatatataggcgaacccacccgccgatcgccccacatattatatttccaggccctctnctttgttttacaccatatgttttctgggttgcgtctattgtttacacctctcttctgagccttctcagaggtgacgtttgagtgttcaccttctctcctcatttttcgtcgccgggatttgtctcggcgctgcacaccatattgttgtggggatgctccaccgacgggaggtttcctccgggttgttcacacgccctaattatgggctccaacatttcgtcttcacctattttgcgttctcttccccccccattaattagttctcctttacacacaccccacaaaccctttgggtttaaaacccccccccgaattggccttttttaaaagttgggtttatattttttttaattttcccttttttgggggggggtttta

SEQ ID NO: 616848 - DNA, 215 bp, Homo sapiens
  misc_feature (3)..(3): n is a, c, g, or t
ttntttcacaaggatttgagtctgatctgctaacattctactgatttctggcgtaatgggactgcactgcatccatcctactctgttcatagctacttgccctcgttaataccactttaagagttttccaccttgtccagaactacagtccattaatcccctcattttctctcttaagagaataaacaggccaggagcggttggaaacctcttct

SEQ ID NO: 616849 - DNA, 1049 bp, Homo sapiens
  misc_feature (210)..(210): n is a, c, g, or t
  misc_feature (403)..(403): n is a, c, g, or t
tgttccatcgggttgcgtgcgcggacggtactggtgttcgtgtacctcggcgtcatgtgtctgtcgcctcctttggtccttgtgtgtcccgtctgtccgcgtcggcgtactttgctccgggggtctgcgttctttcgccccgtgtttgctgtagctcgatcgcgacggctggccgaaatgccatgtgcaccttggtggtctccgtctctnttgccgtcttcgctgtccgggggtgactctggtgtgtataacgggcgtcgcctcctgtcgggctgcctcgtggagttaccccttcgggttgcgctttcctgtgggcgccgccagcttgtgtatcgatggcgctttctctcgcgcgtaggacagtttgccactcctactactacttgcggtcgcgacaaatgancttctcctaaatacgcttgttcctattcagcaatccccctttgcgacccacacatgtagcctggtctccggtaggtgtgtgctccgcagccgttatctggttgaatttttgtaagcgtgagtgttcacccactctcgtaaggggtggttttttttttaagtgacgcggagattcctttccacagttgtgtcgtttatcacacaactcgtccctagagtgtgtctcctctgtgcgatgagtgacacgtctgttcctgtcattctctcctcattatctctccagtacccatgtcgctcgttagcgttggtgtagtatcactctctcctcccttcagctggggtctgcgtttctcctcgcaccgctcctacttccgctttctcctcgcctacagaggcacctccctcctgttgcccatcacacactccccgttgtttcgctcccactccacccctatacttagaacagcttctcgtaccttgcttctctacacataccagtccggcgccctctatctggacacaccgcagacatgccctcctataacactaaacaccccgttttatcacacctatatacattattcccccccttactcagaacctccactccaaacaaagcccccagtgtttgcccccacaacataaca

SEQ ID NO: 616850 - DNA, 143 bp, Homo sapiens
tgggggagggggcaaaatatgtttccacttctttgtcccttaggtctgtctacaatcctaaaggcaaatgactcacggtgtaacagaaaacaagaaaatccaatatcacgataatcagaccaccacaggtttacattttatac

SEQ ID NO: 616851 - DNA, 164 bp, Homo sapiens
gccccgcctttccttttaaaattcaaaggggaaatttttccccctttttcccccaaattaaacagggggtcggtttttcccgggcccctgcaggggttttttgttaaagaaatttggaattttggggggggattaaacttgtttaattaaaaggaaaaccctta

SEQ ID NO: 616852 - DNA, 967 bp, Homo sapiens
  misc_feature (32)..(32): n is a, c, g, or t
  misc_feature (83)..(84): n is a, c, g, or t
  misc_feature (136)..(136): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (165)..(165): n is a, c, g, or t
  misc_feature (227)..(227): n is a, c, g, or t
  misc_feature (296)..(296): n is a, c, g, or t
  misc_feature (317)..(317): n is a, c, g, or t
  misc_feature (352)..(352): n is a, c, g, or t
  misc_feature (389)..(389): n is a, c, g, or t
  misc_feature (391)..(391): n is a, c, g, or t
  misc_feature (399)..(400): n is a, c, g, or t
  misc_feature (402)..(402): n is a, c, g, or t
  misc_feature (454)..(454): n is a, c, g, or t
  misc_feature (818)..(818): n is a, c, g, or t
  misc_feature (871)..(871): n is a, c, g, or t
  misc_feature (904)..(905): n is a, c, g, or t
  misc_feature (967)..(967): n is a, c, g, or t
atcaacaactggtcagttgttttttgtttttntcttttccacactgctctctggattcgaacctagtgaattctgggctcagnnctcctcctccatctctttcttgatccaatccacgtagttgagcactttggtntagaagccatancccctncngcacccgangccccaggacacgatgcccgttgccacccagcgatcagtgttcgggtcccttactgcaaaancgcccccactatccccctggcaggcgtcctgctttagagatgggtgtccagcacagaacatgttttganagaacacatccatcctattcnttccccggcgcccagtcctcacagcgcctgtgcgnttagctacgggcagacggacaaacctgaggtcatgtncnatcttctnntncatgaccccgaagccactgacatagcccatcaagcccatggtcgtagaaggnatgcgttgtgggggaggcagagggggaggaggttgggacccagggtgacactattttccagctccagcagggcgatgtccccctcaaaattgtaggactcatcctgacggtagtccgggtggacgctgaccctgcggatggggtgatttcctagcttcatgagctcttccacatttgtgtggcccaggaacacatccaaagaggcgttgctttgcgcttcgtgttccttgggatacagggtgtgggcagctgtgaggatccagcggtcgcccagcagggccccgcccccgcgcccgtggatgttggtgaacacctgccaggggaagttgcccatcttgggctttttgccctccgatgatgcgcngcctctgttccacggggttcacgggcttcccacacactggcaagcaccgaggnatcttctctcccttctgttcattcttccaaatnncctgtgctgtgcaggtgtacaccccttgctcagactccctgctgccagctctggtctgcatn

SEQ ID NO: 616853 - DNA, 230 bp, Homo sapiens
ctctacttctctccttaatgacattaacaccattctccgctccgtccctaacaaagctaggaggcgtccttgccctattactatccatcctacatcctagcaatactccccatcctccatatatccaaacaacacagcatactatttcgcccactaagccaatcactttcatttgcactccaggtggtgtggggtcactgcagctcgcaatcgtcacatcatggtcctca

SEQ ID NO: 616854 - DNA, 175 bp, Homo sapiens
  misc_feature (89)..(89): n is a, c, g, or t
tttgagtgactctaaggatccgtgcgattgacaggagctactgtgactggttcagtagcagctacagcactgcacgtgagcagtcttcncacgactggttcagtggacacttacttcagatttgagcacactcttcccacatgcccggacaaattacaaagatcgcagtaccgat

SEQ ID NO: 616855 - DNA, 265 bp, Homo sapiens
  misc_feature (155)..(155): n is a, c, g, or t
ttcaaactggagaaattatttctttcaagattggtagtatggtcagacatgatggctcatgcctgtaatcccagcactttgggagtccgaggtgggtgtatcacctcaggtcaggagttcgagaccagcctggccaacatggtgaaccccatctntactaaaaatacaaaaattagctgggtgtattggcaggtgcctgtaatcccagctattcaggaggctgaggccagaggattgcttgaacctgggaggcagaggttgcagt

SEQ ID NO: 616856 - DNA, 129 bp, Homo sapiens
tctctgagacgggagtgacgggccggctcatatgccacactgtgcattaccaaagcatgtaaggcacctgagctaagttgtcagacaccccccaaatgcaaggacatgttcgaaatcctggacatcacc

SEQ ID NO: 616857 - DNA, 632 bp, Homo sapiens
gtccgagcaccagcgcgctctgagctgcccccagtgtccctcccccgccagcagcagcccatttggagggaggaagtaagggaagaggagaggaatggggcagccggaccgacataccgcagacagagccggtgaatagggttatgttgggtgacccgacagacaaacagacgacaagagacagagagaaacaatagacaaccacgaaaaaagaagcagacaagcgaaggcagagcgagctagacgagcatagaatggaaatgaagaagaaagagaaaaacagagaaagaagcaaggaaagaagaaagaaaacaaaaagaaaagacaacaacaaaaaacaaaagccgatagaacaaaagaccaacaaaaacaagaaaaaaagaaaaagcaggaaatacaaaaaaaaacacaacaaacaaagaacaaagagaaaaagaagcaacacgagaacacatgggacgaagagaacacacaaaaagacgaagaggaccagaacagacggagaaataaaaacacaccaaaaaaaagaagaaaaagacaaaacaaaagaaaacgaaggaaaacaaagagaaaaaaaggaaaacacacaacataaaaaagaaaagaaaagaacaacaacagaacaaaagaag

SEQ ID NO: 616858 - DNA, 107 bp, Homo sapiens
ctctctcctgacatagtgtcatgcacccggggtctacaggcaggtctgggaaaggctggccagcaggtagcctgtgtgtttgacaaacagcagctcgccccatagtt

SEQ ID NO: 616859 - DNA, 819 bp, Homo sapiens
  misc_feature (43)..(43): n is a, c, g, or t
  misc_feature (46)..(46): n is a, c, g, or t
  misc_feature (50)..(50): n is a, c, g, or t
  misc_feature (58)..(58): n is a, c, g, or t
  misc_feature (60)..(60): n is a, c, g, or t
  misc_feature (77)..(78): n is a, c, g, or t
  misc_feature (85)..(85): n is a, c, g, or t
  misc_feature (93)..(94): n is a, c, g, or t
  misc_feature (97)..(97): n is a, c, g, or t
  misc_feature (99)..(99): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (125)..(128): n is a, c, g, or t
  misc_feature (141)..(141): n is a, c, g, or t
  misc_feature (144)..(144): n is a, c, g, or t
  misc_feature (151)..(152): n is a, c, g, or t
  misc_feature (157)..(157): n is a, c, g, or t
  misc_feature (168)..(168): n is a, c, g, or t
  misc_feature (177)..(178): n is a, c, g, or t
  misc_feature (186)..(186): n is a, c, g, or t
  misc_feature (198)..(198): n is a, c, g, or t
  misc_feature (204)..(205): n is a, c, g, or t
  misc_feature (217)..(217): n is a, c, g, or t
  misc_feature (258)..(258): n is a, c, g, or t
  misc_feature (265)..(265): n is a, c, g, or t
  misc_feature (311)..(311): n is a, c, g, or t
  misc_feature (330)..(330): n is a, c, g, or t
  misc_feature (355)..(358): n is a, c, g, or t
  misc_feature (375)..(375): n is a, c, g, or t
  misc_feature (391)..(391): n is a, c, g, or t
  misc_feature (415)..(415): n is a, c, g, or t
  misc_feature (420)..(420): n is a, c, g, or t
  misc_feature (431)..(431): n is a, c, g, or t
  misc_feature (507)..(507): n is a, c, g, or t
agcgggtctcgccggcgcagtcaccgcgcagggcggccgcccngangtanctaccacngnctgtgtcaacgactaannctccagnacagcgcnnccntnagacngntnggagggtggctctgccnnnnagctggctccggnganctaccgnnaggangagcggcggangcgacctcnngcctggcntgcaatggccgnccggcnngcgcgacatgancctggtctggcatccgcgggatgctccttaagccccttctncggctgntaacctccggggaacggttgtgaccacaccgacacgtattttacanataaatcattcttgcggcngcgggtcgaacacgtttatttattnnnnattttctcaacaagctnttacccagcacctgtncagtgaaacaacttgataatcgtntcgangggcgtccgcngggttaggaagccactgcctggcagcttgtggaagcctcatttgcaaagccacccctcagatgttttgaagatcgngacgtcttgtaactagcagtgtgtgcacagaatcctactcacggaacgtctgggccagcgatgcaaagaactgaagtttcaagctggaagagcctgtatggtcctcagcaatagtaatagaagaattcaagcagcaggagaagacgagacaacgacccgaagtgaaggactgtagaagaaaaaagaaaggaattgcgagacgatttggaccaagaatctggccaggactaaggaacgaggtaccccagaagggaaaccggctcagggaccatgtatagcagggctatgaccttcgaggaccttggggatccg

SEQ ID NO: 616860 - DNA, 426 bp, Homo sapiens
ctatccagtgttctatgtacatctagatatgacatcagcatgcgctttagtttcctaaggcaaacaaagcccacaccagcccctccacaaacattccccaacgtgtccgtggatgtgtcccagaggggaaggcagtgcaaggcaaacatttagatggtaacctcatagcttccaggtcatcaattgtcttttcccagtataagcaaccgttctctctgcaacattcagcacgggtctcagcctctttcagtatgtccagccagaagtttcatttcttcttcatcattcgtcctcctttacagaatactgtgggagaacacaaaacactgcttaaagaaccaggaggccagccaggggtggtggctcatgcctggcaatcccggcacctgtaggcagcctgaggctgctggcatcattgcagtgtca

SEQ ID NO: 616861 - DNA, 446 bp, Homo sapiens
  misc_feature (416)..(416): n is a, c, g, or t
ttccctctatgtgtccatgtgtcctcatcgtttagttctcacttgtaagtgagaacatgtggtatttggttttcgtcctgtgttagtttgctaaggataatggtttctggcttcatttatgttcctgcagaggacgtgatctccttttttatggctgcatagcattctatcgtgtatgtacaccacattttctttatctaatctaccattaatgggcatttaggttgattccatgtctttgctattgtaaatagtgctgcagtgaacatacatgtgcatatgtctttataatgcaaggatttgtattcctttggggtatcctgggtcacatacaccctttcaagactgagccaggggaggaaattggaatccctggaacaggaccaataaaggggctccaaaatttaaatcagtantaagtaggccctgcccggttttacaaagga

SEQ ID NO: 616862 - DNA, 106 bp, Homo sapiens
  misc_feature (1)..(1): n is a, c, g, or t
ncgggagtggagagagaacggagaagctctggttaggtttgtaagtgaggaggggagtggagagagaaggaaaaagggaggaggggtccctagtaggctgggtgcc

SEQ ID NO: 616863 - DNA, 664 bp, Homo sapiens
  misc_feature (656)..(656): n is a, c, g, or t
ttcatggtatatgtatggtgttgtacatattatatggactaggattgcagattgttgggtgtataaatgtatctttaatggtgctcaagtttttataacttatctgccacaattatagggtcatgaaactagtgccttgttaatactggaaaagataacagatagaaacctcatcaatgcaaccaacgcagccttgcaaacgtgagtactgtcagtatctagtataaactttgtgacctataattataaaaatgataaatggatttttttaaacatgtgactattggaataggctttcattaggtcatagaaagcaattttaaataggttttacaactagtcaaaactctatttcgtaaaatgattcacaaactaaaaagccataattattgtaaaatagctttgtgaactcgaaagttgttatgtatacacattgagcgagataagtgatattctttcttgccttaaatcacaaccatacactaattattctagaagagaaagtaaggtacgtattttaggtgtatgtctagtggaaatatctaacgtataattaatgatggttactgtgaacactaacaaatataatgagagtaacaccgctcccattgtggtgtctcgtaagccaataaaaggtttacttaaagatatcaaanaaaaaaaa

SEQ ID NO: 616864 - DNA, 972 bp, Homo sapiens
  misc_feature (468)..(468): n is a, c, g, or t
gactgtgtcacggtacgcgccgttgggtgatcggaccgcctctggttgcatgaggagccccgtaatgtgtgaaaccacccgagtggaggctgttgtcccgcacgctgtaggttcggcgtcgcgtgtccattaggggattctctgcgtcgcataatgtgcgtgttggcgatgccagttgtcgatggtgcgcgtttgtgcggggtcacagcacatattgcccggaggtgtctcgctcctgcagtgtccgggggctctttgtaaaatgcgcccgcttgttaatcagagggccgcatagatatggtcttgggccagagcgagaacaggaaagcaactgggagggtccacctcatctttgatcgttttcccccgatggggccactcaagccgcggtgtcaggatgacccagacgaccagaaacgacgccccgttgtggtcggtataggtagaacccggcgcaggtaacaccanctcggtgtggtgggcgaaggagcgtgacgcaacagttcagccacgaagttatgggtagcctccactctctgcgggtggtgcgaccaaagccgactatgaccgtttgggacaaattgattgttgtgggcgagatatatcttcattatgtaggatggaccgccctacaagtataggatagtttcctacgctatttgccgcacgctgttgttaatcccgtgaccgacttgctgtgtgtggtagtcccataccacgcagcggtcgctgcctctgagtagaaggggtgtcaacaacaagcttggcgtaggcgattccccgccggggtgaatctctgccgcgaggacagtgagagtgggcggcggacacagtctcccctgccgacgcgtcctctgagaacgccggcggtgatgtgcccgactctcctgctccccccggggctgttgggagggggcgcccctttccctgcttttagccccaaaaagaaaacctaggtccccgccacaaaaa

SEQ ID NO: 616865 - DNA, 788 bp, Homo sapiens
ctttccggccggtccccatggacgcgctggggaagctgaagcagttcgatgcctaccccaagacttggtgaggacttcctgggtcaagacctgtcgggggcgccagcgtgtaccattgtcagtggccttctcgatgctgctacgtgtgtcctgtccgatgctgcagtattacgctcaccacggagagtgcatgctgagctctacgtggacaagtcgcggggagataaactgaagatcaactatcgatgtactttttccgcaacatgccttgtgcctatctgagtattgatgccatggatgtggccggagaatcagcatgctggatgtggaactaagccgaatctgtgtggcaacgcaactgactagtataagagatggcgatccccgatgatgcgtctagaggctgagcggtcatgatgcttgggaaagtctggaggtgatcggtgttttgaccctgacatccacttggtaaccctgactcgtctgtgcagagcctgctactggtgcttgatggcatgaaagatatcaagtgtctgtatacactctgttgcaaggatgctgcgggatggcagtctctgcacgtgaggaggctagccgccttgttcaacgcagaccctaagtatactgatttgcatgtcatgtgcgcctgcgcgaagaggggctctcagccatgaaagcatcgcatggacgcccgaaaggacactggaaggcttgtcatggtgtattggcttcttggcgacgtcccatagcggttggcgcgcatcattttaccatgttttgccccatgg

SEQ ID NO: 616866 - DNA, 257 bp, Homo sapiens
  misc_feature (3)..(3): n is a, c, g, or t
  misc_feature (5)..(5): n is a, c, g, or t
  misc_feature (15)..(15): n is a, c, g, or t
  misc_feature (21)..(21): n is a, c, g, or t
  misc_feature (90)..(90): n is a, c, g, or t
  misc_feature (143)..(143): n is a, c, g, or t
gcnanccttgaggcntgccgngcccttcggctcgccatgcccagcgtcggggaaaggatagaactcggcacgctacgaaatcggcgaagncgcagacattgcttggctggaaaacggtgtccgccgagggacaaaacgcctcngacatgcgcaataaaaactgaaatactgtgccaatggaccaattgaggcgaaggcggacaccgagaattttccgcttgctctcctacttctgactctgggtatttcgtccttcc

SEQ ID NO: 616867 - DNA, 449 bp, Homo sapiens
ggtgaaccagaaccacagatttaggattttcaaaccacagcagtataaactctttccactcctggccactgccatatgccttccagattggtgggcggcatacatgaagcgagacctatcaccggagttaacgaaggcaattggtcaatggggaccatgaagtgaacatgccgtgaagcttcagtgaccctctaccgcatggtacttgcaaggacgtttcaccatccttggagcatgcagaacaactaggtcgatatgacaggccatgtcgggaatggcgtaatgtaggttgcggcactaggagtagatacttcaaattatgccaggctggggatcgtatctcagagaataattgataatggtcgacagatagtttcaatcacacccagagggcttggtagccatttctgcagcggaacgacagataccaacctggatcgacatgacta

SEQ ID NO: 616868 - DNA, 290 bp, Homo sapiens
tcagtcgctcgtggtctcattggggattcgtatggtgaatcactgacttactagcattaattggtaacccccaaatccatattcatggggctggtgtggccattccggggcatgtgcagagggggcaaaatatttggagtcattagatgcttatgtttctagctgagctcaaacaagagggcactgtgccatactgtaaacgggtatcttctcatggacccatggttggcatttggtgctttgggtgggtgatgtcactgttaaaaatggccccaagagcgacggacagg

SEQ ID NO: 616869 - DNA, 831 bp, Homo sapiens
  misc_feature (398)..(398): n is a, c, g, or t
agcggtgcttcggccctcggagctgctgaggagatggcgtcgggctccaaggcctcagtgcccgcggactcattccgcacacatcagcccggacaggcgaggcgataagtccgcctccgcctgttctccggggtacacggggggcaggcacgcatccgtgaaggagcacctgggatgcccaatgcggtcggtggtggtcttccctctcgacccgtgattgaaggtgagaaagtcggggccagtgagacggccatgctgctgctccagcgcctgcacgcggctcagtgccgagggtacagtgggagaggcgtgcggcgtgcggactgcggaggatgcctccctgcgtgtccacgtgcctgacggatgagagatggaggcgcagcaccactgtccccaantctcgctgtgtccgccgggatcgacgtggcggcatcgttggcgcgggacgacgaaggttgtcagctgtatttgcgagggaagtggcatgcaaaagacgtgtaaagggcggcaatgattgctggatggaaggttgatgggttaaatacctgatcagaaataattacaatgtatgaacgacgagaattggggttggagtctgggaagactgatactcgccagatgatactttctttctggtggaaagtaattgaatgaaggcttcatattcccgtatttggatttggtatgagtaggttggaaggtaagcttgtgaagccgagtaacgcagaggactgcatcgatctcgtttcaaaggttactgtttgtgttgctgagccctttttcgttccaagaattggcagatattccaaagagattggggtttgaattgag

SEQ ID NO: 616870 - DNA, 295 bp, Homo sapiens
ttctaccagaccactgaaggagttcctgggaagccgctgcgagtaggctagcactgaagactatttttctattggtataacccgcccacctgaaggggaaagggaaatcaaagttaatttttctcgattagacgataaggcaaatttaacggaaaaacagcgtttcaagaacaagttagcatcagcgctagcactgcagctgcttcaacagcaaagttgcttctgcattcagtgttcatggtgaatggggagtgtgagtctttctgtagggtagaaagcaatgccttccgtaacc

SEQ ID NO: 616871 - DNA, 112 bp, Homo sapiens
agtggtgcataaataatgggatgaggcaggaatcaaagacagatttctgcgacatatggtgctccggttccagcgtctcgcaagtgctatcgcgtgcacaccccccaaagat

SEQ ID NO: 616872 - DNA, 155 bp, Homo sapiens
cccgttaataattcgcttccggatcaagaagtagaactgaccaactgtgagatcagaaggcaccaggtattatctttttgtccaggtctcctatccgagacttagggagccttttctactatcaccggcacccggtccgggtatctccttcagac

SEQ ID NO: 616873 - DNA, 833 bp, Homo sapiens
gagtgcggtggagcggatgccccaccatggttgggatccggaaagactactgtgtgatcgttgagaggatggtgccgtgtgcggaagacgctgcctcctcatcgtgcttcagactatggatcagatttccgtgaggtctacgttccgctaggctggtctataaaggaacatatattgccgcggatgatttgaggtggtactggctaatgcagtgttggtagtctggtcatctgtggtgacaaagaacaggtgcaggtaagacggtatgagtcgatctgcggtcttcttcatcctacccgggacacagatgtatatcctcaatgtggctatactcctatctactagccgtgacagccatgtgaataatcgattcctgtagacaggtggacccctacaggatgaaagcattttctgcaccctagactgtgcttcgatcgatcgcctggttgtggggagataaaggaggggaccatgaccgcgaagtacggaggctacaactcgagtgagagaagctggggccaagcatgaaacgccacgtgagaccccgaaacggatctgagggaacggccgaggcagcacttggacgaaacccggacttcaagatggcgctatcagagctaatccctttgaaggtagcatccaagtcacataatgaacccaaatggggacgtgtgaagtcgcagtctgaagaggaaggtagatgagcaattggtccaccattacgaggcatggagccctccgccagggtccagccacatgaaacataggaggttagtgagagagagcctgttacccatacgttccgtaagatccaccaaggggccttttaccta

SEQ ID NO: 616874 - DNA, 600 bp, Homo sapiens
  misc_feature (39)..(39): n is a, c, g, or t
  misc_feature (176)..(176): n is a, c, g, or t
  misc_feature (198)..(198): n is a, c, g, or t
  misc_feature (224)..(224): n is a, c, g, or t
  misc_feature (272)..(272): n is a, c, g, or t
  misc_feature (280)..(280): n is a, c, g, or t
  misc_feature (312)..(312): n is a, c, g, or t
  misc_feature (328)..(328): n is a, c, g, or t
  misc_feature (353)..(353): n is a, c, g, or t
  misc_feature (368)..(369): n is a, c, g, or t
  misc_feature (376)..(376): n is a, c, g, or t
  misc_feature (460)..(460): n is a, c, g, or t
  misc_feature (464)..(464): n is a, c, g, or t
  misc_feature (486)..(486): n is a, c, g, or t
  misc_feature (493)..(493): n is a, c, g, or t
  misc_feature (525)..(525): n is a, c, g, or t
  misc_feature (536)..(536): n is a, c, g, or t
  misc_feature (553)..(553): n is a, c, g, or t
gcttaagtccaggtgagacaggttttgccatcttcctangtgtcttattgcctcaggcgttaaaccaattcctatttactttgcccagctccatggggttctgagatacatggggccgaaaaggggttatatggccatcttttttcagaaaaagtgtctatacgggaatttaaaanatgaattttccatctgactttntttccaaatacactttcttttttaanaaaccaatacactttctttgaggatgtcagtatttggtaatccatttntacaaaanatactacatctagtctggggttgatatatttntttttgtgttactttntttatgtggcactatttacccagtnactatttggtatctnncatgtcnccccagttctgtaactctgccactgctgcctgtccttgggtcttttctggttgggccctttttcccccccctgcccccccccgngctntgccttcattatctgtttcggngttaagncctgttgtggtgaataaaaagagtaaattgangatgtaagttnataggaagggaatgttngttttaaagtagttaaagaataattaaaaaaagttaaaaaatgttta

SEQ ID NO: 616875 - DNA, 1266 bp, Homo sapiens
  misc_feature (134)..(134): n is a, c, g, or t
  misc_feature (318)..(318): n is a, c, g, or t
  misc_feature (432)..(432): n is a, c, g, or t
gtgaaccactattcacgagagagaaactctaccttcttctatttctagattctccgctacatagatcgtccttaatttataatcattcatcgatgccctagatgctcctcattattttaattattgctttcttntctgataatccagcaacatttattcctcgctagcactattgagtctcattcactctatcgctctgtagtgaacgtgtctaagctcatgtcgcgatcaatccgtcctaataatcagctatgcccttacttcctatacttacacgcctagttagagactcctctttccctcttactgtccctcgtnacttgattgtacgacgtctagcgagagcgacccgtaggctcacttcaaactatgtctcactattcatcgtcttctcctgtacctacgaaacatattctacactccttgccctcntaacaacctttaacctatgtatctagactttacagcgaagcaatctttcccattacgttaaatcgtattaccctacgttcttaacgagagcataccagttttattggaactttcccctaacaaaagactctcgactgtttcgtaaagacacacgcgcaattccgtctggtgggttcgacttagggttacttggaacctttcagataaccttccttttgagaaacttgaaagacccgtctaagtgccttactaaccttaacattcgcactatcacctacatttctctaaatgcgcccctggaatctgaacaacaccataaaccccatgatccccccttatcctatgtctcccctttagtcctccctatattcaacgttcctaaacattattattaggagaaagaccttcccagattctatggctccatatcggtaatcaaacaaacaaggaatctccttttataaaaagccggccttcacgttggctggattggccgtccggtctcgaaatctccaatttgccaccaattagaccccccgatccgtatataggttgaacccaagttcccattttacttttccattccgaagaatggttccccccctctgaaaatgtccgtttcaaccccgtgttccccccatggaccacgtttccctgtccagtttgaatccggcgcgcatcaggaccctttaatctatatcccctccagttttacgcaaattttccgtggggccggtagtcacataatcttccaaaacctttaccgaaatctgccaactcccacccagttccgggcctttcacttgaaattcttcgaccatccagagggcccat

SEQ ID NO: 616876 - DNA, 573 bp, Homo sapiens
gatgttcctgctaactttccacttcatggcttcactaactatgagctgtctggtgttgctttagtgaagatactggccatcattacataggtaccccagagactatgacgaatcactttacagcatccaaggtcatcaacagagaatcctaaatgtcggtagcgttcatcagtttcaaaaagagtgttgtttgtatatggtccaaaaaatgccaaaccagatgatgggtcaataaagtcagcccaataaccctcagctcgaagagcaaagcaaatttccttagcaccattgatgaacttttctaagagcacttctctttcaatttctacttcttcactccaaacagtcatatcattcttagtttttggtgttacagtcagaatcattagtttgccattagctacttctggaaacagtgattcaaaatcttttcgcagcaattctggacatgtttgtattgcacactctactctggcactttcaaagtaagtttctgcactgttaatttcttgttcgacaggtgcatcattaccctgaaattcattcacatattgtgccatcaatactcatgta

SEQ ID NO: 616877 - DNA, 744 bp, Homo sapiens
agtgatgttatgtgtgaaaagagaggaagaaggctatggagcaaatatatcttaataatgaaaagttatctgaaacattttcaaatgtgttcagaagaggaaaaaaaggaaatatttggcagggcgtggtggctcatgcctgtaatcccagcactttgggaggccgagatgggtggatcacaaggtcaggagatccagaccatcttggctaacacagtgaaaccccgtctctacaaaaaatacaaaaaaattagctggacgtggtggtgggcgcctgtagtcccaactacttgggaggctggggcaggagaatggcgtgaacctgggaggcagagcttgcagtgagccgagatcgggccaccgactccagcctgggcaacagagtgagactctatctcaaaaaaaaaaaaaaaaaaagggaaatattggaggtagtattctaaaataggtaaggaaagcaaaagtttaattacccgggagtcatttatttaaaattaggaaaaatttaaaatttcagaatattaaagtgtacttcagtttaggaaatttggcagattttaaaaggagtaaaggtggggcgtgggggttcacaccttgtaatcccagcattgtgtaaggctgaggtgggtggatcacctgaggtcaggagttcgagacccagcttacaacttggtgaaagacatttgtagtaaaaatacaaaaaaatagtgggatgtgggcagccttgtatccagctactcggag

SEQ ID NO: 616878 - DNA, 657 bp, Homo sapiens
accagttcaaagtaacaacagaagttggagatctctgaaaactctgggaggtagagcaggcaattcaattcaaatcaattcatttaaactcacctcccttcattaggtatttgagtccctactatgtatagaacatcataccaggggggtgggaaatgacacactgaataatagataaaacctgtcttctcagtgagcatattaacaactaaatataatattgatcagaattagataaatgttatattgaaagttctttaaatcttaggccttaaattttaaaattataacttatacagaaccagattagagaagtaatgcctggtgctcaaactggttaatttccacctcttgagggatagcttatattgttggatacaccttttatgaagacagaaaaaaatgaccttatgagaaattggctgttactgcaaggaataagtaattttatcatattagcaatggatattatcaaaacaccttgtgagaaatcaatcaaatcaaccttaacatacccaatactgtatttggtgggattcaaattttacaaaagctttcccaaaatagactacccccccctttaagtcttttcccagcacttaaacagaatttttttaaaaaagcaagaaccctgctggaataaaactaattcttgaa

SEQ ID NO: 616879 - DNA, 648 bp, Homo sapiens
ctgcccccgggggtggggccccgcctttttttccggctgctctttttgcccctccttcttcagacgaattgggcgggttaaacccccccggcccccttgtttgatccccgcccctgcgcccccttggggggtaaaatggcctgaccgccgggcccccctttggtggagtgtgtctcgcaacccccgcggggttttctcccccccccgggggcccccctctcttctgtgtggggcttctcctggggggtctccccctctcttctcatggggggcatgtctggccgttctttcccacaagacaaggtggggagcgcccccccggccgcccctcctgcccccccgccgtgggggtcccccgggccggtgtggctctgggcgcgcggctactctcttcttgtgaaggcgctccgccttccccgcccgccgcgctttatggcgccccctcttggcgcccccccgagattgttcttgaaggcgccccccctccgccacagtcttaatatgggcgttcttgccgcaatagccctttctccctcccccgccctattggccccgtctcttttctactattctctcttcccaccccttggcgcccccaggggcacaatataaaccttttttacatgcctaatcataatcagaaaacaa

SEQ ID NO: 616880 - DNA, 118 bp, Homo sapiens
  misc_feature (1)..(1): n is a, c, g, or t
  misc_feature (49)..(49): n is a, c, g, or t
nggtaatcaggtggtgagtgtaagtgcacaagggggcttgactgtgaanactgacagggtcgagcagggacgaaagtcgggactagtgatctgacggtggcttgtggatgcgccgtca

SEQ ID NO: 616881 - DNA, 338 bp, Homo sapiens
tacacctttgtagctctgttgccaggcagaggaaccacctggaaactgagctaaggcaggttccgtcttccaacagaagacacagatgggcagggaatgtgcagactcaagagggacaggccatctaatggccagtcagtgttccatgtctctcaccagtgcctggagggacccccagccaaggacagaactggtcagttcctgccagcagcttgagcttcaatgccctgagagggtcagtaaagggtggtcacttgatgagcttcagcacagaggcggatgtcaacatcgcagaggaagatgtccatgaggtcatgtcctgcctcctgtgctaactg

SEQ ID NO: 616882 - DNA, 820 bp, Homo sapiens
aacatcccagcccccacctacgacgagggcggggtgctacaggctcacgtcaccaacctcgacgcctccccctatcttggccgtctagccctgtgccgtgtcgtctccggtgaactcaccaagggacagacggtggcctggtgcaagcgcgacggctcggtccaaaacgtcaagctctccgaactactcatgaccgaggccctggaacgcgtccccgctgagaaagctggccccggtgacatcgtcgctatcgctggtatccccgagatcaccatcggcgagaccctctcagatcccgagaacccggtccctttgccgctcatccacgtcgatgaaccgtcgatgtcgatgacgatcggtatcaatacctcaccgctgtcaggtcggtccggtgacaagctcaccgctcgtcttctcaaggctcgtctcgatcaagaactcatcggaaacgtgtcgatcaaagtggctgacaccgaccgccccgacatgtgggaagtgcaaggccgcggcgaattgcagctggccgtcctcgtcgagcagatgcgccgcgagggattcgaactcaccgttggcaaaccgcaggtcgtcaccaaaaccattgacggcaagctgcacgaacctttcgagcgcgtcaccattgatgccccagaagagttcatgggccccgtcacccagatgatgggcctacgcaagggccagatgatgcacatggtcaaccacggctccggctgggtgcgcatggagtcgtcgtcccagcccgtggccttatcggcttccgcacgaggttcctcacccagacccgcggtcaggccatctgaac

SEQ ID NO: 616883 - DNA, 251 bp, Homo sapiens
cctactgtatcctaggttacgagagagtactctttttaaccaggacacactttaagattttagaaataagaatatgtttctacagacctgaacattagtggtttttttttttttttttttttggaaacaaattttggctctgtgtggccggggtggaagggaaggggcagaatctcggttcaccaggacctcggcctccaaggtcaaaccaatttttcttgcctcagcctctgtgaatgggcgggaattac

SEQ ID NO: 616884 - DNA, 344 bp, Homo sapiens
gggctgtgttaggccagggttgtcagtgcagcccagcaaggcttttcacaggccagcatcaaaatccaggtgcacacaaatgaaagtggcatttttgaggagaaagttaccttagctggttataaagggttctacgatatagtaacaactatcagtaaagtagatggtgatcttggtattgcacatttgaaaaggttacaatcaaataccttacaaatttgatcaggcacacttttattttctatcacaagaaaattcatcaggtaagcaaattcatagcatgcaggaatcaatttttaaacacgagcaagtcactttcgatttaactgtaaatttgctggata

SEQ ID NO: 616885 - DNA, 173 bp, Homo sapiens
tggtagagatcaggtctcactatgttagccaggatggtgtcgatctcctggcctcgtgatctgcccacctcagcctcccaaagtgctgggattacaggtgtgagccactgcgcccagccgagcatgactatttttaaagttcatggggcttctagcccaactgggaggactac

SEQ ID NO: 616886 - DNA, 242 bp, Homo sapiens
gggcccctttttttttggacccccttggggggggggggggccccctttgggggcccggggggagggggccccccggggggggggggggcccccccccggggggggttcccgggcccccccccccccccctttttgggggtttttccccccccttttttgggttttttttccgggggggttttttttttttttttttcccattggggggaaaggggggccccccccgggggggtttttcccca

SEQ ID NO: 616887 - DNA, 1107 bp, Homo sapiens
  misc_feature (1)..(1): n is a, c, g, or t
  misc_feature (582)..(582): n is a, c, g, or t
  misc_feature (667)..(667): n is a, c, g, or t
nccgccgacgtgagctgagtcaaattgctcgctattccactaatgactatccggctgcaggcggatacgcccgtacgtggttacgtctggcttacgtcattgcggttacagctctgtcagctgtcgggtgccctgtgagcgactgtgtgtgcgtccgtctttatgttcggtctggggttgtctggtaggactctttctggatgccgcctgcttggggaagccgcatgccgcccgcttgcggtgtgagcgcgcgccccgaagttggtgttatcacgcgcctcctatgggcgccgtttcgttcgccacatcccctaatggcgcgtggcccgccgcattttttcttgtgtggatgtacgcgcggtcgcaagacttttgttagccaacgccgcttattagaggttttcctggccgcgggtccgcggcaaatatgcccgggtttctcgcccccttttcccgggggcgcctttcacactggtgtggaatggcgggctgcccccgtttcgccgcgtgtttctgtgtcaaaagcgcgtgtcgccccgcggattctttcccagagtgcttgggctccctcttgcgcctcgnacaggtttcgggggaccctctcttagtgccccgcgcattggcggtgatgtctcctgtcccccctggcggccagacagccaaaggngtctgtctcccccccggtgggtggaacgcgttgttataacacgcacgactgggtctcacaccccgcgcggcctaccgctcgtcccccgggagagttcgcttggggggtggggcccaagacccacaacatatttggggcctactcgtatacacgcgtgtccatattcccggctccgcttcttacgcggcgtgttcctccagaatttggaggccccccggcgtctctcgtcgcaaaccccttggaggggcggttatactatgtcgggtcagggaccccacatggtgcgcccgccctatttgacgccccgccggcgccagaaagtagtgtctgacagcagttcctcctgcacagtctgccccccccacaaaccccttgccccccccccctggggttaaaaattccccctttccccaacataaaaaaaaatcaaaccataaaaa

SEQ ID NO: 616888 - DNA, 432 bp, Homo sapiens
  misc_feature (146)..(146): n is a, c, g, or t
  misc_feature (150)..(150): n is a, c, g, or t
tcctttgtttttagagacagggtctcgctgtgtcacccaggctggagtgcagtggtgcgaccatagtttacttttctgggctcaagcaatcctccgcctcagctttctgagtagcaggactacaggcacacatcactatgcctggnttgntttaaattttttttttttttttttttttggggggagagtggggccccagggggttccccaggcggcagccgcgaatctcatccctttccgggcgtgtatttttcccacgggggtgattgcccaggggtgtcacccattctttgatggacgctggaagattttggtacccatatcccgagacggggtgcatgattcctcggggggggggtccagggaagggaagtgccgggttatcaataaagcctatctccgggttataagagagatggctaaaaagtttcc

SEQ ID NO: 616889 - DNA, 163 bp, Homo sapiens
ctcaaactgcgcccggtgaaggcggcaggcctcaggtggagcccctcgggaaaggcggcccgagagatacgcaggtgcaggtggtcgccgcatcccagccgtattgtgggaagacagatcgggcagctggtcacccacagtgcctactcgtttttcaccgaac

SEQ ID NO: 616890 - DNA, 1953 bp, Homo sapiens
  misc_feature (1)..(1): n is a, c, g, or t
ngactgtccatacggcctgcgtagctaggctatgtcgctgtggtggtttgctgtactggccgtgctggtgtggctgtgtgactgcgtataggctggtttgtgtgctggtcggtgagtgtgtgttgtctcgtcatcggtgtccttctgcgtgtccgctgtttgtgtttagcgagtgctcgtttgttgagtgtcggctgttgtggcgcgtgttgcgtgtttgtcctcggggtgctcggtcgtggtgtgtgttgttggcggctccgagttcttttggtttgtcctttgcgatctggctgactgttggtggcactgcggtgtttattcctcgccgctcgtggtgttttgtggccccagcagtggggtcttgatcgtgcggatttcgtcgtggctggcgcagctgttgtgggcacggtcatcgttgcttgtttgtgtggtccgcgtttgtacgctgcgctgtgtgaggtttcctgtgtgttgttggtcgcggttggtgtcgtcgtgggggtgtgtctgttgggtgtgggtgtgtcgtctgtggtgttgttttagttcggtgggtgtcagttggtgtgtgctgggcagcgccagcgggtgtgtgagtgtgctgccagcggtgtggtggctggtctaggtgcgcgcgttgcgacaccgtgttatgttgtttggttggattggctgcggtttgtagctctgtctctgctcgcgtgcgttggctgtggtgtgcttgtgtgtgtattggaccggcgcagcagtgcaggttgtgtattactgtcttgcgtggctggtctcgatgtgtgtgtggaggcgcgtccctggggggcgagcttgtctccctctgtgcctcgtttgggtcttgcacttagccttcggtgggggctgtcttgtccgtctcctcattcgacctcatgcggtggggtgggttgtctgtacgtatctgtggtcggtctgctggacgtagatcgctcgttgggtactctgccctgttgattattactgtctttttgttttgtgctgcgcacctcagctccgtgcggctgaggccgctgcccatctgcctgtgtgtggccccgcggcgttgtggagctacgactcacctctcgtggtgcgagtggcgctcgctctatcttccgcccgtctaggtgtcttgttgcttcttgtctgttgccgcccacagtgatgcgttctctgcggtgaggcgagggtggttttttgtgctagatagctactggggagtttgcgtcgccagtcgggtcgtgcggtgcagtcgttctcaggtgtacgaggtggcgtctcctcttggttgcgcgtcactccagcaagcgcgacacagccgagtctttttctcctctcccgctggtggtttctatgggtgctgatgcccgtgcttctggtctccgcggcttgcgtgctcctctgtgtgatgtgttctgcttctgcttgtgtgtgagattcttctgcagctgcgccgctgaggtcgtggtgttctgctcagcacggtcgtggtgggtttgtgacgaaaggatgtgtgcttagtctcacgcagcggtgtgtcgtccccgccgctgtggtggtgcgtcgcgtgatgtcgtcgtctctcacgctgtcgttccttcttctgctctcttcgtgatgagatattggtgtgtggggagtctcccccctgctcgcacgcccagcctgcgcgcgacgctgttatacgctgtgcggtgttccgcgctcgcctccgtctcctcgcacgctgctctccggcgcggtgccccagctgcctgatgtgtgtgcgtgtgtggggtgaccctacccccctcgcctgcgcgtgtgtgtgctttgttgttagagcgtgtgtctgtgtctgtctctaagtgctgttcataaccccgcctggtgtgaaacgtggtgttgcaatgtgtaaacaaatgacacctcccttcttgtcaaacaaataacaaacaaaat

SEQ ID NO: 616891 - DNA, 195 bp, Homo sapiens
taatttctggagccaaatgcaaaacaaaaatacatggcccaggttgggtgccatgactcacacctgtaatcccagcactgtgggaggctgaagtgggcagagtacttgaggtcaggagttcaagaccagcctggccagcatggtgaaactccatttctactaaaaatacgaaaatttgccaggtgtggtggcagg

SEQ ID NO: 616892 - DNA, 734 bp, Homo sapiens
  misc_feature (511)..(511): n is a, c, g, or t
gggggggggggcaggaaaaggaagtcccgcctctctctcctcgagggcagaagaaaggcggagaaaaggggaggtgaaggggagaagcgtaggtgaccactcagtgagccctccttcaacaagcccaagaaggtgagaagtgaccccaagagaggagcgtgcagaaaagcgaagaggggagggaggacattataaccacgggctccactctcgtgggcttcaccacgagtcagctcagaaaaacaatcaccccagaggtgcttcactctaaggggccgcaaaacaattaagaaaactcgcggggggccggcgtgtgaagaggggccttcgcgaaatgagggcaccgtggcaaaccaatgggtgtggcgtggaaaaaaagcgtgtgcaggggagacagtggtgggcacgtggaggttaccacacagacagtggtgggcagggggcaaagaacagaaagtatccaaagcacagctcacacaaagagacgccgttacattctctccaaagatgngttcccttggccgcggggagactctcaaagtcaattcggggggctccttgtgggagaaacccggatcacattcgcgccggggccacattataagggcgcccgccctgtgtcttggttggaacagagaacttcaacatcactttgtgtccttattagaaaaacccggtggccaatgggcgggttgacaaacttaataagacgctctgggggtttttcccaaaaa

SEQ ID NO: 616893 - DNA, 118 bp, Homo sapiens
acccaccagcacatgacccctcctgtcttgctgagcttgtgttcttcacctatgtcggggctactctacaactcctgcacatggtcaccccccatttcctaccctctagctttacccc

SEQ ID NO: 616894 - DNA, 115 bp, Homo sapiens
aaaagctaggtagtagcctgtgagtggccagcacagccagaaacaggttttttttgttgttgttgtttttacctaattccctacattgtctatcacaccagatcagctgttgtaa

SEQ ID NO: 616895 - DNA, 163 bp, Homo sapiens
agagcacaccaataaagctaaaactcactgagtagtaaaaaaactccagtagacacaaaatagactacgaaagtggactttcacatatctgaacacacaatagctaagacccaaactgggattagatacccccctactgcttacgccctacaacgcctctgaa

SEQ ID NO: 616896 - DNA, 152 bp, Homo sapiens
cgctggccggcacattgaccagatatagtggctgaacaaacaagctggaagccgcagacctgttgatattccagagtaagaaggcagtgctttccatcaccacgtggttggcagtggctccatgtatctctactgcaaggtgatccatcggt

SEQ ID NO: 616897 - DNA, 782 bp, Homo sapiens
tgaacaatgtaatgtagccaccctcgtgagaccccctgcgctggttgacgttggatgtgccgggctgagcctcggtgacctctgaaatgcctatagtgatggctgctggggacaccatgtgcctgagcctctgaagttgatgtgaatgactgtgcgatgtgagcgtgctctgctgtgagccccccgtggccctgtgaatggcctgaaccctgcccacacctgctgcctctgtaagctggccaatgaacctagtgcccttgcttaaatgccctgctaccttctgattgttgacctattgactgttgtgtgctgactgagtaactgagatcatctgatgaccatatgggcaatctgtgtggcctatgtgacgttgtgtgtcctctcgcgcctgcctgcctgtcctcacctgtgccaggcagtgttggccatcaatgcaagataccctaattgctttacgagttgttggttgaccaatttgccatatgctgggaccctacagtggatgctgaatgtatacctcaatgcactatatataacactgacaaacatacatactgccatacaatgtgacatatccttgatggcccacctggtgccctaattgtgctgaatttcaagattctttgtctaacgttgtgtacctttggacccttgtatttggaaaatgctgatcctgcatcagattcatcccagctacctacacgagccccttcactacttgggaacacggttgcgccaacttcccttgtaccaacttgcttgctgttgcctttgaagtacca

SEQ ID NO: 616898 - DNA, 182 bp, Homo sapiens
  misc_feature (22)..(22): n is a, c, g, or t
  misc_feature (27)..(27): n is a, c, g, or t
  misc_feature (172)..(172): n is a, c, g, or t
  misc_feature (177)..(177): n is a, c, g, or t
aggaacggccctgcaggagcanggtcntgccgactcccccaaccaaggaaggagccctgagtccgcctgcgcctccatccatctgtccgtcagagccggcatcttgctgtctaaagcttaactaagactccgcccggctggcctgtcagaccttactcaggggatgtttacntggtnctcgg

SEQ ID NO: 616899 - DNA, 157 bp, Homo sapiens
gatgggctggaacagtgtttgctctgacaaggatctctgcagcatggcatgagagcacctgaatgactttccagaaatgccatcatcggatgtgacacagactttagaaaaatgcctttgtgcaagaatggccggcagagggaagctactggtagag

SEQ ID NO: 616900 - DNA, 133 bp, Homo sapiens
aaggtctgagctccgttgtggcacagtggttgacgaatccgactaggaaccatgaggttgcgggttcgatccctgcccttgctcagtgttgccatgagctgtggggtaggtcgcagacgtggctcagacctcc

SEQ ID NO: 616901 - DNA, 444 bp, Homo sapiens
tgtgcccccactaccccctttctactgcctattttaaaaaaataactagtttgcgggaacggatctaaaattaaaaaaataaattttcttaaattccattataaactttaatttacatgactctaagactataaaaaaatctgagggcagcgacaaggtgctagcatttatggtaatctaataaagacctgtgagcatttgtgcaccttagtgagtgtatcagtggtggcagtgtaattttggccttgtgtaaagccgggacctggtaagaacttgaaattttatttttttttccaaggacgagctatagaaaggctatggagagtatctagtcacccggggcagtagtggagaccctggcgggtgtttgtgatgtgctccggggctttggaatggcttaatcatcaagtctagggcaattttcccttggatgtccaggtccta

SEQ ID NO: 616902 - DNA, 191 bp, Homo sapiens
ccatcccgtttcatttcagttcagttactatagctctgtagtataatttgaagtcagataatgtgattcctccagttttgttctttttgctcaggacagctttggctattctgggtcttttgtgggtccatataaattttaggattttttttctaatctttaaatctgcagtatttttaactttcctattc

SEQ ID NO: 616903 - DNA, 280 bp, Homo sapiens
ctagggtaggggacgaccaagcggctctttctacggagcagatttagaaaaacttcttgccataattttttggtgattttttcatttcccttactacaaaaaatagattcaccctcgtaatatttagagtccttttctttcagttttgtaatgagataattaagagtataaagatatattaaagacagtcaaaagaatagtagggacatagcaaaaaccttcccaggaaggttttcgaaggcaggagcaaatataaaataaaaaattaaaccagctatta

SEQ ID NO: 616904 - DNA, 144 bp, Homo sapiens
tctgggatagtaatggaagtagaatggtatgggatggagagaatggaatggagaatggaagggaatgggagggagaatggaatggaatgcagaatggagaatggaatggcaatggcagaacggaatggaatggagaatggaatg

SEQ ID NO: 616905 - DNA, 229 bp, Homo sapiens
ggccatgtgccctaggctgatattccccctaggctgcttcctgtctgccatgtgatatgccagctcttccttcagtgttccatcactgattgcaagcttcctgaggtcccaccagaagccatgcacgatctggtgcctatggctgtacatcctgcagacaccatgagcctaattaattcctcttttctttataacattacccagtcctaggggccccctaggtctgatt

SEQ ID NO: 616906 - DNA, 192 bp, Homo sapiens
agtatgacaatggaagggcaagaacacacagcagacacaaaacaagaggactagccatgggcaaaataaacagagcagattacctcaccaacatgcaagcatacgcagatacgtaaaataagtccatgaaacaggggctcagcgatcactatgtcggtgtacctgagctcgagattcgctaattcactggat

SEQ ID NO: 616907 - DNA, 259 bp, Homo sapiens
  misc_feature (41)..(41): n is a, c, g, or t
  misc_feature (66)..(66): n is a, c, g, or t
tcctttttccccccccccaaataatggcaattttttagggnaccaagggggggttttccctgaccnggttccttaaggccctttgcccccctttggccaggcctttttcaaaagggattccctcctgggggtttatcattcagctttggttgaatttttttatccccctgaaacctctccccccctttggccccaaggaaattgtttttgggggttttcccgaccccttaaaagtaaatccttttttcctttgggtgga

SEQ ID NO: 616908 - DNA, 365 bp, Homo sapiens
tgttaaccatctcagatagtcgaaaacgcagaatcctatgaaacccaaaagttcacgacgaagttcaaaaattcttccaagacctttacctcgagaaagccacttcacctctgtatttagaaagagtcctgtgtgttgacgcacccttttcctcacataaaatttttaatagtctgaattaatgtggtcaagctttaatataattgatgatttgtactgctgtggtatagcacattttttagagatgtaggcattattttacctgcacgagtgcatgtctgtataatagcacagtgactactggcgctttcgagagccacatattttattaaggtcacagcttcggcaattttccctcgtgccgt

SEQ ID NO: 616909 - DNA, 114 bp, Homo sapiens
gcagcattccagcagcgctgtggtttacaagcaatttatgcttttacctttctacttccagaggcttgtatacttattagtaagcattaatttagtgtcccctcatccgcttat

SEQ ID NO: 616910 - DNA, 375 bp, Homo sapiens
  misc_feature (219)..(219): n is a, c, g, or t
  misc_feature (229)..(229): n is a, c, g, or t
  misc_feature (235)..(235): n is a, c, g, or t
  misc_feature (246)..(246): n is a, c, g, or t
  misc_feature (250)..(250): n is a, c, g, or t
  misc_feature (370)..(370): n is a, c, g, or t
  misc_feature (372)..(372): n is a, c, g, or t
aaaacatacacattacattcaagagcttaagattaacagctgggcttctcaagaaatattatggaagttattatagaaaacaatgaaataatacagtagagctctgaaagaaaaagctgccaagctagaattctaacccagcacaagtattcttcaaaaatgaaggtaaaaataaagacattttcagatcaacaagtcctatcaagaatttgtgcacancacattcacnttacangaaaacaatanaggnagttttttaggcgaaagaaaatgattccagatagaaacatggatcactagggagaaataaaaagcaccagaagggtaaatatatgggtaaataggtactttaagctttatgagtaaaggncnttg

SEQ ID NO: 616911 - DNA, 588 bp, Homo sapiens
cacgcgtcgaaaaaaaaaaaaaaaaaaaaaaaaaaaaaaaaaaaaaaaaaaaaaaaaaaaaaaaaaaaaaaaaaaaaaaaaagggggcccccaaatttcccccgggggggcccctccccccccttttttttgaaaagggggcccccaaggggtgttattatattatatagatgcagcagaccacgcgcccggcgttattataaaaaaacagccgtctgatgaggggaaaaaagcggttcctcagcgggggcatcttttttgagagagaacgccacccctccctaccttgacgggaggaggagcagcaaccactattgtgggaaacaaactacttatcctggtagtgatatatattataagggctgctggtaagggaggtaatatatataataatattttataagagtgtcgatatacggtgggggtaacacaaagagcggcgtctaattattactgcggcgtggacagaaaaatcgttgttggctaagctggttagttgtatttttagtagaaaaatatttatttatcccgaggaggctatcttaatactaaaaatttaaaacgagcaaatatatatataaaaaaaaa

SEQ ID NO: 616912 - DNA, 819 bp, Homo sapiens
catgccccattgccctccagcctaggggacaaagcgggcccctgtttccaaaaaaaaaaaaaaaaaaaaaaaaaaaaagaagaaatcctcagcaggctgagatggaactcattcttctcatgaagaacgtggcaagcattatacagaggggccatagtctggaaagcaggagatgcttacagacatataagttgtttccagtgttttgctcttggtactcatggttccactatttacatcaaccttttgagaaacagatttatacactgtcttatacttccctcctttgctacagaatgaatctacttgtaacctaccaaaaatttaccctgtcacatttccccagctgctggtttaaaaataaatatcctggatttaaagccaattgtgtctaacaggtgccaccatccaagtgaggatttcactgttcacaggcatttgagacacaccagcggccggcggttctcactgctcttcatatggaggcaaccatatatgggtaagtcatttagtctcttaggtaggcgaactgaggccaatctccccacttttagggctgtgaaactgttctgtatgatacaataatggtggatatgcgtcactatacattcgtccaaatccacagaatgtacaacaccaagagtgaaccctactgtaaactatggactctgagtgacaatgatgcatcaaataggttcatcagttgtaataaatgcactgctctggtgcagaatgttgatgatggaggagacaggggtacatgggaatctccgtaccttccattcaattttgctaaaactactctaaaaaataaaaaaa

SEQ ID NO: 616913 - DNA, 726 bp, Homo sapiens
gatgttctgccccggctgcaggaacgcgctgatcgtggacgagggacagcgctgccaccgcttcgcctgcaacacgtgccctacgtgcacaacatcacccgcaaaggtaaccaatcggaagtacccaagaactgaaagaagtggatgatgtgattgcgtggagcagtgcctgggaaaatggtgactctactgcagagtcgtgtcccaatgcgaacatcctcatgcttacttctatgcaggttcagacccgctctgcagatgagccgatgaccagcttctacaagtgctgcaatgctcaatgtggacaccgctggagggattagggccaggatgtcccacgctggcctagtgtgtgcttgtcttgtccatcgggttagatgctaagctggcagatatgcagttgtgtgtcctgagggtcttgtgctagtgtggtggaaatgataacacgctttgaggctgaagagaccagcggggtcagagaaatattggtcctagtctgccaagagaggagtgcctgtacactcagtgaatgtctgggcagattgtactggtgttgctggagggaagacaacaaggacgccaataagctaacattactgcctcgtgttaagaggtcctatgtctgtgcatctgtccactttatcggcagtcgacagttccctttactcccaatcacgactcttaacgtagtctgtacagcttggtaaaaacttaagtagcatgtcc

SEQ ID NO: 616914 - DNA, 128 bp, Homo sapiens
tctttaaggcattgagatgtttctgtatatgcacatcaaaagcacagcacttttttctttaccttgtttatgatacagagacatttgttcacgtgtttacctgctgatcttctctccactgttatcct

SEQ ID NO: 616915 - DNA, 555 bp, Homo sapiens
ctagagaccccgaacatgtgagctatacctgtatttgtactttcacttatattggacatttctatcatccgcgtttgctattatgaagaaactatcatgagcatccatacgtggcaggccaggtctcactaacacaggcctccctaacaactgtttcagtaccgactgagtggttcaattaaatattaagaggaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattcaacgagttttatggggggtctgaagaaactccccaggcctccacaaacaagtttatgggagatctgaagggactctccaaacctctgtgatttagcaggagacaagataagggccccagcatctagacccatttagattaactgaatttaactgaggtaccagagaagggtcttcaggactcagacttatagataaaagaagttatcattatgtatttgata

SEQ ID NO: 616916 - DNA, 260 bp, Homo sapiens
ggtagctactacaagcttgaaaaagggaaggaggccaggcatggtgctcacgcttaaaatcctaagctttaggaggctgaggcaggcagattgcttgagcccaggagctcgagaccagtctgggcaacatggtgaaactccatctctacaaaaaatgcaaaaattggctggcccaggaggctgaggcaggggcatcgattgagtctgggaggtcgaggctgcagtgagccatgatcacaccagtgaaccccagcctgggc

SEQ ID NO: 616917 - DNA, 455 bp, Homo sapiens
gttcaactcttggagcacgactgcagttttttgggagggggcagcgcacccgcaagggctttcctcctctgtctttgggggaccaggggctctctcaggggctctgggggctgcgggctgtttcagccagggaggccaaaatcaagagtgagatgtagaaagttgtaaaataaaaaaagtggggtgggtgaatcggttgttctttcctccccttgggaggattgtcataagggttttagcagggtccccctttttttccccccccccttttttttttttttaatcaagagaaacttcaaagttaatggggggggggggtttcccagggtgagaactggttccccccccagcctttcatgaaaaagggggtttttttttatcatccaacctctccccctgagggggagggtttccccaacccttccaaataaaaagtaatggctttggaactgcca

SEQ ID NO: 616918 - DNA, 171 bp, Homo sapiens
cggtgataaagtctatgctgaaagatggaaagggagaagatagatccaattaaaaaaaattaaaaccaatttaaaaaaaaaaagaacacaggaaaattccagttctacttgaatttagcatcaatacagaaagtccccttctactattaacttttatacaaaaaaagttaa

SEQ ID NO: 616919 - DNA, 828 bp, Homo sapiens
tggtccacgatgttaatatgtcgaccacgcgctcgttccaggaggcggaggctgcagtgagcgttagatcatgtcacgtgcactccagcctccgcctcctgggttcaagcaattctacctcagtctcctgagtagctgggatgacaggcacgccccaccacggtccagctaatttgtttattcgggtttctgagacggagtttcatgctgctgcccaggctggagtgcagtggtgcaatcttggctcactgcagcctctgccttctgggttccaagcgattctcctgcctcagcctcccgagatagctgggactacgcccagctaattttttaatagagacggagtttcaccatgttgaccaggctggtcttgaactgacctcaggtgatcttgccacctcgggctcccaaagtgctgggattacaggcgtgagccactgtgcctggcctaatttcggtattctcgttagagacagggattcaccatgtcggcctggctgatctcaaaatcccgacctcaagtgatcctccaaactcaccctccccaaagtgctgggattataggcatgagccactggggcccgccaggcctttattgagacacgtatcgctctgtacgaccaggtaagagtgcaatgggaccaatctcggatcactgcaacctccacctctcgggttcattctggttactcctgcctcagccttcccgaggtagctcgagattgcagacgcccaccgaacatgacaagttacattccgtatctcaaatagacatggatttcaccactgtcgcccacctggtctcaaactcctgacttccgtaatccc

SEQ ID NO: 616920 - DNA, 170 bp, Homo sapiens
attaggtgatcgttacccactgagcaaatggcagggaccaaacccgcaacctcatggttcctagtcggagtcgttaaacactgcgccacgacaggaactcctagagttgaaatttttaaatttaattttatttttgtctgccatgccacaggtatggccctaaaaagacc

SEQ ID NO: 616921 - DNA, 360 bp, Homo sapiens
gcacgaatttgccacatgtgtccagtctatcagtctacggcgattactatacctgacaggcagattgcaatgtactgaattagctatcacgtggcctgccgttttggaggaaaggcaagttggattgaatatctcatcatattcttcaactagtttccgttctgttcaagaacatactccagctaccacgtggcaggcacatagttggtatcagggcattctgaaatgctgaaatgctgctctgcctatcagcttctctctgtcccagtctctccctggggaaaggctgcatggggagcaagcccctgcatgcccgaacacggagtccagatgaggcttgctgtgctcactccatccctt

SEQ ID NO: 616922 - DNA, 261 bp, Homo sapiens
tgtttatttcctgaaatttcagggtctcaacgatagttgggctcccctaaaaatttagtttttttttgggtaatcctaattcaagtaatgtttttaaagtttccctgcaaaagtttatgttccaagcccttgggcagacctgctttaaatatggcccgactccagtgagcccttaaaaaaatatgagggttttaaacgggggctttcctttgattttggccttttttgttttttcaaaaataaaaaagttggatgtggtta

SEQ ID NO: 616923 - DNA, 498 bp, Homo sapiens
tgtcatatagtcggcatctctctattgtagcttgcgattgtttgatcatgggcttgagaatgccatagctaggatcgataagatgaccccagaccttatatccaagacgatccagaatctccatatcacagtgtcaccgtggccagaaaggatccggactataatcatctgctcccctctccatagtgtgaagtatcgattgcataacatcatttggttggtctgagcccaacaacaggtaatccagggctagtccgatcaaaaatggtcagcaccatgcaattccctaaccaatagcttaggtaagtggggagtatcatacatgtgtagaggcagaacaatcagttcaccctactctaggccagaagaggtatccagtgtctggactctctacgaagccccagctcaaagacgttaaaaaaggcaactgtaaaccttctggtaagtcatattattcatctctgtcctgttcccccaagtttctgtgcagtcaagata

SEQ ID NO: 616924 - DNA, 860 bp, Homo sapiens
gtgacactggcatggaagaggtcaagcctgccgcttcgggcttctcactgcagctgggcttggacttgcggagttgcgccagtggcagatgggacgtctggagacgtttctccttcaacgtacttgggagatcactctcttagcagggtctgcgcttcgcagaccgggatgaatgctggtttccgtcgacccgtgatgtagcctgggttcggtcgccttcctaggcgtctgacaccgctcggatggagtgtcgcgtcggagtttcgaatagaagtggaagtaagtgggctctgagtcgtgggaagagggaacatgcggatgtccatgcagcatagctccacacgggctcgctgacagtgaaggccgggcctgcctcagaggcctgtattcggcgccaggacatgaggggtgcctctcgaagccccgaagacagcagtccggatgccgcccgaatccgagtcaagcgctaccaggcagagcatgaacatacttcgagggcctgcggtagcttggcatggcgtttcgggacgttgcacggttgcatgaagcgtggtagaccagatctaccaggttcacagatgaggacacagggacaacgtgcggcccgcaggagcaagatcagtccccagggcctacggtcgccggggccggcgctccctgcccgaggccggccgggtcggacgtcaggtgtcgtgctaagggcacacagcagacgggggctccgagccccgccgaagtggagagtgtgcgccagagagcgtcagagagttcaggggcgcccatggtgacagggaattagtcggcgcaagcatcccgggtggtgccttcccggggccggagggacttccgagcggtgtggg

SEQ ID NO: 616925 - DNA, 181 bp, Homo sapiens
tcagtgtatttgccagaaatggaaatgtcacgcgattgcttcggtgttctggagattttggcttttatccaccttttgtgagtgcaccaactccactcttccactccttatcattttcctggtttctttctggtctttatcttccgacacatcattcttcagcatggtggctggagggaaa

SEQ ID NO: 616926 - DNA, 255 bp, Homo sapiens
cctgaaggaaaatagtagctttttcaatgctgttctgtgtgtgtgtgagtgcctttaaatcaagtactgattaactattaagtgacaactttgtagatttttagttttaactcttcaggagccagatgctgtaaatagaaatttgggtatttctcaaagactctacagataaaactctaataaagctatatatagagtacacattcaaatgtacacacacacattttgatgtggaaatatgatacacgatgatgt

SEQ ID NO: 616927 - DNA, 314 bp, Homo sapiens
actggactggtcaagaacaaagctcatggcaatagtcttttggaatgttaaaggaatttttctagttggctttctggagggccaaagaacaacaacatctgcttattatgaaagtgttttgagaaagccaaagctttagcagaaaaacacctgggaaagcttcattagagagtccttccccatcacaacgcttctgcttattcctcttataaaacaagggcaattttgtgagagctactgacgattttcccctcgaaatttactatttctacagcttattaatctcaaatagtaagcatgtccttgccgtcact

SEQ ID NO: 616928 - DNA, 376 bp, Homo sapiens
  misc_feature (75)..(75): n is a, c, g, or t
  misc_feature (109)..(109): n is a, c, g, or t
  misc_feature (136)..(136): n is a, c, g, or t
  misc_feature (158)..(158): n is a, c, g, or t
  misc_feature (162)..(162): n is a, c, g, or t
  misc_feature (187)..(187): n is a, c, g, or t
  misc_feature (204)..(204): n is a, c, g, or t
  misc_feature (207)..(207): n is a, c, g, or t
cacggacgagtcctttatcaatatatgtctcagatttatcaactcaagtgcagccaaattctgtctctaaaaaangagtaaataaatgaataaataggccgggcacggnggctcatgcctataatcccagcacttngggaggctaaggcaggaggacngctngagcccaggagttcgagaccagccngggcaacataacaaganctngtctgtatacaaaatttaagaattagcctggcatgtgggagcccacctgtggtcccagctactggggagactgaggtgggaggattcttgagccggggaggtcgaggctgtagtgagctgcattggcaccacggcactccggccggggtgacagaacaaacccggtctc

SEQ ID NO: 616929 - DNA, 588 bp, Homo sapiens
atggccttcgtgctctctctactcatggccctggtgctggtcagctacggcccaggaggatccctgggttgtgacctgtctcagaaccacgtgctggttggcaggaagaacctcaggctcctggacgaaatgaggagactctcccctcacttttgtctgcaggacagaaaagacttcgctttaccccaggaaatggtggagggcggccagctccaggaggcccaggccatctctgtgctccatgagatgctccagcagagcttcaacctcttccacacagagcactcctctgctgcctgggacaccaccctcctggagccatgccgcactggactccatcagcagctggacaacctggatgcctgcctggggcaggtgatgggagaggaagactctgccctgggaaggacgggccccaccctggctctgaagaggtacttccagggcatccatgtctacctgaaagagaagggatacagcgactgcgcctgggaaaccgtcagactggaaatcatgagatccttctcttcattaatcagcttgcaagaaaggttaagaatgatggatggagacctgagctcaccttga

SEQ ID NO: 616930 - DNA, 680 bp, Homo sapiens
aagaggcggactagtcataaccgatctttacttaccgagatgaacaggctatcaattaacagcgcctgctcgacggggggagttgcaacaccgagaacgcaatctcgctgcgaatgactacagaaaggattctgactctggtcaggacctgtgtctgatggaaggcacgcatgctctctggattcccagaggaaacaacggcctgtagactgacgtcttaacactgctttacaaggcttaactgtcataggcacataccttggtgtagtgggcggcggacactctgcctatattgctcaggagcactggaatatctggaacgccatggaagagctcaaacagcagtaatgatcacaacagcctccttcacttttatagagagtgatgaaatcgcgcactggctctctaaacgtgagagtaacagtacgaactctctgcaccttaaactcaaggaaacatatctctgaatgctgcagcaatgtaacgcactatcccaactccgtcgcattgaccaggtgccaattgttcctcaagtgaatgcaggtgccaactgtacactctggaaagactatgcactgcttaggctaagccatttaatatgcctgaaattggaacataggtgacacagcatgatatgataatggctggaaggctctttggcctagcacatgttgctcttt

SEQ ID NO: 616931 - DNA, 381 bp, Homo sapiens
  misc_feature (5)..(5): n is a, c, g, or t
  misc_feature (12)..(12): n is a, c, g, or t
  misc_feature (16)..(16): n is a, c, g, or t
  misc_feature (19)..(19): n is a, c, g, or t
  misc_feature (22)..(22): n is a, c, g, or t
  misc_feature (24)..(24): n is a, c, g, or t
  misc_feature (36)..(36): n is a, c, g, or t
tgtgntgtatgnacgngcnatntntatgaagcacanaaggatcactcaatctagacgcgaacatctggtgtgcaaattaaagaaaacattgtacgtattaaaacagtctctgagacagtggtacaagcggtttgattcatcatgattaacatttgctacaagcgatgtgagcatgattgttgtgtttatgttaaaagccttgatgatgggtcatttatattttgttactgtatgtggatgatatgttggttgctgcacaacatatgcataagattgttagtttgaaagctttgttaagttaggagtttaatatgaaagacttctccactttcggatctcgcaaagagagaacatgttttttcctcataacaccacacaatt

SEQ ID NO: 616932 - DNA, 128 bp, Homo sapiens
cagatatatatgtacagtactcagaatataagggaatggacgatagacgaaaatgagatactctttagtgagtacagaattagaagaaaaaaaagaagaggggtagagcagtgccagaggcaaacggg

SEQ ID NO: 616933 - DNA, 988 bp, Homo sapiens
  misc_feature (1)..(1): n is a, c, g, or t
  misc_feature (77)..(77): n is a, c, g, or t
  misc_feature (133)..(133): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (200)..(200): n is a, c, g, or t
  misc_feature (251)..(252): n is a, c, g, or t
  misc_feature (254)..(254): n is a, c, g, or t
  misc_feature (276)..(277): n is a, c, g, or t
  misc_feature (284)..(284): n is a, c, g, or t
  misc_feature (290)..(291): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (319)..(319): n is a, c, g, or t
  misc_feature (321)..(321): n is a, c, g, or t
  misc_feature (323)..(326): n is a, c, g, or t
  misc_feature (332)..(332): n is a, c, g, or t
  misc_feature (334)..(334): n is a, c, g, or t
  misc_feature (337)..(337): n is a, c, g, or t
  misc_feature (340)..(340): n is a, c, g, or t
  misc_feature (352)..(352): n is a, c, g, or t
  misc_feature (354)..(354): n is a, c, g, or t
  misc_feature (356)..(356): n is a, c, g, or t
  misc_feature (359)..(360): n is a, c, g, or t
  misc_feature (374)..(374): n is a, c, g, or t
  misc_feature (391)..(391): n is a, c, g, or t
  misc_feature (396)..(396): n is a, c, g, or t
  misc_feature (399)..(399): n is a, c, g, or t
  misc_feature (413)..(413): n is a, c, g, or t
  misc_feature (422)..(422): n is a, c, g, or t
  misc_feature (434)..(436): n is a, c, g, or t
  misc_feature (450)..(455): n is a, c, g, or t
  misc_feature (467)..(467): n is a, c, g, or t
  misc_feature (504)..(504): n is a, c, g, or t
  misc_feature (532)..(532): n is a, c, g, or t
  misc_feature (539)..(539): n is a, c, g, or t
  misc_feature (601)..(601): n is a, c, g, or t
  misc_feature (604)..(605): n is a, c, g, or t
  misc_feature (726)..(726): n is a, c, g, or t
  misc_feature (910)..(910): n is a, c, g, or t
  misc_feature (981)..(981): n is a, c, g, or t
nggaaataaagttttatcaatttaataaaaaaattttacaacataacatggggaggtaataatttgatatctatatnatagtatttattttgaaaaatattcccagcttgagggtaaaacaattaattttgcnttccaaactctagaatcatgattttcatgtgagcctaatgcagaattacagcaganaancnaaaacnttttcattaatttcctttgtcattaaatcaataaaatctttgactgccacnngnctcctttaacaatatatatttnnctccccnattggnnccatattgcnaangcngccttatatacncncnnnncccaancncancanatactgtataanancnaanngccaacattgagtngtaacatttatatttancttanggntttaatggattttnacctttgcngacacccaaaannnaaataaaataaatnnnnnnctgactgtcccngacttaaatgatggctacagggataaacacggaaggnagccttgccaagttaatcactgccaatngtaaatnatgactgccaaaaacaaacagaagtttttttcttttaaaggaaaccatagagcagtcctganaannatttcttcctagtcctgcacaggataattacagcagaagacatgggaaaagtcccatggcaatcaccaattgcttaaagaggttttgttacaataaaaatttggatagtataatagcagtnttgctggaacattagcaaaagtatatacattccagttacctttgatttagccataatcacatatgtatgcttttttttttcttggacaaaaatatatatttttataaaaaactgatcatccaactttaatgatttcatatatggactcaagagtggtagtaaaaggaacagacccaattatganaaggcgatccagggacagaaaaatcaagttcctcaggaaaagaaagtataaattagagattcaacacattnttcagcc

SEQ ID NO: 616934 - DNA, 142 bp, Homo sapiens
gtcaccagaggcagctctgcggcggagcgctcaggctcagtccagcctggaggcaggctctctacagctcgtcttggctggccggggacatcttcctcctcatcttcctccttgtcctcctcatcctcctcatcctcatctt

SEQ ID NO: 616935 - DNA, 362 bp, Homo sapiens
tacaccatccccacctccacctacattaaccacatatcctaatactgaatatcaaaacattctaagtccctaaaaatattaaaggaagccccaggacttacaattgagtccctggtggtttgtggtttgtgggttcaaaattacacagcactcctgcactcctgcacttcttgctgcttgcaatctccaggaacctactagtcaaagcagcatctggtctagatggcacctgcagctctcctctacaggatactcttagcaacctcatttcctacagtggttgtagcgtggtgcaccagggggcttgttgaacagatcaacactgctctaataaagttcccatccttaatgaaaaaaaaaaa

SEQ ID NO: 616936 - DNA, 947 bp, Homo sapiens
atctgcattacactttctgaataaaagtgaagatcatgggtgattaaggatattgaaagagaagacatgaattcatttgtaagacaatggaaccaagccaattggtcaatagtgagcaactgggttgggtcctaatagtgcatctcaaatatactagagccttaacctatccttgccatctatagttactgcagcctttctcgtctgcgcaccattgcattcgcgctcctcgccgtacgagcatgtcgagtcgcacattcgctaaggctagcactgtgactcaagctgcgccacgtgacttcgagttgacaaagctgttgtcactgcaactacagggttaaacactgtttcataaagtcagtcacgcaaatgcgagagctttggcatctatatttttaggctcgaataagtttgtaatgactcgattccgtttcgatcttactcaagatgacgatagaggagagggaaacgaataagtaacagagatggacaatagtaagaagagaacgtgaataagaaacagaaagagcaagggatacggcacacccacagcacaacacggtggcgagccggcaatggcgaccaacaaataacgggaacaccgtagcacccttccagccctcaactacggcggccagcacaaaccatggcgcgcacagatgtgggttcatatgacacaacattccccatcaacgctaagcaccgccacgaacgcgtggcacacaccacacgccaggcgagggaggcctaactcagacaacgggctacacaaccaccacccacaccggccaacaacactaccaaaacccccgacagaaacatacatgcacccggattcgtaaggcccgtctcccaacaacacgtatcatcagccatggacaaaaccaatgcgcaccacactcgcaacacccccggtcaactcgcaccaggggaggaaggcaaaaaag

SEQ ID NO: 616937 - DNA, 932 bp, Homo sapiens
  misc_feature (298)..(298): n is a, c, g, or t
agcggttagagagtaatgaatcaggtggagctgaatgatggtcggtcagtcttgtatggctatagtgtgtatgatccggtttgttgcctgttaagtgtccagtttgctccagtccacaacttcgtcttggaacgagctatctattggctatccgattccggaattgtggcatcagtagttaactgtgcattggaatatatcgacattgcgacatcacattatagtatggcgtaccgttagtatttgggagtatcagatgtccttcctggtgactgatatgcatcgtggtagtgtatcnctaccaccaagacattcataaactagattcgccaattaactcgtaatgactaattagtgacatcaaggtgcggaataaagtcgaggagtaaggagccggaattccctccatccatctctatagtatactatcgccatttgcgaatatgggtcatcaagcataattgctcagtttcatttgccttgttcggtcatcaacatattgtagagatatgttctatgtctaaatcatgctgaccagatagaatagtgctttagacttagggattgatacactcagggaattctacatataaagacggtggttgtgatacaacttttggggaactcgaatctaagcctgtttgctcgtggctgtagtctatatgtaacgtggagtttgatgcgtctcgcatgtttacttagagtgctttggaattcgctagccaagtagtcttggtgatttgccagaagtgccaagtattcctgatctattgtatataggaattatgccattcctgtcattcatgtgcagtggaattggtggttaatggtagacgaatacatatctaagaagagcgagttaggttgtaaaataaacagaaaattttaacttaatacacaaggatccagatgctagagtatctggagatcaa

SEQ ID NO: 616938 - DNA, 111 bp, Homo sapiens
ggaatcacactggatcaaccgcgacgtttcgttctctcgaatggccatgcatgtgcgttgcagtacatcatgctgcatctcatgggttacgacctgacgatggatgacctg

SEQ ID NO: 616939 - DNA, 863 bp, Homo sapiens
ggcgccaggtggtaagccgtcgggcggcttttggacatggcgactttttctggcccggcttggccagttcctgtcgctttaattccggcacgacaacgattgtcgagtttacacaaggacgcgttggcgcaggtttcggcacaggccgcattatcgcacacgcggaaaaaagatgcagggaacccaagtttttacttcctgggaagtaacgttcaaattgttgccgccaaatcaaaaactaaagaccatacttttgaagtgaaacgaccgcacaaggaaattccttttgcgccaaataaatttgtcacttccccgcaagatgtgtggcgccacctgtgggttgaaacccacggggtatctcccagtgcactgtggtcccctcaatggaaatcgttctttacaccacgggggtgcacacgtggcgaacaaatatgttacgcaccaaaggggggcctatactgccacaacttttggtgattcgacacagttatgtggcaagtctccgttgaagcgaacacattgtttgtggacccaaacgagagttagagcttagcgggcatgtggaaaccagcccctatagtgttgggcactaccacaatgttgttacacccacgtgtgatctggtgcaggacgtgcacaacacagagcgcaacccaatcactgttggcgacgcagcgtatgggcatcccacacttcttagttaaaacatgttgcgcccaacagccttgttgtgaaacaaacacagtgcgtttaccgatagtaacacaaccaggaaacacctctgtctacttttcatcaacgacagcgcacctgtggggcgaacaactatacattttccccacagtttataaaacacgtcctag

SEQ ID NO: 616940 - DNA, 115 bp, Homo sapiens
tggtccatcctctctgcgagcttctccttctaattctgatccagtcagaaataagattttttgagtaacaaatcaatcagatcagactctgacacaaaaacaaacaaacacacac

SEQ ID NO: 616941 - DNA, 359 bp, Homo sapiens
  misc_feature (338)..(338): n is a, c, g, or t
  misc_feature (340)..(340): n is a, c, g, or t
agaaattgaaaccaaaaattaatagaacctaaaaccataagtttagccaagatcctcaggatatgaggtcaacatgcaaaaatcaattgtacagtatttcctatatactaacagcaagcaatcggaaacatttttatcccatttgtaatagtgtcaaaaataaaatgcctcaggaataaatttgacaaaagacatgcaaaatatgttgaaaactacaaaacatgggctgggtgtggtggctcacacctgtaatcccagcactttgggaggctgaggcaggaggatcgtttgaactcaggagttgtagaccagcctgggcaacatggtgaaaccctgtnancttgcaaacatacaaaaaa

SEQ ID NO: 616942 - DNA, 427 bp, Homo sapiens
cattactatgtacaggaactgatttccaatcgattagtaattaccaatatacacccatacctggagggttcaggacagagaacagggcctctgaggaaagcaaagccatgaaacaatatctatagttatctgggtacataaatagtactagctggagctgactgcatttccttccagagcagctttgaagtgaaaatcatacacaatgtcatgtgtagactaacctgagccgaactgcctttccaggatattcctaaagtgcttttaacgatagtaggtaatacagattacatggtcatttaaaaagttttattggcttaagtgtttcgaataaatcggctttaaaattgaacagtagtataggctctccagctggtgtttagtttcgtttggctttgagtgacatgtagctgatccccaggtatta

SEQ ID NO: 616943 - DNA, 266 bp, Homo sapiens
agaccaaacagtgccgcatgggcgtatgaacagacatatagacctagggaacagggagcccacaaataaattctcacatatgtgggcaactgactttcaacaagtgggccccaacaattcaatatagaaagtgtagtctttgacaaatggggctggaaaaactggatatctacacgcaaaaaaaattttccttataaaaagagattaatcatatgccaaagtcaagggccgatggatcaaagtaataacaacctacctaaagctat

SEQ ID NO: 616944 - DNA, 377 bp, Homo sapiens
gttaccggcagagtctcaagggctctcagggggatattccacaaaaaggtttggggcatgtccggggtttagtcgggtccacttcaattcctcttccctttccccttcttcttccctaccccttcttcttggtctctctcgcttacagaaataagggctccagtaagggacgtacattttcttcccccatactcctcttctcagtagacccactcactcacttccactcatcactcagagtcgggccacagttggtgctcatgtgtcgtgtctcataactcaggtcggcaactctgatgacgggccatagcgagcacggggcccttcggggtaccggggcccggcagagaacagcaaggtctctccagggtcagcgg

SEQ ID NO: 616945 - DNA, 169 bp, Homo sapiens
atataaaccctcaaaacggaagatacattgataaaaatgtagcattgtaagcgaaaaaatattgtacagtacttgcagaatttatctttcaatttaaggttacaatgtgcctaacaaataaatagtacttaaaattatagttctcattattaatttaaaataaccatca

SEQ ID NO: 616946 - DNA, 182 bp, Homo sapiens
agcggtccagtatagcaggaggatattgaggcaggagctctgcccgtgactgtatccacgtactctatcttccattcctcgccctgcccacagaggccaggagctctgcccttgtactgtattccacttactccaccttccattcctcgccctgtgcccacagccgagtcctgcttattcct

SEQ ID NO: 616947 - DNA, 163 bp, Homo sapiens
cccccgggcccttttttttgggggggttttaccccaacttttcccccaaaattccccagtggtaggaaggggggggggccaagggatttttttcttggtccttaagtttccaaaccttttttcttcaagggaaaccctttcccctgttggggcggtttgccca

SEQ ID NO: 616948 - DNA, 197 bp, Homo sapiens
ctgggaaggctgcagtgcagataggatcaaagcaagcagaggaacatggaagggctagactggctaagtcttctggcctccatctttctccattactggatgctacctgccctcgaacatcagactccaagtcttcagcttttggactcttggacctacaccaggtgctctcagaccttcagccacagactaaaggc

SEQ ID NO: 616949 - DNA, 142 bp, Homo sapiens
ccccccccgggggcccccagccccccccctgtccccgggagcgggggaagggggggttggccctttcctggcccggggttgctgccctcctgggggttttttggtcccccccccgggttctggaattacccgttttttttta

SEQ ID NO: 616950 - DNA, 167 bp, Homo sapiens
tgcactgtagatcgctccatctgtgaaggtgacttctataagagtaaattgccttgttgagaaaaaaaaaaagaaaatcttatattcgagtgctatttcttttgggggcaccgaaactttatacaacattttgggggcttgccttgtgattacatttcccctccggg

SEQ ID NO: 616951 - DNA, 324 bp, Homo sapiens
taaccaaccgacatctcacgatgaacccagagcagtgagcattcacttcttcctgatgatagcaccaagccatcttagagggatctggtcccatgacccaagacatctcccactagacccatctcccacccattgcacggtcacatttcaatcatgagatttggaggggacagaacatctaaaccatgttcactgcattcaattcatttggaactccatgcagtcagtattttttttcatggcaaatatatgttacgtagtagtccttttctaagctaccaaagactataatggcaagtaatggttcatatatttgctttgcct

SEQ ID NO: 616952 - DNA, 628 bp, Homo sapiens
aacggggcagccatgtggtacccctaggaaacctacccgctagtcctaagggtagttaagtgtgataggccgggttgacagctgcaaagctaggacacagcctagtagcatctcccaactacaacactgtggtgttcacggccaatgttatcaaaggagtgtagaatttggaagcaggcatcttaaacataggctccgtgtggaatatatgaggctactgagggcatgttcaggttgctgtctacaactatggtgaggaaataatactgcgcaatcgcctataggacactgtctttaaacttgattggtcttcaggtgcccgtgtctgtgactccttcctgccataagggggttgtttagacctgggaggttaccgaaaaggggtgtaggttcgggtagcgcaaaatgcactaggatctacaaaacaccaactagtgctcccaccaaaaacgtgggatccgtgcacgttaacgattactaggactatgcaaaaacctgtggtcgtccttagtctcctggatgagcgcccgcgcgcgcttcgtctgcggcgccggcgcttctcccgccactcctttctactcccgtccctcacgcctccgctcgctcctcggggcgctcttgctgctgt

SEQ ID NO: 616953 - DNA, 630 bp, Homo sapiens
  misc_feature (1)..(1): n is a, c, g, or t
ngaggagttcccgcaacagataactgtctggcccaaaaatgacaaactgtggagtctggggcactctgctccagttccagcagactgttgtccatcctccgtacccaccattcacctattactccaaatatgtatggcacagactcagactacatattactgacctccttatttcagaactgtgcacaaacaatatcctcagtccttcatgaagaccaagaatgggtcaaatggaaagaggcttgtggctattactactaggactatgaaattaaataggaaagcctcacataaatagaaatttcaatagtttgcttttagagggaaaaagaatgatcaaatctagttccatcttctgcacagtttacacagactaaccccaaggcctaccccttctcacatatgttgcatcccatcttcttccccttcttaaatacttcactcctgcaaagagggagtgcaatgaatcctcctttctcctccaatcattactttcttcctgtcttttgagtcatccctatccatacacaagaacgctgtggtatctctcatcttcaaaacaaaacaaagccctctcctttgactccacacccgtctacaggacgtgttccactgcacagcagatcttct

SEQ ID NO: 616954 - DNA, 219 bp, Homo sapiens
  misc_feature (166)..(167): n is a, c, g, or t
  misc_feature (191)..(191): n is a, c, g, or t
agagatccttggggccttaacctgagtgggggtctcgcaattccctaatgagattccaccccaatatcatcaggcactttcccccttatcaactagccctagctatacctctgctgccaagaaaatgagcccaaccagtacaccaggagtggggctccatatcagnnccctaaggtcaagcctgtgtccanctgtgggctcattttcttgtggcagcag

SEQ ID NO: 616955 - DNA, 433 bp, Homo sapiens
ctactgcagctatccaagtcttttgttccctcaaatactcttacctctgagctatgtacatgccgatcacctcctcagaatgtgctgtcctggctcttggctgatggtctttcccagtgaactcatctgggcttctgtatttaccaccacacagctaggttagatgtcctgtctccttatttttcagtacatactgtgtttagccgtgttaaaattcttggcacactgaagtctaattgctgagttaattctgtgtgagccctttagaagcatgttgagagcagtagctaatgttttaaattcatcatacgtgtgcatagatctcaaggcagggcctggcagaatgggagtacttaggaggaaatttttactcagggaaagtgggttttcacgcagtaaaatatgtgctacgggtggggcacggtatctggta

SEQ ID NO: 616956 - DNA, 186 bp, Homo sapiens
aagctccaacaagaaaaacaaaacaaaaacattctcttaaataaccatgagacaattatcataactgtaaaattaaataacatggaaacagtactgctagtctaacctacagacctttttatttgtcttttattttattattattattactatttagagatagagtttcgctcttgattgggagct

SEQ ID NO: 616957 - DNA, 715 bp, Homo sapiens
tggtaaacggggtctggctggtttggcgcaggtcgggtctgggcacttcttgggcctcaagcgattctcccaacctccagcctcctaaataatggccaggtatttatagggcttgagccaccaagccgtgacccctcttctttgggcttattattctccgtggttctccctccacattgaacgcaggcctccagtgaaggagaggaacgttgtcagtttaggtgccgcgccagcgtttctccagtggcgtcaacttcatcacacaacaccagcgagggcccaattttaaatttagagggtgcatgggtgtaatggaaaagacatgtaatacgcaaaagaagggtgctccagtggctggaaatggatttccacagggatgggtctctggtgatcttccccagtacgccaggggacgccctttggtctggcccatctggttggcctgggcacgcaagaagcctggtcccgaacactctgggcattgaatgatgtgcccgattgggactccgtggggggcctttcagaaccggtgtggagttcagactgggtcttaggggcccccatacccagggtgtgctggggagggggcaaacatctactcctttttaaggcgtgaatagacccttctggaagcgtgatatccctgtgggacatattctattcaatggggacagattctcgtctgtgtaccccaggctgggaaggagggtccctt

SEQ ID NO: 616958 - DNA, 268 bp, Homo sapiens
ttggcgcgagcacagtgattacaacctccatatactattctctgattgctttggctaagctctagaattggccatctcacctggcttattgcacccataagttatagtaaatcatcatcaataactcctgcgatgtctctgctgctggaaacagcagatacaaaacccaaagtctatgaaatgtaggttctagcggccgggccaggggaggaggaggacaggccatttgcaaatgagcacgcacatttctgcgatcggtctggtgcat

SEQ ID NO: 616959 - DNA, 174 bp, Homo sapiens
tagaggatccccagtttccagagtagggattcaatctttaaaaaagaagtatggctggcaggcatagtggctcacacctgtaaccccagtactctgggaggctgaggtacatggattgcctgaactcaggagtttgagaccagtctgaccaacgtggggctctaccaaaaatac

SEQ ID NO: 616960 - DNA, 149 bp, Homo sapiens
ttttacagcgaacatcataagtaggacagtgcttctgacaggaatggacggcatacagatggatgaagaacttgtggagagactataattaacattcacttccaacgggcaaagaatggaggtggagaagtagatatggtcaagtgttc

SEQ ID NO: 616961 - DNA, 492 bp, Homo sapiens
ctccgagctcgcgcacatcacgacatttattattcacaaatccgaacccatgatctaccgaaaactcttttaaacagaatccccaaaaagacaattttacctaaagatccgcgtctcccccgccggagatttctatttttccattcttcctcttttataacataacccggtgaagccgccgagaccgaccacgttcgcgcgagccggcatcctgtcactatcctccaaagagatgaacaacgagatgagagggtccttatcccgctgttccgcggacctgcgacactcgtaccacacctctgctccccgaccggacagacacggtcacgccagacgagcagatggatacgaccccagtaatctgcgagccgtaaagaagctaactattaacaaattaccggttagattctacctggtacccatcatgacggcaattggacagtcaccaccagagaacaacaagataaacacaccaaagaagaacaagaagac

SEQ ID NO: 616962 - DNA, 168 bp, Homo sapiens
aaaaaagggaattttttttgggaaaaaaaaaaacctggcggaaaaactgggggcaaagtttggtttctccaaaggtttttttggttttcggggtttttcccccccccccttttaattgttttaaacccctttttttttttaaaaaaaggggggcctttggccccttta

SEQ ID NO: 616963 - DNA, 287 bp, Homo sapiens
ccctcatgcagtgctggcatgcagtgtacaacattgtcatcctgggaggacaagcagtacatcgtcgtgcgggaggctctgatgctcttcaagagcatcttggaacaacagatggctgcgcaccatctctgtgatcctgttgctcaacaagccagatctgctcgctgcgaaagtccttgcttgggaaatctgaagatttgcaggactactttccgagaattttgctctgctaaatgtacgtccatgcaggattggtacgtccctgagccgctggtggaggacccgac

SEQ ID NO: 616964 - DNA, 255 bp, Homo sapiens
aaaaaagatatacttttatagtttcagctaacaagcagatggtcgtctttacttatttctgttttgtattgctgtatgaccgatcagcatgataggaacccaaattagcttgttgtctgcaaagcaatggtgtagccatgggaggaaatcttttgctgtatgtgtgtatattagagagagtgcatgtttatgcacttaaatacacacacatacacacacacacacagagtccaggttctagatcgcgagcggccg

SEQ ID NO: 616965 - DNA, 119 bp, Homo sapiens
accttagattattcagctagtatcatactgaatggggaaaaactgaaagcctttcttctaagatctacaacaagacaagagtgcccactgttattcaactggaagtactggaagaccta

SEQ ID NO: 616966 - DNA, 94 bp, Homo sapiens
ggggatgcaggtgaagctgaggacagctcccaggagggcggcaggcagccaggatggccgggcactgactggcaataaactcctactaaatccc

SEQ ID NO: 616967 - DNA, 357 bp, Homo sapiens
gctacttggcaggctgaggcaggagaattgcttgggcccgggagttttgaggctgcagttaagctgtgattgcaccaaaatactccagccttgggtgacaaagttagattcttagtcaatcaatcagtcagtgaaaaatccctttcattcattcattcattcattcattcattcattcaccacccggtgtttttacaggttcaagagatcacattttggaggcttcaatgggtccctgtgaaatgtaaacctttactcttttggtgtaatcccccaagtgtgtctctagggggcacagcccacggcgactctatatatctctctaaatttctctgcaatcaaactctgtttaaacaa

SEQ ID NO: 616968 - DNA, 113 bp, Homo sapiens
aggagaaagcccatatgatgaatgctattaagaaatatcagaaaggcttctctgataaactggttttccttgagggagatcagaaacctctggcacagcacaagaaggcagga

SEQ ID NO: 616969 - DNA, 989 bp, Homo sapiens
aagtagtcgtgctgagcaggttattctcgctcctcaagtgagattgcatttaagcaaatcactactgtcatcagactcaggatgatttcccctctccattcatatgagtgaagcaatcagtggcactcatacatcatcattctgaacacagcttcaaagcagagcaacccatattcgtagctcgttgcgcacatagctgggttcttgcgggccacactcttgttgcaatcattggcatctccatattaacatctgcataacagccgagagggcataatcacttacaacattgtcctaattcatctcgatcccacaatgcgatgctgggtgagacacccaaggacttacgatagttagagaagctaatgtactgtttggttatgggctcacttcccatgatctccgtggaaaatttcctggggactataaaacacgtacaagccgtataagtaaaaggacagtacgtattgccattgattctctgcgttccttaggattcgcgacggcatgtcatttgccctctataccgtttgaggcaattgttcctttcatctcccttaaagaaggttcacccttaatgtcacttggattcgcggcatagttaaaagctaaagttcggtacttgggcgttatttggacttaggttcccccattggtcagttctccgcttttactctcgtggctttcccctttgtccttttgccctgggtctctggattcttcggcttgggctggaagacgcgatctctaaactaacggtttgaaccttatggtatattaccttaatccttaagggtttccacttctccaaggagggcaaaatgttccaaaaggtttatacagcggtttgtcacaacaacttggtttccatcccttaatggatgccaacgcttgtaatcggggtagtttgacacacattggttccaatccctttgctttaccactttttttaacggattgtaacctttaagtttcttatccgcaaagaa

SEQ ID NO: 616970 - DNA, 299 bp, Homo sapiens
cagcctcgatgtcgctgggatacggcatacgccaccgatgcctggctacattttttgtgatttttttggtgaaatggggtttccccctgttggtccagcgcagtcttccaactcctgtacctcaggtaacccattcggcttgggctccccaagttgtgggattacaggcgtgcaacggcgtgcctgggcaatggtatccatttctaaagtgcccacagctatttggacgcgtgaagggtcggggtcaacggcggggactctaggaggagacccggggctggctcacagacccgggaagg

SEQ ID NO: 616971 - DNA, 135 bp, Homo sapiens
aggctcgggaggcacctgccacccagggcttatctactacttagctgacttatttccaggttcttgcagctggaaacaagggtcttgcagcttacaaccaggaacaggatgctgaaccgcagggtgtgtacaaat

SEQ ID NO: 616972 - DNA, 125 bp, Homo sapiens
  misc_feature (22)..(22): n is a, c, g, or t
  misc_feature (59)..(59): n is a, c, g, or t
  misc_feature (73)..(73): n is a, c, g, or t
cctttcatcatgggtgagggtngatagcggaagctttctatctcgggctttcacatagnaggcctcttgaaangcagcttctaatgacccaataggaaatacaggatggcaatcaccatatcttg

SEQ ID NO: 616973 - DNA, 620 bp, Homo sapiens
tggtctccaagatgaatgctcatctttggagggtgccaggtagaagctagggaggggagtgtcttctctctccatgattcaccttgcagtgagcccaagttagaagggtctggcgggggtagtgccttacacatgcttgattaccacactaccccctggcttgggatgtgagtggaataaattatctctcgttaaggctaaaacacactcattatggcccctttggcctcaacggcggaactgtgaggacgattccctttacaaagggataatccataacctcgcccactaactcctgacctttcacactacggtttcaactatcggataacataactcactgatgcgcttcctcttattaccaaccacatgcgccactctttgatacaccttgtgattgacggtgtgtatatagtctctaacccgtaatcactctttgcatcctcctttcttcaacaggactcctcacacgcgcaagcctcgtaacattccaccccaagtccgttttccacctaaccaaatcccactactagcatacaccagttaagccttaccaaaccccagcgctatacttttcccatcttttaattcacctcaaatccacctaaactcttgaccat

SEQ ID NO: 616974 - DNA, 358 bp, Homo sapiens
tagaaacatgtatcctttggaaaattttgaaagtcacagcatggtctcacattggtcattataaagctgaagcaggctgggccctgtggttcacgcctgtaatcccagcactttgggaggctgacgtgggtggatcacgaggtcagaagttcaagatgagcctggccaaaatggtgaaacccagtctctactgaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctcaaaaa

SEQ ID NO: 616975 - DNA, 566 bp, Homo sapiens
ggtgtctccatagatatcgcgttaggtcagacaccagtagaagccggcgtcccggctggtgagctggttgagtgatgacagtgaaggtgcctgttgttctggctcctccagcagggagaggcggccctcgtactgagccttaacccacccctcgctgcacaccagcaggtggcagcgtccattctgttgcccctatcccagagacaccagtacttgatgcttttgctattccttacggtatctaggggcagagcacggccacagagcctcctgccacccccttcaccacagatggggctgcggggaatcgtggactcctcattgacgaagagttgccaggcctggataggcgagcctatcctgcagctgaccatccgaatgggctccacacaggtagcgccctgcatcctcctacctcaggcctgtgatacaccacactgaatgagccatccttgtcctgggggttgagcaggatcctgccctcaaaggctagggccctcttccccagggtgaagagaatatagagcgaaagggtaaccgagctcgaaattacgtatcatggcata

SEQ ID NO: 616976 - DNA, 233 bp, Homo sapiens
ggaggtgaagcaggagaatcacttgagcctaggaggtggaggttgcagtgagccgaggtcgcaccattgtactgtagcctgggcaacaagactgaaactccttcaaaaaaagagaacaaaatgggatccaagtacatgaatagttgaaattaacctagggttggcgtgttactaaaacagaggacacgacacggacacttttataactacttttccccgacgacctgacttgt

SEQ ID NO: 616977 - DNA, 950 bp, Homo sapiens
  misc_feature (639)..(639): n is a, c, g, or t
gcacgatgaggctgttgtcattggtggtgtggctctacttgtgcgtgtctagcgtcgaagcatgaggataggagccaggcttttgggtttcgcaagatcgacttgcgtgaagcaggatatcgcgcggtggcagggatcgaggaccctgagccttggcagtagcaagcatctagcaagtggttggctcgaaggtgcgtgcagtgtacggacggtggtaacgtagtcgtgattgacttgccttccactctcagggaacgagcttttggggtcaattggatgtccttggagattgacatcatactggtcaaaggtgggatccaggacttgtcctcctgtgtacgcaaatagatctacaccaacaacgtaggtgagttcgcattgtctgctccctcttgcaagggccttggttctacctatatgcgaatcgtatcaatccctcgagacgaaatcaaagttgtaccatgtagcccatgagacgccaaggagcacgcggagtgcgggcgccccgattggtgaaccttggctttccataagccaaagtgactactcatgcgtaacacggggaagagataactccctgggccctccagctcgggaacgtgtggaacgatggagcgaatgtttctttccaccgttcantttgtgtccttggaaagcttggggtcacgacccgtttgtgggaggctacactgaagcgccctatacgccttctcaatacgtcggtattctcccgcctcgtgggcctaaataagggtcgagaatcatcgtcgccgaggacacacaggaggagatccagagtcatttggaacccaccgtacccccataggataccggcaaagtgaacagaaagcttggagaattatgggggcggcctcttcccgaagccaagtgcttcgcttgcccttgcgttctcgcgacaggaacaaaatccccaattgtcttccccctac

SEQ ID NO: 616978 - DNA, 330 bp, Homo sapiens
  misc_feature (138)..(138): n is a, c, g, or t
accacaatcaccctactgtgcaatagaacaccagagtttactcctcctttccatctgtagcttcagacccattgaccaatctctccccttcgcccccaccaccccccccccgctgtcaccactctcctcccccccccngcaagaggcttgaatcttgaaggagcacatcagatagaaagagggaaatcaactgggacatggtttgttggaagtggggtggaatctggtttgtttacagtttcagagtttgaggcatcaaaagtgtatgtcattgcccaaaagtatttaacagctttctatgttttaggaattcactagaaataaggcatg

SEQ ID NO: 616979 - DNA, 800 bp, Homo sapiens
  misc_feature (1)..(1): n is a, c, g, or t
ncggtgtattaatataaaacaaacatcttcttttttgttttgatctctctcactctctactgttcgtcccgcagaagagcagaccgcaccccctcctcttcgttgcttctccactcctcacaaaaaaacactcgcgtacggatggagtcatccaccccgcgcctccgcggatctatttatccacgtttgccggcggggcggagagagatatgaatctattttcctgctccgctcgcggtagaattttatttttccgtgtctgcggcgtgtctttttgttgtggcgcgcgcctactctgaatctgctgcttctttttttcgctcctataacactctcgcgtggcgcgtggttggtctccccgcgcggagtgtatgtctccgcgcgcgtgtttttttctgcgtgtggggttttgcgcgcccctctctctctcctccttcccccccgactgaatacaacccacccacgaagaaataaatatattaataatataacacaccacacacacacatctcaatcatcttctgcgtcccccccacctctctctctgtactatcatacacaccccccacctaactactccaccaccccctctctctttctctctccccccctctctctttttttttatcccccccccccacatactcccccccccccatctatctctccaaaaaaattttttcccaccacatcattttttgagatgagagaatgttttaaaaaacaaaaaataaaaataatctcctctctttttttttttttcttgtgcccccccctttcggtccttttttttcctccca

SEQ ID NO: 616980 - DNA, 316 bp, Homo sapiens
aggggttaaaaaaaaggccttttaaaaagggtttttcctggaccaaccttttttttttttaaaaaaaaaaaggcggccctgaaaaaaaagggaaacctaccttttggggggttggggcttttttcccccccctccgggggaaccctttttaaaccgggggaactaaatctagggggtcccgggggtttttggcttttttttttttccccgggaaagaaaaaattaagggttgtcgggaaaatccctgtattttgggaaataaaaatcggggggaaagggtggttctttgttccccaagtttttgggggccttttcc

SEQ ID NO: 616981 - DNA, 565 bp, Homo sapiens
  misc_feature (441)..(441): n is a, c, g, or t
  misc_feature (475)..(475): n is a, c, g, or t
  misc_feature (479)..(480): n is a, c, g, or t
  misc_feature (483)..(483): n is a, c, g, or t
  misc_feature (485)..(485): n is a, c, g, or t
  misc_feature (488)..(488): n is a, c, g, or t
  misc_feature (490)..(491): n is a, c, g, or t
  misc_feature (495)..(495): n is a, c, g, or t
  misc_feature (511)..(511): n is a, c, g, or t
  misc_feature (565)..(565): n is a, c, g, or t
tggtctataaatacacgtgttgggtgagtgaggggcaacaaaaggcaaaaagatggcgctgtacacagctggtataggcttggagggtggaacgccaaaaaagacagacacacagacagctccgcccagcagggcaggccgggcagcattcggggggcttgttaacactgggtggggtggggcagaagagccagacaggaggctccggcccggggcgtggaggggccagaggcaaccccgaaggcctccaaggtctccagaggctcctgtgggtgtggcatctcaggtgggtggccgccgtgggctctcagcttcacattcatttcaggggccttggcggggcaaacctcgggcagcacaaaggcgggcgcgggtgcaccgtcggagagttgtgtagatacttcagctggcattctggcgcccacctggctggctggtgtntcagcgggttggcacccgggctcctggagaagtncggnngcncnggngnncctnggctggacacagcatngaagccagatctgggccgctggggagaagggggggatggtgcagtaggcatagn

SEQ ID NO: 616982 - DNA, 451 bp, Homo sapiens
accgtgtactcttcaacttccgtacgatgtgccgcatgccagggatcatattgcgccagattgccattaaagacgttggcgaaaacgcgctgatacgctggaagcagccagcgttccagtgccccggagtcggtatgcgctccaagacctttggaggtcgttccgggcggacggcggcggatacggtcagggtagatgacgctcacatccgggttaaaccattgctttccatcactttcaaatgtccacagacgattgagaaacgactgccattcgccatttcttcactctggcgggcctgcatttgcgcctgcgaccagtagatggggtaaatctcgggacgtgaagcgctgagcgtcccgaagaaattatcgccggggcctttgtagacctcgtcaaagcggttgcggtccagatagtccagcatcgactgatcccagcctagcgcttg

SEQ ID NO: 616983 - DNA, 167 bp, Homo sapiens
tgaggatccccgaggtgccttagacagcagtggcatcaacttgtccaggctttgggggtgatcagcttgaaattcagctaaccgagcagctacggtccctcatctcctgcttgatgtgataaagttcactgagggcgaaccaaaagacctcaatgtgctctataggc

SEQ ID NO: 616984 - DNA, 230 bp, Homo sapiens
ttagccctgagagttcccgaatcgcgacaggacatgagcagggcatgtaaagcggaaaggaacacaagaacccgacgtagcccgacagggccgactcccgagaggacacagcagggaaataaagcagaaaggaacagaagagaagagaaaagatataaagtgcctcaactaaacaagcaagtgggacaatgagggcagagcagcacaggtccctgtcgggctattcgggg

SEQ ID NO: 616985 - DNA, 1412 bp, Homo sapiens
  misc_feature (1412)..(1412): n is a, c, g, or t
gataacactgccgattcttaatcaagactttttttcctgactggggaacgggacctttcactctttcttttacgacgacggggacaacgtgtgacgctcttaccctatattcctacactgtgctacttctttgacacgcaaacgacacggccactgcacaccacctttggacaccactgccaaccctgtgccacacgggaccaccttgacgttacacacgtgacacgtgtcgtcctacaaaccatgggacttaccgacacaccctgtggctctacctcactctaccaacgggcacctgggacccactccaacgacaccctaccatgacctccagtctactatactggcaagacctaccatgccacacccatggggctacttgacttgtctgccccctataaaccacataggctgttccttaaaccacaacactactcctgtcgccccttgtgactactgtccttgctgacgctttggcacctgggcccatcttctcccaacagacggccttgtacgacacacggcgcacgacagtggttcaacggacaggacccttcttgggctacactgaccgtgtcgccccgacccccgactgttgtactctgggggcactgaacggcacacgcaccctcgttacggagggaagccgtaccgtactgggacactggtacccatttgacaggcacaacttcacgaccttggacacacgttggtggcttcctccccaactacccacccggtatacctccttctttcacttactccccttcaatacggtgcccttgtatcccgctttggcccctagtttgacccccgtgccacttcggctctgtggcccgactgttaccacgcgtcgctcgttgcgttgttacgccttccagcttctcctgtgttaccccttttttcccctgtttcccacagggtttggcgtgacatatgtccgtcgctgttggtgtttttcggcgcgcatcctatcctttatgttcaccgtcttgtgtcgacccctgtgttgggtatcggactcacttaccctttcagccgggacacacctttaccacaatctgtggtcggcccgtcaatgccgttattagggcaccatccttgtcgccggccacccacaatatcccttgcaattaactatttttggcgcgccagttcacatatatatctagccgggacgaatagcactaacaaccatcactctcatattggggtcgcccctatgacatccgccgactctcgacactgccatagatttgtcgtgaacgaacacctcacgacagtctttcctcacctttgagccactttgggatcattccaaccggtaatcacaagtactactacacagtcttggacactcatctaatcgcatcggatgtcctagtccaacgccacactcgtgtccatccagn

SEQ ID NO: 616986 - DNA, 1131 bp, Homo sapiens
agcggggtgtaccgttagggctgggagccggctgggcgcgcggggtaatgacgggtgcctctcgccgtgcgactgacgcgggggcctcgtcctgctaggccgtgcgccggggcagtgagccggtccgtgcccagaccgctcgacgcgaggggcgcccggtggcagctgggctgagccctcgatgcctcccgatttgacggaggctcgcgggtaagtcgcacgtccatgctcgagccccgcatcactctcttggtctgcccagtggtcttgcgcgaccaagaccgcggagactagacaaggaagaggtggctgccacgagtccccgtaagttgcgcctcgcaatgaggcttccaattctagaggtcgaggaaacttttggggcccagactcaaggccctttgcttcagaactcgcgtgtggctgggaatatgacggcggggcaatctgggctggagggggagccgcggaaggtctgcttcagcgttggcccctttgcgtcggcccgggtggagagagacacttggtggcgagatcctttccgcggactgggggtgaattccttggattcttattctgggtaggccataagccattggggactttctgtgacgttgtccagttcgacacaccactggtggttggcggtggcgcttttttccctatgttggcgaccgggggtaacatgtggcaggccgtgaccactagattggccccctcgccctcattgttgttggcggccatcccgtagtcggtaaaacgcgaaacggaccggtttggaatgcggctagcgattgcgaacacacgcttagacctggtgtgggaatggggggatgcagatggggccggtcctaggcaggtaaatactaggtctaaagccacttgagattaactactattgtgctcgggggaatacattttgggtccccattcaaaactttttacgcatggaattcaacaatgttacggcacaattggaacggtcctcggtgagatggttttgtacggtttttccacacttggttgacaattcggtggccaatatccgggttcattgagctaattgactagcatctcggctatttatccttctggttgtgaagagagtgtgcgtctccacccttcctggcgccc

SEQ ID NO: 616987 - DNA, 901 bp, Homo sapiens
tggggccaccatgttctaaatttgttgcccccatccctactactggggcagaaccttgttcctcaattttttgggtggcttcttcctcaactgtgagcgtcgccccccctcagcagagatgtgttgtgaacatgtcttagcagtaatttgtcccccccttctttgttgttccgccccctcgcgacatccttcccccgccgctcgtgcttgttctggcacagaacggggggtcgtcaccaaacccccccccgtttggggtgctctccccttcccccctctccgcagtgatatagtctccgcttctcccccccctttgctggaacgccacttcttagagacgcccctgcgggggaatgattttttgtcccgttttttttctcctcttggaggcgttgaacaacgaatgttgttcgcccccggcgccttctttgggcgggccccccagccattttttatcccgcttggccaccacccccctgtgtaacaagccccccttctcccccacttccagtgctgccgggtggttgttgtttctctctgttctggccgcacaacacatttttcgagcatgtgctctcaccaaatgatggaggctgtccctgccctctgtgtattcctactctcctctctgccatatatatcccctctatctcccaagatggttattccacaaccaacccagagcagaaataattgtttccgcccactgaaacccccattcatctttttttgcttccttgcccccagaactactctcttttttataccttgattcggggggaaacccccagtccccttttccccctttggccaccaataccccccttttttttttcccccccttcttttttttttcccccctttttccttattgtaaccccaaaaacctaatgggccctta

SEQ ID NO: 616988 - DNA, 417 bp, Homo sapiens
aatttttgtatttttaatagagatggggtttcaccatgttgcccagggtggtctcaaattcctgaccttgtgatccacccgcctcagccttccaaagtgctgggattacaggtgtgagccactgcgcccggcctaatttttgtatttttagtagagatggggtctatgtagcccaggctggtctcatgctcctgacctcaagtgatccacctgccttggcctcccacagtgctgggattacaggcatgagccactgcacctggcccaatgcctctttcagcgatatgaagttaaaaccaggtactgtgattgctcccctggttttggttcttgtgacagtgcttttctctgtgcagattataatgtagtgttccagtggtgttggtgtgaggggacaaatggtgtaggtgtctattc

SEQ ID NO: 616989 - DNA, 236 bp, Homo sapiens
tgcatatggtaaagccatttaccaacgatagttgtaggtaaagaagggcagatttattagagaaattgtgaaaatatgttgcagtgggcagctccgacagagaaggggctacctgcaaagaggcaagggctggaggaaagttttatagaggtcctgctgtaagggtgctacgatgtggaactgaggtcattgatgccacgcgggattgtattgtagatatagctagtctcataaca

SEQ ID NO: 616990 - DNA, 241 bp, Homo sapiens
ccttggggggcccccttttcccctaaaaaggggggggggggggggcccccccccccttttccaaaaaaaaaagggaaccccccccctgtgggggttgaaagcccaaaatttttttttttttttgggggggccattttaaaacccccccccaggtttttgttttttgggggcgccccccttgttaaaaccccccccccccctttttttttcccccaccaaaaaaaaggggggggttttttta

SEQ ID NO: 616991 - DNA, 220 bp, Homo sapiens
cgggctgggaggagagagggcgaggagaccgggggaggagggagggggaaggagggggagagacaggaagagaagggagaagggatcagccacgaaccgacggggaagaggacgagaccgaagggagaaaggggcaagagggaacggaagaccagaggcgacggggagcaagagcgcgacaaaggaggcgagggaagaggcaaggaaaagccgagcgagc

SEQ ID NO: 616992 - DNA, 824 bp, Homo sapiens
cgccccgcccgttgttaccggtattgtaagaacaagccgtacccaaagtctcgcttctggcgaggtgtacctgatgccaagattcgcattttgtgacctggtggcggaaaaaggcagagaagagtggatgacgtctccgcttggtggccacatggtgtcgaagatgagatatgatcagctgtcctctgaagccctggaggctgcccgaattgtgtgccaataagtagccatggtagaaaatttgtggcgagaagcatggcttccatatccgggtgcggctccaccaccttccacgtcatccgcatcaacaagatgttgtacctgtgctggggctgagaggctccaaacaggcatgcgagagctgccttggaaaagccccaggcactgtggcagggttcacattggcccaagttatcatgtccatccgagccaagctgcagaacaaggagcatgtgatttgatggacctgcgcagggccaagttcaagtatcctgggcgcagaagatccagatctcaaaagaagtggggcttcaccaagttcaatgcatgatgaagtcgaagacatggtggttgaaaaagcggctcatccccaggatggctgtgcgggtccacgtacagtccccaatcgtggcctcttggaaccaagtgacgtgccctgcaatcatgacggctttccaatgttgctgacaccctcttagtatgcaccaataaattctatttcctgtccaaacaaacaacacaacgtgggacggccaaaaaaatccccacagggacaaatacagcgtaccagttcttgtacacagggaccaaaagagaacaacaag

SEQ ID NO: 616993 - DNA, 1044 bp, Homo sapiens
cctgtaatcctagcacttggaatatcaaggtaggaagatcgcttgagcccaggagagccaagatcacacaactgtactccagcctggatgacagagtgagacctgggtccccaaaaaaaaaaaaaaaaaaaaacaaaaaaaaacatcttggtccggccgcgccctgcggcccctcacaagaaagccctcttctaagaacccccttccgtgggggcgccgcgcgggcccacggtagaggaagagggaaaacgggcccagagagctggttcccagaggagaaattccgggccagagaacagagcggcctgggattctcacacccattaaaaaacgccccggggggaaacaggacggcttttggaacacaccacccaaaagaggggagagatctcgggaggcgggccatcaagggggggctaactacccaagcggcgaggctccacaaggcgagcggcctcggaatatctcaaaatattacaccgccccagggccggggagacacaccacagcagtgacgacagcaagaagtagaacaagaacaacaagcgactaacagcagggaagacaccacacacagcgcaacgcaacaccacacaaaacagtaggctcgacgcacacacaacaacgaagtagcaactgacaagaacacaagtgtccgcccgcaagccagcaacacagagagacaaagaacgaacgaaacaaggagagcaccaactacagcgcaacgagcaagccggcagacacgcaacgcccggaccgaggccaacacacaacagcacaagacagagagacacacgcgagacaagcgaagggacacacagcgaagacagcacgcagtgaacaatgagtacaaagacgaagcaccactgaggcacaagacagcgagagccacaacaacatcgagccccaccgcgcacgaagaaacaccaaacaccagcccgagcacgccacacaggaacacaacgaccgcgacgcgaagcaggaactggactctaacgcagccgcgaccgcacagagacgccaagccgtccaactgacgaccca

SEQ ID NO: 616994 - DNA, 173 bp, Homo sapiens
tagcagtatccgaggggctctggagaacctgttctcgacgttagtaagcactttcctgtgtaaattgttgtccctgaatcatcatactcaggacttgctgatccacatctgctggaaggtggagagagaggccaggatagagcccccgatccagactgagtacttccgctctg

SEQ ID NO: 616995 - DNA, 111 bp, Homo sapiens
aatcagctcgaccatataaagtcaggagagaatgcacagctgtacacccaatctgatgccccctcaatactttcatcatgtttccatcatctttcaggtcccatactctga

SEQ ID NO: 616996 - DNA, 273 bp, Homo sapiens
tgattctagaggatctccggccgtggtggcgcttggtgtggctcatggggtgtgctcagttgtgtggctcattggggggctgagtggtggggcctatcgcgtggatcttagggtggcacctggtcgtggctcgttgcgggactctagagggtggctctttgcgactcttggcggggctctttgtgtggctcttggggtggctctttgtgtggcgcattgggtggcccattgggtgggctccttgggtggcatctttgtgtgtcgcatttgcga

SEQ ID NO: 616997 - DNA, 290 bp, Homo sapiens
cggtccgaatatcccaacactaccatcacattttcatagaattagaaaaaaatttaaaagttatataaaaccaaaaaagaaatcgcagagccaagacaatcctaagcaaaaaaaaaacaaaaaaaacccaagggggggggcttcacactcccggcttccaccttttcctacaaagccacagtacccaaaacggttgggtcggggtccaaaaccgggcacatagacaaggggaacagaatttgtggaactcagaaatacccccacacattccatacccattgtgattcttc

SEQ ID NO: 616998 - DNA, 1313 bp, Homo sapiens
cgcgcagaaggggtctggtgacgagtcccgcgtactctccttgaatccactcgccagaccgaccgaccctctgccgcgcaccctgcacacccgcccctctacctgtgccaggaacttgctacgtaccagcaccatgcactaccaatatccagacacatgaccccggagacagaagaaggagcatgacatgacatcgcacaccgcatcgtggcacctggacaagggcatccatggctgcagatgagtccactgggagcatagccaagacggctgcagtccatatggcaccagaagaaacaccgaggagaaccaggcagacaaactaccgacaggcagctagcatgacagcatagacgaccagacgtgaaccccatagcatagggggtagtcaaccatactatccaatgaggacaactactacacaaaaggcggatagaatgggcggatcccatgtcccaccaagggttaatcaagagtccaagggacggaagatagaaggagacagtcaaggatagaacaaaggagacagatgggtcacccaacatagaaagggaaacaaaagtggacgagaacgtaaccaaccacaaaggggataggaaatgaggcgaggcacatgaaagcgccaagaagaccacaagaaacaaaagaacaaggcaacgaggaggccatggaacaatacggcacagaagaaagggcaagataaagagaaatgacatggaacagaacacaggcgcggaaagcaggaaccacacacatacaagagacacagaacgaacaaagagcaatgggacagaaacaggcccaaagaagagaacagagggcagcaccaggacgaaaagcacccagagaaaagcgtggggcagaaggacaaagaaaaacaggaagcaagatagggaagacaacaaaagacagaagaggaaagcgcaagacagaaagccaaccatccagaaaatggaggaggacagcagatggcacagaacgacgagaaccgggacgatcgaccagagaagatacggaggaccgccagaaagcacaagagggatagacacagggacacatggcacggagcccaaaacgaagagggacaaaaagaggaaagcgaccccaaacgaaagacatacgaacagcaagaagacggcgacaacccaatagcgcggagaaagggaaagaaaagagaagaggagacgaaaccgcaaagtggaccagaagcaaaagatagcaaccaacaacaaaaagagataaaaaccaaacaaaaaaaaaaggaagaaaaaggagaccaagaagacgagccagagagaagcaagaacacagga

SEQ ID NO: 616999 - DNA, 227 bp, Homo sapiens
  misc_feature (114)..(114): n is a, c, g, or t
acaatagatgtactattcaacgaggagtgtatataagataatcctggggaaggatcgctggtcaagggtgtcataatttacagaattttatagaacttcccaaggtgaatacanttcatttttgaataggtatcatgtgcacacggtacattaaaaaaatgtaaacagaagtcaaagtattggttcataatttactttatatgtctctcatagatcttcctgaggtg

SEQ ID NO: 617000 - DNA, 359 bp, Homo sapiens
ccagatgcgagacgtcgaccaagcatcaatcacgctccgtgagtgtagtctgtcgtcggatggagcacggggtccggcccttgtgagtgtcactcggcaagtttattctcgggtgttgtcaggactcctccgtgccagagtcatcctcatcgtccccgaagcagctagtcggcctcctcctccacctcgccgtcctcgtacgtactcgtcgtacaagaggtctgagccctcgtcgggcgccggcgccttggtcttcacgcagtactcggtcagcgtgttgagcacattcacgccgtcccgctccgcgttcaccttggtccccaggacctgcttccggattatgtctgtgtattccctaa

SEQ ID NO: 617001 - DNA, 668 bp, Homo sapiens
  misc_feature (248)..(248): n is a, c, g, or t
  misc_feature (260)..(260): n is a, c, g, or t
  misc_feature (270)..(270): n is a, c, g, or t
  misc_feature (668)..(668): n is a, c, g, or t
gaaatttactagaaactcagtattgggcggaaatccgccgtccaatccgcgtgggcttattatactatacatttgaagcacgcgatgatctcaacgaacggtccgcgggctggtgttggggcgatgaggctgtgcgtgcagtgcgctgctacgggaagacggatacggccgaaagctcttcagcaacgggcaggagatgctttccagcccaccatgagctgcctgtggtggatgctgtcagtctcgcnttgatcaggaantctacccacngtggagaaggtggaattcttgtccagtgatggggaacggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccaggcattggccccctttgtgcgcacactgccacccggcacgctgggaacgcattcgaaccggccactttgaatgacagagacgcagtttgtgttatcctttgtcatcgttcgtggagggccgtggggcacacttcttcgcttctgtaccn

SEQ ID NO: 617002 - DNA, 688 bp, Homo sapiens
aacagtgtttaaacaagaacattagggggttatctacaccctctttgaaccaaaaggacaaaagggtcccacttttgggcccacctaaaaattcctgacaagagcaaatgtttgtggattgtggtgccccaaaaaaggggccaaaacccatttttaaaaatgttatgattcctgcatttgttcataagttcagagtttaattcccttaaaccaatgcctatcgtggtcagttttctcatggcctttttaaccgaacattaagcagccacttgtttacagcacacctagtacctattaattcttgctcttgcatggttcgaaccccttctctgtagccacccgtcctttgccttatataacacacattttgccagtaagttggtaaagccagtgctgctctctgtgtgtgacccagcgaaattgaccattccatgcagtcaggggctctctcaagtatttgtccagcctacggtaggcttttcgtgtctttaacatcaagtgtgtgctatgatagaaccctgatttatacatcttattaccagtgtctctctgtatcgagctgtgaattgtccatttaacgttggcatgtctgtgtaataatcagtcgtaagtagatgatctctagctctggaacattatttctatagcttagaactgtgattattaataaaatgaaagcgtttaaaat

SEQ ID NO: 617003 - DNA, 354 bp, Homo sapiens
agcggtattacacgagctcacgagaatgacgatcacacagggagagaggggaggcacctgagatatgagctctaggccttttagcatggaggagtgcccttggccacatatatagtccaatctatatagaaaggtgatattgtggacatttagggaaaggtgaccgttcaaacaggaatggcccttggcattgttggcaacatgcgagctgagggcaagagttttgtcccgagaattaacgcgcgtattgagcacattcagcgctctatgagcccagataggctcccgaaacgtgagaagggtaaggttcagcctaaggttgaagccaaagcgaaggtgcctgtgtttctgcgc

SEQ ID NO: 617004 - DNA, 522 bp, Homo sapiens
cccgctgactcgtgataagattatgctgctttaacaattaatggagagaaatgggataatgtctctggaggcagagattctatgcatctctttatacaaatgtagaatgtctctgggaaatggctgacaaatatgtcttgactcgcctcagtgatataagagatgcatttagttatggggttatagtgaaataaatatatgggttgacaaaactcaatgatgtaacaaaaagcccagaatttgaaaaacaggcataggaagaggaatgttttacaatgtccttcctgtgacatgggtaaaaacacctgccatcctcagccatcatcgagttttgttgaaatgaaagccaaaataaggggcaagagattatcatccttagtggaagagaagtagcccgttactcaacatcatatgtcttaataacttgagacgactctttcaaaatagtgtccactactggcatatcttacccaaacaagcaaagtcagctacagtcaacaccaagtggagtgtactctcaga

SEQ ID NO: 617005 - DNA, 424 bp, Homo sapiens
cgatcggaagcccccggtgactaccttttggaacaaagccaatcgacgttgacgctgattgtagtggtcaactaaccccggacacagttttgagtttttcctcaagctttggccggagccagcccatcgttgaactgatggggtcttatccagttgtaatgatccatcaggtactggctaatgtctcgctgagcttgctgtccggtcaggtagcccgtgaccggtatccactctgttttcaagctgcgaaacacccgctccatcggcgcattatcccagcagttgcctcggcggctcatgctctggcgcatgcggtagcgccacaatcgcgtggtctggtcggaaggcatgttcatcggaacgcagcactttcaacagcatgaccgttacctggaaaacctcatcgacgcgcgcagccgcccgt

SEQ ID NO: 617006 - DNA, 279 bp, Homo sapiens
gtggtcgaagggctgaggcgcctgtcggactaccccgaagtacatgtggtttctcgctgtactgcgaggggacgcgcttcacggagaccaagcaccgctgttaggcatggagggtgggcggtgcttgcgtttttaacaagggtggggggctttttctcccccttgttccccgtccaaagtggtttaaccagccctttggcttgcctgcgtgggaccaagagggtgcgttccaacccgaccccggccgaggtccgagagggttgccccttccccctgtgg

SEQ ID NO: 617007 - DNA, 87 bp, Homo sapiens
acatctgtgtacttctgtgccagcagccccgggaatctaccaaaaaacattcagtacgtcggcgccgggacccggctcacagtgctc

SEQ ID NO: 617008 - DNA, 430 bp, Homo sapiens
tcattcagtcaagaagtctgatctacttatttatattaccaggacatcaggacaggtgtcaattccatgtagttgtgtgatttgagtgaatttcttatcttgagtctaatggatgtgctgtggtctgagagactgttgttatgacttcagttcctttgcatttgctgaggagtgttttctgattatgtgatcaattttagaggactctaactcattctatgaggccagcatcatcctgataccaaaacctggaagagatacaacaaaaaaagaaaacttcaggccaatatccttgatgaacattgatgtgaatacccttaataaaatactggcaaaccaaatccagcagcacatcaaaaagcttatccaccatgatagagttggcttcatccctgggatgcaagtttggttcagcatatgccaatcaata

SEQ ID NO: 617009 - DNA, 432 bp, Homo sapiens
ccaatgtattatacctttaagtcacacataatgtcactgctatctggataaagttataagttcatatatttgaaataagatcctggaagacgatattctaaatggtgtcaaactgcagagacaagaggccttcagtatattcacatctcataggtaaatatgtacattcggatgatgatttctcttgataacattaacattaatctaatttaatcagacatactgtaatttaaaaattaatgtgagcgttagttttaacgttcacagaaaacttaataattcacattctcaggcattaaggactcaccataacattgtcagtcctaatgacattttgtcaaagatggcaagtttgttacctcacttgagtggggtactcctttacccccaattctaagacaatataatgtgtatactacaaccgtcaataaa

SEQ ID NO: 617010 - DNA, 807 bp, Homo sapiens
  misc_feature (37)..(37): n is a, c, g, or t
atcgtgctatccagcactgtagcccccagtatgaacntgaccgtcatgggccagagcgagcgtgctctcgagatcaaagcacgttgcctgactgcgaccatagcgcgtacaaagactctcgttccttcccctaatcctgcaaggtgttcattagccctggctgtgtgctcgccatgtgcgcatgcctaacattgagctcttgcggctagttgctcttgtgtggcctgtgatctggccccgatgctgtaacgggttggggttgggcaactgatggttcccaaggacactggaggcctagaacctgatcttgcacgggttcgagtgggcctgccctagctgtaccgtttgcatcactgaggcagctgctgtgctctgttccactatgtgcgcgacctcggctggcccagcctcccagcttgcgtggtggattcccgagatgctggctatttgcctgcaaccccttcagcagtggggatgctttgctggcctctgcccagagtcaagtctggtactgtattcactgtaccttctgcaactcgagccctggctgggtgtgtgtcatgtgcaaccggactagtagccccattccagcacaacatgccccccaggacctatgccagctctttggcacaagggaccacccaagcctgggcccacaatgaaagccttaagtgacccaactgaccagttcctgtggagatccttgagaacgaagcgaccaaaagaaagactcgggacagaaggtctccagactagtgacacatgactcagcgaaggggaaacagcaaatggctgtacaaagcagac

SEQ ID NO: 617011 - DNA, 147 bp, Homo sapiens
gacgatcccccggaacaacttacgctacttgaaaataatgtataatttgtatttagttagttgtagtcatatttgttatataacaatagggtcatctagatttaatgataattgtactagggtttttcagtatatttgagcagtcat

SEQ ID NO: 617012 - DNA, 142 bp, Homo sapiens
taaccatccgatgatttacaaagcattaaagcttcagagaagtacacaaggctacagtctcatctgtacaaaactacagatttttttttgttgttttttggagatggcgtctggctctgtaacccaggcggtgagatgtccg

SEQ ID NO: 617013 - DNA, 339 bp, Homo sapiens
accccaagcagtcagcaaccatcaacactgaggcaagaccctccaccacaaaaaattatgactcattgaaggctcagatgatcattaacattttttaataatacagtgttttttaattaagatgtattttttagacataatgctattgcatacttagactacagtatagtgtaaacattttattaatatatgcactgggaaacccaaaaaatttgtgtgacttgctttaactgcaatatttgcttaattgcaagtggtcagaacacaacccacaatatatccaaggtatacctgtagcatagtatatcctcttatatactatattattaaaaattcagc

SEQ ID NO: 617014 - DNA, 222 bp, Homo sapiens
gatgactatggctcttaaggttctgagaaatcggacggagagctcaaacttccaattcctgcgtcttccatgccacagcagatcggcattcctaccagatctttaactcaggttgttcattctgcgagaaggcggatcatagtgagtcctgtgccagagagccgattacgacaatcaaatgttttccgcagtgatataacagatgcagctgctgccaaatcc

SEQ ID NO: 617015 - DNA, 818 bp, Homo sapiens
cgagctggtgtggccgtgcctggtgcggcagtgcctggggcgttggcctggcaggaagattgcgaacgttgggctgcagttccaggcgagcgcgggggactctggacccacagagcctggcccctgctgctgctcgggcagctgcaccacctgcacctgtgtgccctggagccacgtcctgcgggaagctgcagccccgggtcaccgaggagctctggcaggctgccctgagcacggctcaaccccaaccccgacggacagctgtcccctctaccttgaactacgccaccgtggcctgccctagcccttgcaagtgggtgatggccgggcacaaacaggccacctctggccgcccacttcatcactgcggcttggttgcgtgaccgtgccttgccgccctggagcgcatcgctgcattgtgatggtctgcgagcagccagaggtcttatgcttccgcctgttgccctggcccggtgcgcttcccgcgtgttcacccaccggtcaggtgcctctcggcggcatatggaggaagaagacggtcaccagtggaggtagaacgcttggtgggacaagacaacggggccggtggagggtgtccacgtagcaggtgcgttaggcgaatgccacagacgtgcgtgcgggtagcagggccagcatcgttggacagcagccgttggagatgagagtgagagagcggaagaaacgtatctacgaggaaggattaaggaggagattgggaaaaggagcttggggggatcagtcgcaggggattcatcgcgggaatgagggaagtgaggaggagaaggaataaggaggta

SEQ ID NO: 617016 - DNA, 586 bp, Homo sapiens
  misc_feature (586)..(586): n is a, c, g, or t
atggtacacctgaatgttgttgcagtaccagcaattgatgaggaacgagtatgcagcacacaatgaatagctctgcagtactggacccgtgatggctcgtgtctagtgggagaccacctaattacagtaccgggaacctctgaggggcattgatgcaagtcgacagtgggcgacatgtccacgagcatgcacccggcaataccacgtctctattctgaaacaacacccttgagtacaggcacaactccccacacacacaggtaagacccatctctgcccacagcatacacacccatggccccctacctgtcatcacagtaggtgaacttcatgtccatgctgtggcggctcaggaaggtcttgctatccagggggatgtccatgtgggatgggtgctggattggttcacacatgatgatgagtgcaggacagcaggggctccttgtagccacacagactattgtgaggagggcagttgttgtagactttcacctggcccgtgcagtgcaagacctgagacaggcgtggaagggtcagacatggagccgagagtgctgggggtgggggtagggccttaggcatcccn

SEQ ID NO: 617017 - DNA, 126 bp, Homo sapiens
agttagttttataaccctgaatgcccccccccttcccctaagcacacaggggttaaaactgtgtgtccctcccagtggctgtggcagtgacagtgacacccccccccccagtaaaaaggaggctta

SEQ ID NO: 617018 - DNA, 444 bp, Homo sapiens
  misc_feature (8)..(8): n is a, c, g, or t
  misc_feature (20)..(20): n is a, c, g, or t
  misc_feature (58)..(58): n is a, c, g, or t
  misc_feature (231)..(231): n is a, c, g, or t
tgtattancatttttgggcnccctccaagtagttacctttaaaagctcctaaaataanatgtgtcctcaaccctgtcaacctttagctctcccactgtataaaaagtacacccattcaccctgtccctcctgcctttactttgctggtatgtaaccctcattatgtttataatatcagggtttgtgggcaggcttggtggcgtacacctataatcccaacactttgtgagnccaaggcaggagaatcgcttgagccccaggagtttgagaccagtcagggcaacgtaatgagaccccatctctacaaaatataaaattagttgactgtagtcccagctacttgggaggctaaggtgggaggatcacctgagcccaggaggtcaaggttgcagtaagccgtgatcatgccactgcactcaagcctgggtgatagagcaagaccct

SEQ ID NO: 617019 - DNA, 110 bp, Homo sapiens
cctggatatagtgaggagttagagcgcacaggtgtgtgtgtatgcgttgacgttttgagttagtgtcatatatactgcagcttatagtatgacatcggtccccaagtggt

SEQ ID NO: 617020 - DNA, 344 bp, Homo sapiens
  misc_feature (81)..(81): n is a, c, g, or t
ttgaacttctgacctcgtgatccacctgcctcggcctcccaaagtgctgggcagattcatgtgtttctcctgcctcagctnccttgtgtagccgggattacaggaatgcaccaccacacccagctaattttgtatttttaatagagacagggtctctccatgttggtcaggctggtcttgaactcctgaccttgggtgatctgcccacctcagcctcccaaagtgccgggtttacaggcgtgagccactgcacctgccccccttttttttttaatttactttttatttcaaaataattttatacttacaaaaaaatgtggcaaaaatagtatgcagagctctcc

SEQ ID NO: 617021 - DNA, 990 bp, Homo sapiens
gcgagttcccgcgtgatctgtgtctaggttcgtgagctctttggacagaacaaatgctgtgaccctctctcgaggcttcgatcgacctgcgcagctgctctccgaatgtgatccttcactggatactatcttctcggctcatctcctgcttttgataatccttggttatgcagctcatttcttgctcggctatagggctactccttgcatttgtcccaattcaagtctatggagctgctcccatgatacgacaagagatattaatttagcactcgaacgatgatctagcagacagtacagacagatcatgtgatcagagtgttgtacctgtatgtgaccttacactatcatggcgtagcgctcatctgcctttggacattcatagtttgcgactccgcagactgactgttagggctcttggaaaggtccgcttggacgcgcagcatatgcgttctctgcgaaatttggaccgagagagaaaggactgcggaagcgggctgacgacgccggtccttccttgaaagagacttgcaaaagacctcatggcacgttagcgtccgagactggcggcagagctcattccacagagtacaattccaaagacacggcgcaacgcctaggaacggaattggattactagagggggtaaaaataactcctcaggaccgactcaagataggaaaccgcttcggacccaggttagggccacttgtaaggaaaaacaaaaggcttgaacacccaggggacacccctatgttagagaaattgcgtgtggcactgtccctcccttgtgcgttttgcatagccacccggtgagcgaggaacacaccagacaaatcctttctagatggaacctctctcgtgggaaggaacacttgcaactgttccacttacgtaatgcaagtgtcaaagttgaaaagactttcgagtccaaagaacaaatcacttgagagcttggatggcaacgcctgggactcaagaccttccgaa

SEQ ID NO: 617022 - DNA, 522 bp, Homo sapiens
ggcgatccttgtctgaataatgtgctaggtgcttattcttctagaggttggcagtttcaattgtgtgttgcttagtctctctcctagaaccaaagaatcgcaggatgggccaattgtctagcacaagcttttccaatctgcagtccacacacagcccaggatggctttcaatgtggcccaacacaaatttgtaaacttaaacattgtgagattctgggccgggcgcagtggctcatgcctgtaatccctgcactctgggaggccgaggcgggcggatcacgaggtcaggagatcgagaccattctggccaacacagtgaaaccccgtctccactaaaaacacaaaaaatcagccaggcgtggtggtgggcgcctgcagtcccagccacttgggaggctgaggtgggaggatcccttgagcctgggagatcaaggttgcagctgagctatgatctcaccattgcactccagactgggcaacaaagtgagaccctgtctcaaaaaaaatagacaaagggaaaca

SEQ ID NO: 617023 - DNA, 435 bp, Homo sapiens
  misc_feature (433)..(433): n is a, c, g, or t
tactacccttctttaaaaaatctgttccctaaacatgtgaaaaatctacttcaaaacctttctgaaaatgaaagattttccgtgttttccctacagcctgtttggttaacagcccaaattcaaagctccttcataaagtaccgcaaggggcccaggtgcagtggctcacacctgtaataccaacactttgggaggccgaagcaggcaaactgcctgaggccaggagttcaagaccagcctggccaacatggagaaaccctatctcaactaaaaacacaaaaattagccaggtgtggtggtgcatacctgtaatccctgctacttgggaggctgaagcacgagaatcacttgaactcaggaggcagaggctgtaatgagccaagattgtgccactgtactccagcctgggcgacacagcaagactctgtctctntt

SEQ ID NO: 617024 - DNA, 191 bp, Homo sapiens
accccagggtctgcgccgaaagagcccgtcagccatgggcaggatcgcgggtaggtgggtcagccgggtctgggtcagagcgcagtgggcggagaacggcgtcacttctgtatttttagcgacccgggcggggtcggtgcctttattttagggggcctctgcagggtccgccggtcctctcagctgaggcg

SEQ ID NO: 617025 - DNA, 128 bp, Homo sapiens
ttctctatttaaattaatagattatgggttaattaacaggataacatggctatatatacctatatatttaaaggggattctttcttaactaatatatttggtttggtaggagattgtagagttagggg

SEQ ID NO: 617026 - DNA, 893 bp, Homo sapiens
aaactttttacatattagtggttatgatccaatgtgtcatgagtgaatttaactgtaaggtggtttaaatcaaatatgcaatgtttgggggggaattgtatttctattagcagattttgactatgtttacaggacggctttaaattcacaggattatcaggcactgtgacgcatctcttcagcttatctcttaaagctagatgctaatattaacgggcttagactttaggatctacatattctgggcacttgaactaggcagtaacttacaaactaagttttgcttacctttcgttctagggactagcactgctatcaactggaaagtatttcccaacctaactctggttcattacagaacagtcatactttttgcaatttcagccaaaacatacaagaccggctgtaactaactctgttagaaacagataatcacatgtcctgaaatccatatgtctcactatgatctaccactgtcattctccaactttaaaatctacaacatgtcactataagattcagacaaggcttcactactctatctaaatgaactttcacttccctactctcacttccggtcagccgtgcgttaaccgcaagccaggcccttgctacttggtctttcccccgcattgcccgaccggcctactccgggcactattctggtccatgacctgcccacttacgttcttattgacccccgccttttgcccctgaccctgcattgggccccctaatttttccaccgtggaggccttttactctcttgccctgctctatattttaccctaactcttggacgcgtcccggttataccgtaccgcggttgccgctctacccctatatccagcgctctcctctaagcgcccttctttgctctggcaccccccttg

SEQ ID NO: 617027 - DNA, 999 bp, Homo sapiens
ggcgcagccctcaacaccccgtgcatctgcgcctagggactcttgggtccagatgtgctgtggttttcacaccttcttgggggcaacatggttccaggagccacctgtgggtgccacctgagccacaggctcccagagaaagcagcacagctcttcctgccacccagagtcttgctgggtggcggatgggggaacaccagatggttgtgggaaggcctgaggccaagaattgggggactctggtactgtgggcagatgagggctcctcatgaatcccaggctttgaaggggaactcagctttattattcgacgagaggcacgcaaagttgggagtggccgccgcgtagtggctcacacctggtgatctcacgcactttgggtgaggccaaggaaggtggatcacttgaggccagtgatgttcgacgtaccagcctgggctaccatacgtcaaggtccccatctctacaaaaattattatttctttaaagacaacattagccagggtgtggtggtgcttgcctatatgtcccagctactcgggagcgctaatggtggcgaggatcgctggagtcccatgaatttgaggctgcagtgagctgtgattaactgcgttgcactccagcctgcgtcaccagatcaagaccctgttctcttaaaccataacacgtttgggcgacaagagcttggtcacctgaaagggagggattactagtacgagcggtgcatggacgattgcttcgctgtgttggtgcctcggaccatcggtattacgttgctgcaacaggtccttgatatctcttactgcttatacacagcttggaggcgagaatgttggttggttaacgagattatgcttcgggacagattggattaacacagttacaggccccctttgtgccgccttgccccggggcatattggccaaaagcgttgtgcaaaaaaaaaacaaccgctctttgcgcggagggtaaggacgctgtctcttctgaggaacgcca

SEQ ID NO: 617028 - DNA, 868 bp, Homo sapiens
  misc_feature (2)..(2): n is a, c, g, or t
cngccgacagcctgtggatctcgcactcacaaggtaatcgccggtcacacacccgtcacatagtgataaggcccggtgtaaaaccgtgcggcgcatcgcgcagaatcccgccggctaaacaagtggcgcccccaagaccaacggtattcggcacccgcttgccgaggatggaaagcaccccccttggggtgcacagaaaacccctaaagggcagctttccaaagtgttcccatacctacgtcccaatgcgccaaaagcccttaggggtttccggcccccataacgcacgtgggtggaactccgggaagcggtgtagtacagcatgtggcaccacccgaaaggttgggaaacttccggccctgagcttcaaacgacaacggggccccaacacgtacgactatggaagcccaactgttagagacactctcaggtgaccgaaatgaagtggaaactcgatgcttaactcccaaatcatgaacggctggataaatgagccagtacatccatgccctcccaagtagaatcaatttcatgtgaacgctcgtctcacccgagagagccgtcggtatgaaattggccgtgattcccttctaagtgatgttgtgtcttggtcacacagttggacatgatataggtcgtggattatggggaatctaagagaggctgccactcgcctgtgagttattgggaattttcaccgaaccacgctgtatgcgcccattcaatagggagcccaatttcacgaattccccgcaggttacctaggaggcggactcatataatttctctgaggcgatgaaaacacacacatataaatacacagggaaaaattagaccccacacaaagttaaaaagagtcacatgtagt

SEQ ID NO: 617029 - DNA, 386 bp, Homo sapiens
gcgaccagaggaccctattatggttgaccacggcctcaaatgtgtgagatgtgatttatagataagcagtctataattttaagacaagaggttctaaacacatctttagattctaagcagaaagaaattacaagcactatttagaatttacattaaacaagttacctctatcaaatttctcgattctcttatgctgtagctatatttgattttaccttaaaaagttctaaggtcctttcccccccttggttaatttgggtaaactaggcacattttacaaggaaatctgtgtcaaaacagataacagtgcataaatcaatccaaatttagaccctggcaaccagttccccatggctcatctacgggactctgtcaaacaataaata

SEQ ID NO: 617030 - DNA, 851 bp, Homo sapiens
gtctgctttctgtcactatagattagtttaccttttttagaattttcttttcttcttttccttttttcttctgggacggactctcattctgtcacccaggctggagtgcagtgacgccatctcggctcactgcaacttctgcctcccgggttcgggccgttctcctgcctcagcctcctgagtagtggggattacaggtgcgtgtcaccacgcccagctttttttttttttttttgggtgttttatagtgtgggagggcgggggttcacacccatggttaaccagggtggaaacggcccaccacacatacccaggctatatttttaaatctctttaaaagagaagacaggggtctctcacctatacagtttctcccagggatgtggctcttatacaactctccgtgggccatagacgcatttctcctctcactgtgacctttggggtatttccacacaagcgactaccggggagatattacccgtggataatacacccatatttaacttatgtttccctcctgtagggctcttatatttttcacatcttgtgagtaagagaacatactacccaccgcgcgcggtgtgtacacacaccccacctatagcagcccaggcctcatgtcgcgccctccagcacaagaacgtcgtgcggcgcccaccaccgccaccgagggaacacgcacagccggaatccacaacacaacgcgggccagcagcccccgctccctctccgcgagcggcagcagaaccacgagcgtcacccgttcccgcgccggggcgtcacccgccaacaggcggggacaacgcacgtcacacaaagacgcgggcttaccctcccaccgtgacccg

SEQ ID NO: 617031 - DNA, 122 bp, Homo sapiens
tcgcgaacgtgtatctgctgacaaagttgtgattgaggcctgcgacgagctgggaatcatcctcgctcatacgaaccttcggctctaccttgtctggagctaatggataacacgttcgcgag

SEQ ID NO: 617032 - DNA, 582 bp, Homo sapiens
  misc_feature (221)..(221): n is a, c, g, or t
  misc_feature (380)..(380): n is a, c, g, or t
  misc_feature (432)..(432): n is a, c, g, or t
  misc_feature (527)..(528): n is a, c, g, or t
  misc_feature (557)..(557): n is a, c, g, or t
  misc_feature (564)..(564): n is a, c, g, or t
  misc_feature (575)..(575): n is a, c, g, or t
agcgggtcttggttcgggccgggcataaaaggcttcgcggcccaggactcacttggcgctgagaacgcgggtccacgtcgtgtgcatcgtccgtgcgtctaggcctttgcccactgcgagctttcaggtcataggcctccgtgtaacgcgcgctatcgtgaaagccatacccctgagcttcaaggtccatcagccggtgagtggctggcgcgcttcaaagnaggtgcaagctgttcggaactacatacagggaaggtacgctgggtcctctctgtttctactccttcttgggacttgtcactattatgtgttgcgcccaacacgtaggatccatcagcgattctagcgatgaccggtgcgacgcaggcacgttacccgcncaatgcttgggtcgcgtgttagtaagtggcattggggccgtactacggcgtngtgagctgcctctatgtgtccatcgcgctagccctgtggcctttggtggattccacatctatcccctcctctcgtgcatacaggacgtgggacgnngctttgtgtgacccctccactggagaacnattcatnccacttgacgntctgcga

SEQ ID NO: 617033 - DNA, 733 bp, Homo sapiens
acctggcgggtttggcacggggaagacggccatcgccatgggcatggcgcaggccctgggccctgacacgccattcacagccatcgccggcagtgaaatcttctccctggatgatgagcaagacctgaggcgctgactgcaggccttccggctggtccatcggctgttcgcatcaagtgaggagacggagatcatcgaaggggaggtggtggagatccagattgatcgaccagcaacagggacgggctccaaggtgggcaaactgagcctcaagaccacagagatggagaccatctacgacctgggcaccaagatgattgagagacaaaaaagaagaaaaaggaaaaaagaaaaaaaaaaaacaaaaaaaaaaaaaagtgtcccctgaccaagtgacaaggtccagtgccgggagacgtgatcaccatcagacaaggcgacgggctaagatctccaagtttgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgcaatgtggctgagtggcggaggagggcagggggagatatccctggagtgtgtca

SEQ ID NO: 617034 - DNA, 152 bp, Homo sapiens
attaatacctatgggtttttacaacaggtacaacaatcatagtgcacacaccacttcataacgacaacttctccacctactgtgtgcaggcccaggggcgacagcagctgcgtgtataagagagagtgctcatgaccgaggtctctatccca

SEQ ID NO: 617035 - DNA, 247 bp, Homo sapiens
gaggactcccgcggctctgaactataggcactaataatatgtactgagctttattcaagctaatggttcagcgtgaaatgaaaaggatcaagtgaaccccttccagtcagaagtggagctgccaggactcccaccccatccacgatggccaaccacaacaggctagacgttgttagcatactttccctatacctacctctggtactccccttggattgggacaagaagaacaagttaatctggtcta

SEQ ID NO: 617036 - DNA, 338 bp, Homo sapiens
  misc_feature (18)..(18): n is a, c, g, or t
tttttttttccccccccnccccccccccggggggccccccccggggggggttttttttttgtggggggggtttttttaaaaaaagggggccaaaccccccccccccccgggggggggggggggggttttttttacccaccccggggggttttggggggggggcccccccccccccccctttttttttttggttttttttccccggggggggggagggggggtcccccccccccccccccggggggggttttgggggggaccccccgggtttccccccggggttttttttttttttttgggggggggggccccccccttttttttttttttttttttta

SEQ ID NO: 617037 - DNA, 337 bp, Homo sapiens
  misc_feature (33)..(33): n is a, c, g, or t
  misc_feature (157)..(157): n is a, c, g, or t
  misc_feature (215)..(215): n is a, c, g, or t
  misc_feature (262)..(262): n is a, c, g, or t
ggcctcccaaagtgctaggattacaagcgtgancaccacgcccagccataaatggtgtttttaagcaattttatggtgctaattaagcaatagattaatgtgcttctcttgcactagactttaagctccatgaggggagggagaatatctgattttnctcatgttgaattcccagtagcgttcttgacatgtagtaagtgcttaataaatatttnttgaaggaatgaataaaaacccaaggtgcagtagctagtgctttgantttggggctctgttcctcaacctagaaggttaagggaaggcctgtccagaagcctggaaggcccaagggggaaaa

SEQ ID NO: 617038 - DNA, 299 bp, Homo sapiens
tggcctcgtacgggggaggagacccattctatatcaacactattctgatttttcggtcaccctgcacgttatattcttatcctaccaggcgttcggaataatctacccatataagtaagtatactactccggagaaaaagaagcccttgggtaccacatggttaggctcgagaccatgacattcattgggttcctagggtttatcggtgtgagcacaccatatatttaccggtaaggatagacgtagacacacgaagcatatttcacctccgctaccataatcatcgctagattccgta

SEQ ID NO: 617039 - DNA, 324 bp, Homo sapiens
cggcgcatcgaaatcgaagtcgcgcctcgggagcaccggtgcctttgcgatacagataaatggacagttggtgttctccaagctggcgaatgggggctttccctatgagaaagatctcattgaggccatccgaatagccagtaatgtggaagaccctagaggatatcgacaacagctgtgttccctgcgtcatagctgttcccgtgaggactctgggttcctgctctgttctggggtccaaaccttggtctccctttggtcctgctgggagctccccctgcctctttcccctacttagctccttagcaaagagaccctgccctc

SEQ ID NO: 617040 - DNA, 423 bp, Homo sapiens
gtttagctgctgagggggatacacttcttctttatttctttctaaaacaggatctcactctgtcacccaggctggagtgcagtggcacaatcttggctcactgtagtgtagacttcccaggctcaagggatttctcccaccccagactcccaagtagctggaactacgggtgtgcaccaccaccacacctggctaatgtctcttttttttggtagacacagagtctcactatttagcactgattggtctccaactcctggcctcaagcgatcctcccgcctaggcttcccaaattgctgggattacaggcatgagccacaatgcctggcctctgctagttccgtattctctagagttgtctttactttgtgctagtgtgtccctcattgtgctgatcctctgtaaaaattaatacctttttta

SEQ ID NO: 617041 - DNA, 938 bp, Homo sapiens
cgtgccgaccccgccgtgctcctcggcagcgttgctcggccggtttggtaggcccgggccgcgctggcctccgctgagcccgtcacccgccatggacaactacgcagatctttctggataccgagctgacaccttgctggcacggtacaaatccgcgcactgggcctgtattaggatcaactcgtaggctttacgagaagaagatcttcgaggtacgagacccagaggcggcggtctcgccccccagctcgtccgcgtctcctcttatagcttctctgacttgaattcgactagaggggatgcagatatgtatgatcttcccaagaaagaggacgttactctaccagagcaagggctacaatgacgactatatgacgagagctacttcaccaccaggacttatggggagaccgagtctgccggcccgtccagggcctgttccgcagtcaagtgacttcaattcccacgatgctgacgctttcatcaccaggtgcatgatgacgatctattgtcttcttctgaagaggagtgcaggatagggacacgcacatgttaaggcgggacagtgctaccagaagatcacgacagtagcgagctgtgacagcctccaaggagctccctgggacctgtcctattaatccgtagtttacttcttcaagattgatgtctacttaatattttctattaggctaccgacggagaatagggctgaaagcgtgtcctgggctggtggcaaggatgcaagccattgggaattgtgattcaggcatggaaagctctataaacagtagtgggtggaagacctaaagggcagtgttggttacaagtgagagcgggacacaagcgggtgtgagaaagaagtagacgagggagaaagaggacgaggggagagacagagagtaaagaggacgagtctcattggtctttcttttttgaga

SEQ ID NO: 617042 - DNA, 872 bp, Homo sapiens
  misc_feature (711)..(711): n is a, c, g, or t
acttgtcaagagagtaaaaaatttaccacccatagtaggcctaaaagcagccaccaagttaagaaagcgtcaaagctcactcacccactatctaaaaaatcgcaaacatataactgaacgtcctcgactagccaattggaccaagtctatcaccctataagaagaactaaggtcagtataagtaacatgaaaacattctcctccggtaagcctgcgtcagattaagaagactggaactgacaattagcagcccaatatctacaatcaaccaacaatgtcattattaccctcatgtcagcccaatacagagatgctcataaggaagggttacaaaaagtaaaaggaactcggcagactcttaccccgcctgtttagcaaaaacatcacctcttagcatcagcagtattagaggcaccgctcgtgccagtgacaccatgtttaacggccggggtaccctaaccgtgcaaaggtagcatagatcactctggccttaattagggacctgtatgactggctccacgaggggttcagctgtctcttacttttacccagtgaacttttgactgcccgtgagagggcgggcatgacacaagaggacgaagaaagacctatgagcttaaatttataatgcaaccgtactaaacaaaccacagttgctacaataccaaactgctaaaattcggtgggcgactcggaacaaaccaacttccngggttacctgctagaattcaccggtcaagcgaattatatatcatggtccatactgacaggacagtccctagggaaagcggcagccatttgagtcgctaccaaggtccacccggtgggcggaccacggggcggtagggtgcaaaagcctgtgggaacgaccg

SEQ ID NO: 617043 - DNA, 214 bp, Homo sapiens
ccttgtgtccattttcataaaatccaaaaccactcataagaactttgtcaggggccaagaaatgtatcgtggacattcaggtgaagatatcttactactcagacatcagtcagcatcccagatacaagagtctagagcctacaatacaaaagccatatgaatattatcagctctgtggtgttacacatctgtaacatggtataggaatgcaccc

SEQ ID NO: 617044 - DNA, 228 bp, Homo sapiens
tccccaaagtttattatctactaagaatgatggcagctccaagagttatcacgcttacagatgggggtggagagataccggtaattgtgtccgtcatgggaactccgggtccacaaaagttaagggaaagggataagggtggtaacattgggtttaaatccctaacaagtaagatggtaagggtcaattatattctcgaaacaatcacgtgaataatctccagaattt

SEQ ID NO: 617045 - DNA, 278 bp, Homo sapiens
gtatcatgcagatggactcttcatcacgcctccccagaaacattccctgcaatgagtccggaggagaggaggagagtctgtgtgaggagcgagagagagcaccaggctcagaggtgtccctatctaagtctcacggcagtccccagccatcttggctcatcccagagaaggtcttcatcggggaggcaaaagaaaacaattccatatggctgagaacttgtggacactgggcgatggcgtctgtggaaatggatgggtgaggagtcagggccgacaat

SEQ ID NO: 617046 - DNA, 224 bp, Homo sapiens
  misc_feature (210)..(210): n is a, c, g, or t
  misc_feature (220)..(220): n is a, c, g, or t
ataaacagtgggattttctggactattcatgatgtgaaataccattcagtgatgagaatgaaaaacctactgctatatccaataatatggatgaatctcacaaatattataatgagtaaaaaaagccaaatacgaaaaacaacaaaatgtagaattctatttgtacggagtttaaaaacagggaaagtgaatgttttattttaggagtcncggagagtcnctta

SEQ ID NO: 617047 - DNA, 102 bp, Homo sapiens
gcgtgcaactggatgtcttttggcataattgttacacgtatggcatggatatgcacacaggttggtgtcttcaaataacggccaacctagatatggcctcac

SEQ ID NO: 617048 - DNA, 169 bp, Homo sapiens
aagttgctcgggggagtaggtatgtgatcaggagtagggttaggactgagtgggacgaatgaaagagaggacgtcatagtttaagttatgccttttgggtgaggtgatgatggaggtggagatttggtgctgtgaaagttgttttatggtaatacgcttttcaaggtct

SEQ ID NO: 617049 - DNA, 666 bp, Homo sapiens
agcggagcggaggggcggtgttgagaccggcggagcggcgtgggcccctatgtggacggagtggacgctccgggaaagcgaggggcgctacgagctctggcccacgatgaacacacgactgacacacattcacacgacgatacccgggaaccgaaccgaacgagggagacttataagtactgacatcgaaatggaagggaagaattagataagcatgcagcagaaagaccatgcgtgtgtcatgataacgaataacagaaagtggaaagcatatctaggccataagaaggccatggaccattgaggaagagggggaaaccgataatagtgatagaactcaaggaagaactagaacagacggacatgcggcggatgatcaatcactagtagaaagcatggcaaaatacagagataagggaaaacttggaagagtgaacccgtagaaaagaggacagagtttacgccgggcctacataacaacgaggacacaagatatagggggagcagagtgcagtgtagatagggcataataagggcgagttgcacgatatagtgacgaaagaacgccagatcaagaacagtaaagtcaagcagaagtcgacgtgcaatgtaagaaacccgcaatatgaaacgatagtgaacgatacatgtgagacagaacacagg

SEQ ID NO: 617050 - DNA, 1041 bp, Homo sapiens
aacacatttcgtggtgaccctgttgggttctggtcttgttgcagtaccaatgcttatgaatgcggacatatatccttcgtaactactcaatgaaagtctccccaacgtggtctccgtatatatccttcttgctggattgttatcaatcgagagactaatcatacgctgggcatcatcctgttgtcatggcgatctctggacagcaccagtgaatggccgtgtgcgatacatacctagtctatccagatgcgatctggtagacaccccagtaattcgtgtgtagctatgtacaaacagaaccgatgtaaggtgagcagaagtcacacgaacatgggcttgcaatcatgaatccttgtggtggacatccgtacgacccctaatgctctttcttcatgctgcctggcataattctgcagtagacagcgattaggatgtcgcatcgtgggttagagctggtcgtagccaacctttctatccctgtcgcaattgcgggccctgaatagtagcaccgactctgtacgtggacgtaacggaaggcaggtacctccctgcaaagattgaccaaaactggagacgtttggttttgaagcgcggctgatacatttaccaaggcccaattcggcgaacggacacaggagtgcaagcagtaaaagtgggtggttaatgagactgcactgtacggcacgatgtatataggttaggacgcaaaggtgccctgtgcggaggacctgaaacggcaagtaaagcgcagaaccctgttcttttgtgactgcatggaatgggtcaatggggatttctgttcgggttggcgagattccaccgcattgtcttgatggactttcttagggaatcaactatttttatacccatgcaatctaccaggcacgtagcccattggaggatcctaacgaaagaacaggacatggattgcaagcaatgaaccaaggctttcctacaatcccgtgttgtggctccctggcagggtctgggtgtaaaaagcccaaactaatccttgtttctaaaagaagcctttactcttta

SEQ ID NO: 617051 - DNA, 174 bp, Homo sapiens
atcacgagatcccggaattgtgtggtgttatggtagtagggaagctggggcttagctgtccatctatttggagttggcaggaacaggatttttgtcttgtgcagcaaccttgcttgtcaagcatgctgattgagcaggaaaggcgttttcttttgggcataacaccacacaatt

SEQ ID NO: 617052 - DNA, 746 bp, Homo sapiens
  misc_feature (728)..(728): n is a, c, g, or t
cctgtagtcccacctcagcctcccaagggtgtgtgtgactacaagtacacactaccacgcccagctaatgtgttttttgggtacgacgatgggatttggccagtgtggcccaggtcgtggtctcgaattccctgcgattcacaagtgatcctcgccacctcagggccctcctaaatgtcctaggattataggggcatggagcccacctttgtttgcccctgggcccccttcaatctggattaagacacacaccttagagtttgtggctatggaggccatttttcctgaatgggccaaattttaaattaacttcgggtgggttggaaccttccctattccttttaagaagggtttaagcccaattccgtttgccccttttaaacagaagttttttcacctttccgtagatttattagtagtccaccaagtttcgttgtgggaaaaagtttatttactttccactttggtttgtgtgtcgcccaaaagaagttgcttcgtaaattaatttcgtaaaaaggtttttacgaagaggcggggggcatttttattaaagcgcgccccaaatgggggtggaatggggccttttctaaaagaatgttttcaacaaatttttcttacaacacttttgggggggccttttaaagcccaatatttaaacgggcccaacaagggtgggccaaattccgcggttccctttgtggggaaacaccccgggaggaacggacatntgtttccttccttaggaa

SEQ ID NO: 617053 - DNA, 581 bp, Homo sapiens
  misc_feature (233)..(233): n is a, c, g, or t
  misc_feature (238)..(238): n is a, c, g, or t
  misc_feature (249)..(250): n is a, c, g, or t
  misc_feature (274)..(276): n is a, c, g, or t
  misc_feature (283)..(283): n is a, c, g, or t
  misc_feature (306)..(306): n is a, c, g, or t
  misc_feature (312)..(312): n is a, c, g, or t
  misc_feature (323)..(323): n is a, c, g, or t
  misc_feature (325)..(325): n is a, c, g, or t
  misc_feature (334)..(334): n is a, c, g, or t
tgctgaatccctttctcagctcagagcagttttaagatttaattgggaatacagagaaacaggattgtttgagaaccaaaatcaagaggaacagaaatcttaacttgatttcatgtgttagaacatgtaccatgcctcttctgtatctgtggaagtttcctgtttgacacagggtatctaggaggggcggggaagacatggatagtataggaagacattaatcctagcattgncattnatatacataanngaaatcctgatgaggacctgcttnnngttggtnttcctttgaaacccagccctatngtattngtatttaaaantntgtacacantttgtataataatctgtaccttgaggtatttgggactattagaggaaaaactttggattcagacccttcttgcagttttaaaatcatcggttcatttctggtttttaaaaaaaatcttaatgggttggatccaaatcccaatacagttggaaaaaaaaataaaaatttggacttatttttataaaaaacacatttttaaaaattggtaaaaaaaaatattcgagggtttacctctagggggggggcc

SEQ ID NO: 617054 - DNA, 267 bp, Homo sapiens
cttctctatcgagagtggacgtatgctgtgcaacctcaggcctctggaatgcagtccctctctcatgatgcccgtctccctggttccttctcaatcagttccgcaaagagcttaccccagtgacccaacataatggggctcacccattcatactgtctcccatctacttgtaaggtgcttctcttttctttagtcgagacagagtcttgctctgtgacccagactgtagtacagtggtgtaaccatgggtcactgcagcctcgacct

SEQ ID NO: 617055 - DNA, 665 bp, Homo sapiens
gggagtccacaggagcggaatgtagtctagatcttgactgatgagccgtaaagctgcgggctggctctcgttattccggataacgactacatgctccgatctgtcatgtgccggccttcactcgtgtgaggggatctgccggacccctgctaattcagatttctttcccattccggggccttcctctatcgtcggcccccttcaccgttggatcatgttcaagatatttgatgaaaagagatgatgtgtccaactgcatccagttgattaacttcagtttattaacgggtattcaagaactcaattgtactagagctaatttccaggtatatgaaccatggctataatcaatatcatgcctacatgaaagatcctgtcatatatagtcacgatgccatgaacactatatgaacactccttagcagtacacaggtggagaatttactctttctttagacataagtagaaggtgaccttgtttatccaacccgtagagatttacttcatcaaatatccttgtgatcctgccatcaacagcaggttgataagatggagccatcaaatttgtactcatgtggtagcaaatatcatgtgtccaggcttaacttcgtcctggagtctaacgcttaatcctgctgcaggtagataccattgttgctatcatg

SEQ ID NO: 617056 - DNA, 322 bp, Homo sapiens
aaattccgctctctggggaattaaggatctctgggcacacaatcctcagtcagagaacctcatcaatcaggccatcccccgtgttgaacatatgggcaaatgactgcaccaagatctgattgttctatcgttacaaagaagaatcaccaccagatccaggaatgaggatactgcctcctggtcctgggctctcgagtgggtccagagccctgcccccgatacatcagccttcagaagggacttccaagcctgggaaagcctccccaggaggtatccttatagctaaacagcctagacagaagggtgcagagctgtgcctcag

SEQ ID NO: 617057 - DNA, 106 bp, Homo sapiens
gttcatttctacactgatatacattgccatccttgtccaagactcggaatgcctcacggatttcttcttcactatctgtatctttcatttttctagccatcatagt

SEQ ID NO: 617058 - DNA, 587 bp, Homo sapiens
  misc_feature (449)..(449): n is a, c, g, or t
cggttatagaggataccccggtccccgatgcacatgttatggtcccctgcacaagttatgaagagagtagtggttctcccagcacgcagttggagatctgagaacggacagactgcctacctcaagtgggtccctgacccctgagtaacctaaatgggaggcaccccccagtaggggcagactgacacctcacacggccgggtactcctctgagacaaaacttgcagaggaacgatcagacagcagcatttgcggttcatgaaaatccgctgttgtgcagccactgctgctggttatccaggtagacggtctggagtggacctctagcaaactccaacagacctgcagctgagggtcctgtctgttagaaggaaaactaacaaacacaaaggacatccacaccaaaaacccatctgtatgtcaccatcatcaaagaccaaaagtagatnaaaccacaaagatggggaaaaaacagagcagaaaaactggaaactctaaaaagcagagcacctctcctcctccaaagggacgcagttccttcaccagcaattgggaagacagctggctggggaatgactttgaggagt

SEQ ID NO: 617059 - DNA, 135 bp, Homo sapiens
  misc_feature (13)..(13): n is a, c, g, or t
ccccccccccccngggggggaaaaaaaacccccccttttcccccccccccgggggccgggggggaaaaaggggggggttttttaattttttttttggggggggtttttccccccctttaaaaaccttccccctta

SEQ ID NO: 617060 - DNA, 222 bp, Homo sapiens
taggaatttgagaccagccttagcaacgtggcaagactctgtctctaaaaaaaaaaaagaaaaattatctaggcttggtggcgcccacctgctgtctcagctacgggggaggttgaggtgggagatttgcctgaggctgggaggtgaaggctgcagttagctgtgattgcaccactgcactccagcctgtgtgacaaagggagactctgtctcaacaacaac

SEQ ID NO: 617061 - DNA, 156 bp, Homo sapiens
gtagtacactcgtcataattgaggtgagctgatgtctctcccctattgcaatagaattgacagcagttgcaacaattctgaatagtcttccttaacgttttagcaagcgccagaatgaatttttccttagcacacaccaactgaagtaggctggtc

SEQ ID NO: 617062 - DNA, 1160 bp, Homo sapiens
gacaagcttaaccaaagacatttacccaaataaagtataggcgatagaaattgaatagctgtgcgcaatagatataggtaccgcacacgggaacagactgacaagagattatagaccaagtcttaaatatacgcataggactaatccctatagccttcgtgcataatgaattaacgtagagaataagctttgacaaggagagccaaagactaagacacccgcgaacaagcagagcgaggcatacctagagcaacacgcgtaaccgaggagcagcagcccggtcatagtgataaggcacaaatagatgggggcaaagacttgtactacggatacgaggggcgaccaaagaagcattaccctgagaccatggtagtactaagcctgggtagatgcgcaaagtagtcaggaaatctttcagtgtgcaagctctgtacaagatttgggcccgaaacaagaaaatccacctgcgttagaaagtcacgcgcatttgggttagaaacttgtagaagcatagattaagtgccaaaaagacgtgaaaagcgaggacgtcttgtttggtggaccaacgttagaggacaataagaaaaacacgtaatgtgtaaggacgaatgcaaggtcaaacaaagaaatttgtaaaaggaagaacgcaaataggagtaagaggcaccgttaaaagaaaatgcaaaggagccaaaacccaaaggtgtaaagaggacacacaggccggattatccaagagggcatccagaggcaaacaccaacaaagagtataagcacgttaaaggagaagaaaagtttcacacacaaaaaaggaagttaattagacccttggagaagcgttccgcgttccaagcgaaggccccgaaaaatattggaggacaacacaaaagtccataagtcaagagccgacagtaattatgcacagggcaaaccttaacattggtattgacggtaatttaaaaggatacaagactgtgacacagaacaaatttgaccttcacattccccgggagatttaaagggccattggccgagtagaaggaattttaagaaaagcaacttggaaagcatgggacaatttgaaacaaaggaacaccaaaagtaatgctaacacaaaatccaagacacaaaagacaaaggtacacagtgtatataacccc

SEQ ID NO: 617063 - DNA, 959 bp, Homo sapiens
tcatatcattggtcgtggttgtagtccgtgcgagaataccaaaaaaaaaaaaaaaaaaaaaaaaaaaaaaattttggggcggctggggccttggaaaaactttttaagaacaatcgttgtgggcgcgcgcgggggcacccagagacgaggaaaggagaaacatgggcgacaaaagcggaggtccaaaggagaaaaccaggggacaatgagaaataggcggctggggagatcctacccaaaataaaacaaagcgcgccgggggggaacaccaagagagcgggcatgcgcgaaaaaaaactccccgagaagaggagcacacggggagagagcccaaaaaagaggggaacatccttataacacgagggagagtcaacaaagacgaagacggacgaataaatcaaaaattatacgccccgccaaaagtggggggcaaaaaaacaaaaaaggaaacaggaagagggagagagaggaggggagagagaagggaggaaaaaggggcaggagagggggacgagaagagggcaaaacagaggggaggggagaggagaagaagagggagggcgagacgagggggaaagagaaagcgacacagagggcgcgagagagaggagagagagagaaagggggaggagagggggaagggagagggggaggagaggggagagaggagaggagaaggagggcggagggagcgggcaggggggcagagacgagggaaggggaagggggaggaaaagggggagggggaggagaaggaggcagaagagcagaagagcaaagaacaaggcagcaagagcaggagggagaagaggaagaggagagaaaggaagaaagggacggaagaagcaaagcagaagaaggaagaagcgccggaaacaaagaccgaagagacgagagagagagaggaggagggtagtataagaacgagaaaacaaagaggagggaaacagaagaggcag

SEQ ID NO: 617064 - DNA, 651 bp, Homo sapiens
gcagctctgggttccaggacttaactgcttaacctaagagtttcactgaggctgctgtgtatttcgagcgggcagtttatcttttgctatacttattttcaattcaattacaccacgattcaaataattcccctcctaaaaccaaaaaggagggaaacgtcaactccattgcaattacttatcttcctattctatgccccggcgtataacagagatagaagaggaagataagtaattgcaatggagttgacgtttccctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttg

SEQ ID NO: 617065 - DNA, 220 bp, Homo sapiens
  misc_feature (29)..(29): n is a, c, g, or t
  misc_feature (41)..(41): n is a, c, g, or t
  misc_feature (52)..(52): n is a, c, g, or t
  misc_feature (100)..(100): n is a, c, g, or t
  misc_feature (137)..(137): n is a, c, g, or t
  misc_feature (140)..(140): n is a, c, g, or t
  misc_feature (158)..(158): n is a, c, g, or t
  misc_feature (163)..(163): n is a, c, g, or t
  misc_feature (177)..(177): n is a, c, g, or t
  misc_feature (191)..(191): n is a, c, g, or t
  misc_feature (204)..(204): n is a, c, g, or t
  misc_feature (210)..(210): n is a, c, g, or t
  misc_feature (220)..(220): n is a, c, g, or t
cgcgctataaaaactttataaaccccccngagcccgagcantgtgaagaagnggcgagaacgacccccggaccgaccaaagcccgcgcgccgctgtcatnccgcgtttcagcacctacgtcccgctgccgtcgccgncgncaccatgcccaagagaanggctnaaggggatgctaanggagataaagcaanggtgaaggacganccacanagaagatccn

SEQ ID NO: 617066 - DNA, 141 bp, Homo sapiens
tacatctatgcagcgcagacacgaaatacagaacgctcaggatatggtggtaccaggagacgactatgtagaaagttggagtcaaacactggatgcagaaatttgaggatttctcatacactttctctttataaaaaaaag

SEQ ID NO: 617067 - DNA, 1184 bp, Homo sapiens
gccggctcttctgctgctgttatgtctacttcctcctgcttccccgccgccgaccgccgacatcatgagtggaaatcgtgcacttgcagtgcctgggcagtgcggaaaccaactcggcgccaagttttgggaggtgatcagctgatgagcactggcatctgaccccacagggcacctaccacggggacagcgacctgcagctggaactgcatcaacgtgtactacaatgaggccacctggctggaagtacagtgccccgcgccgtgctcgtggatctggagcccgagcaccatggactcctgtgcgctcgggtgccttcgggcagatcttccggccggacaacattcgttttctggtcagacgtggttgctgggaacaactgggccaaggggcactacacagaaggcggcggagctggtggactcggatgctggatgtcgtcgagaaaggaggcctgacgagctgtgactgcctgacagaggtttccagcctgaccacactcccatggagtgcggcggagactgggtctggggatggttacacctcacgacgatcgagagaaaagagtcccgcggacgggaagataaccccagaacgcgggaagcagtgaaacaacggtaaaagagaggagagagaccgttcggcacgcaagaagcgataagaacaaaagagggaggggaaggaccatagaaaggccaacccgtatcagaaggcacgcaagggcatcgccaaaaaaacaagaagcagaaagaaaaccaacagggcgctcggcagtgaacagaaaagacatccctacaacagaaaaagacagagtacgagaaaaccaccaaaaaacgaatggacacaacgacaccaacacgatagggagtggacagagaaacaagacagagacgaagagaccaaaccagagacgaggaggatcaaccaagacagtgggcagggagagcggtgagaagggggacgaggcagacacagtggcgaaagacccatggaggaggacaagcgggggtgatgaaaaacaaaggggagccgaaaaacaccaggggacggcaaaaataacgtatacggacaccacgggaacatggagccgagagagaacaagagacgagaggcaacgaccgagaaagagaagagcggcggcaaggagagacgcgggcaacagcggcagaaacgcagaagagcca

SEQ ID NO: 617068 - DNA, 141 bp, Homo sapiens
cttggcacgaggtgggtataacccattgggctgcccaaggccatccagcctgagctctcctgcaaaacaaagcctgatgtggcacggagtggggttgcggggagtggagtaacataattatcatacaacataatactaatc

SEQ ID NO: 617069 - DNA, 141 bp, Homo sapiens
caaggttaaaagatactattttaaaaaaagaaaaaaattaatatatgagaacattatgttacaagtcacaagctaatctatgggaatgtttctactttacaattttaaataatgaaaaataaggtcgaatagtgctttgtt

SEQ ID NO: 617070 - DNA, 214 bp, Homo sapiens
tctgtgactctacctttaagttgtaccctcagaaggacgggtaagcaggaggcagggtgtccccagtgctgaggtggggagcttctacggcgcaagcttgcaccccacaatgaatccacctcgtgctccagtgcgcgcctctcccaggtctcagctctgggtggggagcagtgcgcgctagccgacagcgcatgttcccgcttaaactcggggc

SEQ ID NO: 617071 - DNA, 1673 bp, Homo sapiens
gctgttgtacatattatttcatcacccagaacccattagttatttttcctgatcctctccttcttcccactcttcaccctccagtaggcccctgtgtgtgtgtttctctgtatgtgtccatgtgttctcatcacttagcttccatttataagtgagaacatgtggtgttggttataagtgagaatatgtgatgttcggttttctgttcctgcgttagttgctaaggataatggccttcagctccatccatatccctgcaaaggacatgatctcattctttttaatggctgcatagtattccatgatgtatatgtaccacattttctttatgcagtctactatgtgatgagcatttaggtttgattccatgtctttgctatggtgaatagtgctgtaacatcatcatcttctgaaactggtagtggcaaatgacctggctcaagccaagagaagaaaacacttaacatgtatcctaggaaacaccttatttcctaagaaaaacacgaccagacttagttgtcaccaatcagtcatcccttttctggcttgtacattatggctcagcggtggggactcctacaggctggggaaaggcaagattcccacggtcgagtttggccacagcaggcctctacacacgctcggtgggcccagcaggcggggccgcaccccccatccttggtgggcacaaccactttgggggcataaaaaacctctcgctgacatgatccacccggcgccatcctcgtgtcgttcctctgcctttactgtatgacacaccactcctgccaccgaccagcacacagcacgacagacaacacaccacctccacgctagcagcccacgccacgtaccaacgcaccacacacacgaaggagaccaaggaggaaggagagccggccgagtaacagagagagagagagaagaagcaccgagagagaagcgcgacccagcaaggcacaggcgagggcgaaacaccgaaagagaaacgcaagaagcaggctgagggcggagaagaggacagagacaacacgacgagcagaggaggcgaggacgagggagcggggacgagaccgacggagagagagggacgtagagaaggcgaagaagaggccagaagcaggcaccaggcaggagaggagaacagaccgagaggcaccaagacggagaggggaacgaccggcagaggaaggcagccagaggacagagacgagagagaagcagaggacgcaaccggcacaggacgccgagcaggacacggaggagcggagaagggcagacagacgcaggaaggcgaggcgaggaagggcggtgaggaaggacgggacacagagccagagacggggcgagagaggacgaagggaaggagacgacgagaagcagcgacgacgaggacgagcaagagagagagagagggaggagacaggggggagaaggagagagagcaagaaagacgaggcggaaaatgaggcgagacgagcaggcgagagagggagagcggaacgaaccgcgcgccgacagaaggagacaacaagagacgagagaagaagcgacgaggaaaggacaacagcacacgcacaagacagaagcgacgagccaagagacaagaacacagcaaaaacagcgagacggcagcgagaagcaacgcacacccacagcacgaacacagccac

SEQ ID NO: 617072 - DNA, 883 bp, Homo sapiens
gggtattgctctctccaaatgcagaacttccatccactttatctggtgatctgatgaacagcatggggacgtggaggtgaaataagcatctttcagaataaggtttttttttttttctctctctccagaaaccaagggctttagaacatttggtagaacttctcgggaatcccttctcgtgaactggggtttttaccaataaaaaaccattcaccacattcaggggaagggagctctttcagtgaatatacattcacagtgttctggctctcacggaggaatgtggtgtggtccaaaagcaccaaataggggcacccgggaggttgactgtggtggtgttcctccataaagctcgttttaagtggcttccccggcgatggcttggatggctcaggtgggctttaaaggagaaagggcagaaggtggctagaagtcgaagtcatccaatatccaggggctaacgtggtacttggacccagggtaatctcagttcttaatcaggtccttcccaaagaccttacaagggagttggtgtatcctggtagattttggacgcctaataggtcacagaattggaaacttttagacgcagttggttcccccttagggtgagaagggttacttaattgaccacgtgtgaattcctactagtatccattataagatgtaacgtgggaaaaagtgaaacccagggagactgttgagttccctattggatttatgttattgggtgggcgggtcatcagaaagtttaccttgaaggtaatgaggaacgggttctggtggacttagcgccattccggggacattttgccaagggggaggccgggtggattcttggggccaacggggttgacggaggcaaagggtaaacggaaaattc

SEQ ID NO: 617073 - DNA, 115 bp, Homo sapiens
cctcacagactgcgcgtgactttttgatggatggccggggtttgggctttggtttcttagtgttcctccttaggctgcgaagaatattcctcctccgcgggcgcagtccgtgagg

SEQ ID NO: 617074 - DNA, 388 bp, Homo sapiens
tgcataatctccacagtaactccagttacagttcatcggctccagagagcaatggagtccaagcgtctgacagtatagtgataacgagtatgcctgtcaagtttcacacatagtgggagcattatgtgatccaggacagtcagtgcacagatgaatgcagtagcaaaagtgtgatgcatagtaatgatcactgtgcattatcggcattgcgcgaggcccaacgttgtaaggaatgactccaggtctatagcgcaaggtgctgtatggatactgacctttgcagctgaatagaatgatgagagtaaactcgtgcatatgaggccacatttgcatcactgagctattcctggatggctcccgagtggtgttagacaattcctcattagcc

SEQ ID NO: 617075 - DNA, 176 bp, Homo sapiens
cgacacgaggtgggtcccacttgaggggcagcaccagggacgcaatggtccaccaacctctcccactccagagcaggtaggggctggaacccccgggtcctgtgtgggcctcaggctctcctcccatctggtgaggagctgggagagagagctgctctccccgccaaaaaaaaaaa

SEQ ID NO: 617076 - DNA, 133 bp, Homo sapiens
atcaagatcttcgccgagagtcgtcggggtttcttgcttcaacagtgcttgcgacggaacccggtcgctcgttccccaccccggtcgggcgtccctatagccagccctctgtcacctcttcatcgcacactcg

SEQ ID NO: 617077 - DNA, 424 bp, Homo sapiens
catgcaaggcagctgtgatggattcacctctgtgcaagacagctatgacggagttgatagaaagtgtgagaacatgggccacccctccttggatgtgtaagtattatagacatcctagatgtaagtattacagacccctaccaggacagggaattccagaggaagaacaggatttgagggaaaaaggcggtaaattaattttgatgttcaataagcaagtcaaagtgctgcattccaggcagtgggctggacaccttaatccaaacccaacagttccgtacactcctataaccactcccactttacagatgaggaaactgaggtccggagacattcagtctcttcccaagatcacataactcatgagtggcagagcaaggatttgaacccatgtctgcctggccccaagcctgatgtgaaaagg

SEQ ID NO: 617078 - DNA, 442 bp, Homo sapiens
gactggtgtaggtgttgtgactgaagagagctgaacgaggagatttttcatgaccttcggaatagccatggcctcagtttgtacgacagttctgtagcatcagagctagagacgcctgaagactttacactcacggatgacatcaccaggaattgggcagctttcacatcccgagcagctatgctgcagaagagcgtattgaggggcgagtaagcagctctgcagacagccggccactgcctttccacccgccccaagaatgagttcgcagccaaggctacagaggatcaaatgcggctcctacggctgcagcggcgcctagaagacgagctgtggggccagttcctagacctgtctctacatgacacagttaccagcctcattcttggcggtcacaaaaagcgtgcagagcagcttggcacgtgacttccggcatcccttg

SEQ ID NO: 617079 - DNA, 306 bp, Homo sapiens
acccgtggcgagttcatgcatgtgtgaccaggtatatgagtggatgggtgaaagtggggtgtgtgcatgcggtgtgtacacgtgtgtgtgtgtgtgtgtgtgcgcgcccaggtgtatgaaagaatagatacacgtgtgaaatgtgtacacatgtgagaatgtgcgcccaggtatatgaatgtgtagatgggtgtatgtaaatgcacacatgaaatgtgcgcgtatgtgtgcgcatgagcgcccaggtgtatgactgtgtggataaatgtgtgggatgtgtctatgtggtgtatgcgcgcgtgagtg

SEQ ID NO: 617080 - DNA, 343 bp, Homo sapiens
  misc_feature (11)..(11): n is a, c, g, or t
  misc_feature (338)..(338): n is a, c, g, or t
  misc_feature (340)..(340): n is a, c, g, or t
tgttggccccnggctggtctcgaactccccgaccctcaagtaatccctactgccctcagcctccccaaagtgctgggattataggcaaaagccactgctcccggcctcagcaaaaatatttttaaaagacagaggtaaaaaataaatactttttcaaacaaaaaaactaaataaaattctcaacagcaaaccacactacaaaaaaatgttttaaaaatgtcctttaggcagaagcaaaggatgccaggtggaaatatggatctgcacaaaagaatgaagagcaatgggaaacttaactacatggaaaaagatgcatgacattttcttattatttaaantntat

SEQ ID NO: 617081 - DNA, 163 bp, Homo sapiens
tcactctctgccaagatccacagacacatgctccagagctagctagaggagcagcagcagctcagctcagctcagccctgcacagccctgcccagctctgagctccaaggacctgcctctgacccagagtgtaaggtagctcactgcgacagatgagagtcaa

SEQ ID NO: 617082 - DNA, 125 bp, Homo sapiens
  misc_feature (92)..(92): n is a, c, g, or t
acctgcaaactttttctgtaaagaccagatagtaagtattttatgctttgtgagccatacagtttttgttgcaactagtcaactctcaactnacgtggacagcatgtaaagaacgagagtgactg

SEQ ID NO: 617083 - DNA, 107 bp, Homo sapiens
  misc_feature (23)..(23): n is a, c, g, or t
  misc_feature (75)..(75): n is a, c, g, or t
cctggcaccatggactctttcangtcttgacccttcggccaaatcttcagaccaaacaacttcttgttcggccanagtggagccgggaataactgggccaagggcca

SEQ ID NO: 617084 - DNA, 292 bp, Homo sapiens
tagaggacccgtacatctatgctagaggaatcaaatcgattttacttacctctggcaaaaaagagagaacagaaaaaagtcatctattcagtatactgtttctatatagcaaaactgaatgtctaaagttaccttactgtccacacacagaagaatctgcatgtattggttggtggtcctgtcccctaaagatcaagctatacatcaattttacaatataaatacttgtactaccttaatgataaggactccttaaagttccatttgctaatgattaatacactgtatgggc

SEQ ID NO: 617085 - DNA, 120 bp, Homo sapiens
gacgccatgaatatctttgcccaagaagagctggcacgtccagaacaaggacaattgttcggcccgcttgccggccgtgacggagggccaagggccccggaagaagaaagagagagagct

SEQ ID NO: 617086 - DNA, 175 bp, Homo sapiens
ctgtgcttctgggacctccgtggtaatgaggtgctgggtcacctgttacaagtcaggagcctgtagggagacactacttttgtacaagtactgaatgctgcgacaagcagatacttgtaaaattaatattatttctaatgtcagtggcgactcggttcctggggctagcagccag

SEQ ID NO: 617087 - DNA, 359 bp, Homo sapiens
  misc_feature (68)..(68): n is a, c, g, or t
  misc_feature (186)..(186): n is a, c, g, or t
cttagctaggctgagtgagtggcaaatctcagctcatgcagctcgctctggttcacgcattctcccanctcagcttcccaagcatgtgggactacaggtaactggcaacaaggctggtaattttgtttgtattttagtagagacggggtttcaccgtgttagccaggaaggtctcaatctcctganctcgtgaatcgccccctcgggtctcccaaagtgctgggattacaggcgtgagccaccatgcccgggccaaatattttttattcaggatggtataacctaactgataataggtaataaggttaaatttttttattgacgtattttatttacaaatatcatgcactgctggtgtt

SEQ ID NO: 617088 - DNA, 276 bp, Homo sapiens
tcaaaaaaaaaaaaaaaacaaaaaaaacaggttttttggagtcagaatacctggcctagagtcccagctccatgatttttctttgttaaaagacagggtctctgccaggcgcgatggctcacacctgtaaatccagcactttgggaggctgaggcaggagagtcgcttgaacttgggatgtggaggttgcagtgagccaagatcgcgccattgcactccagtctgggcaacaagagagaaactctgtctccaataataataataataatagaagca

SEQ ID NO: 617089 - DNA, 364 bp, Homo sapiens
ctgaggatcccgacgcttcgacgtagactataagtgacttatgctctaagtcctgcctgccttacctatatcttgagtactaagttacagtgacactagtctcctttagtttccttgatattcccccagcgttttcccacccctggtcttttgaacattctgtaacctctctttcgcgagtgttattctgtgatctttagcgaagtatatttcagagtatttaaagatctagctgacagccagtactttggattctcaataatttgtattaagagatggaatctcgctctggacacccaggactgtgagtgcaatggaaacgatctggtctcattgtaacctctgtattacggtgacaagtggt

SEQ ID NO: 617090 - DNA, 327 bp, Homo sapiens
cgtactacccaacacaggaaacccgtttctattaaaaatacaaaaattggccaggcacagcagctcatgccctatatctcagcaccttggcaggccaaggagggcggatcacgaggtcaggagttcaagaccagcctggccaacatggtgaggccctgtctctactaaaaatacaaaaattagccgggtgtggtggtgggtgcctgtggtcccagctactcgggaggctgacgcaggagaatcccttgaacccgggaggtggaggttgcagtgagctgagatcggccactgtactccagcctgtgcgacagagcgagactctgtctc

SEQ ID NO: 617091 - DNA, 356 bp, Homo sapiens
gaatgagggaagaaaaaaatctttttcttctagaaggctgaccctgattatgtatccccctagtacagcattactgaaatacataggcttatatacaatgcttctttcctgtatatactcttgtctagagattcagtgcgtgtgcagtctggtgtggacgaagttgttgcgcaacaacttcgtccattaggattatctcggactcacggacgtaattgacatacggccgatgtgcatgctacaacgaccgatggcaccaaacagggagttaactcagatgtggacgaacttgttgctggacactcggcgttgttgacacaagctcgaatgaccacaccctgtcaccagtgctctcc

SEQ ID NO: 617092 - DNA, 1160 bp, Homo sapiens
ggagttgggaagagaaactgatgcttttgtatgccgccctaatgcagcactgtgccgggtgtactatgaggctgatacaacataagacgaaataaacgctctgtacagggaatggggtttcatcatttgtggggtgttagtatatagagtagctttatattgctcttaggtctggagttggccatgtacctatgtatcctaagcattcacggcagtagagctcctttactaacattcatgtaatggcaacgagttgtcctctacatttggaaagctaatcctaccttgtcagtttcaaccaactgagtcatcactcttacgaacaggtaacatccggtcagctagtttactatgttccttgactatacaacaggttataatactaccctgttcactttactaaatataagtacagtaatgatgcataattagaaactgaggtatctaaggtagaatgtactgtttgccttgacatgtagttaacaacgtcactgatgtacctcgctggcgtttaaacagaatactattatactatgaatcaggggcatttctcagaattaggtcacaaattcctatagcaactggcctcacattcgaatacctaagaacaccaagacaggttacagccggggtcaccgcacaccaacaatcatggttaacccaagaattgagggtgccacaaggcggcccttgggaacagccagatcgactcggcgcggacagcgtctgcgcccggacgacttacgccaaagcacggaaaacgcgggcgccatttggaaaacacgggggctcccccacaaggagttcatgcaaatgcaaaaacgccgacacttaaaacagaaacacctcgggccaaacaacgagcccccataggggcgagcactgtgccacacagagagagttaagcacacacagacgcctcgtgcgcagaacccatcacagacgcgcgatccgctaacgatgccagcagaccagatacgcagcgatcggtctcgcccgtaaacacagaggagtgtggccagccgaacagccgccgaacaaaccacgtctgaggccgtcgcaccccccctgcagcgtgcgtcgttctgcgacgttattttgcacagaaggaggagtaggaataccacagccggcgcagcacgacgcacagccgagcacgt

SEQ ID NO: 617093 - DNA, 249 bp, Homo sapiens
catactaaatactgacttcgcagcgtcttcaatttgtctgtactatgcacatgtagtctacaaacagccgctcgagggcgattggtattcgtcccactgcttgatttgcacttcaagtttggagttggactgctccagggtccgcatcttttctaggtagctccccagacgagcactcagggagtgctcgatctgcggcaatcataaatcggaggctatatggaaaatgactagttcccctaataatcg

SEQ ID NO: 617094 - DNA, 566 bp, Homo sapiens
  misc_feature (419)..(419): n is a, c, g, or t
tggcagattgcagaggtatactacatttttatgcactgtgcattcacattctatgatactgcaagctttgctggccaagctcaccaacgaacgttgaattgaccaaacatgtactaagtgcatgctgcagacataacggagactgaattttggagatctttgcttcccaaagaatcccctgaaaaaaaaaattttttttttacttctactaagtagcccagttttccaatcacatgaattttctggaatatttttggagagaagcagatttattgaggagctgctctttgttaccccatatatagacaaagttaaatatattctctgaattaaatcatcagagtatgaaggtaagatttagtcaagaagatacatttgttggactatggggccatctgtgtgcaacagagacctaaagntcaatggctaagcagtatcgaagttatctatcttcatgacatgtgagagtttgcattcaagactagtatggcgggcccatgagtcaaggactgcaggtatctgccattctattgctcattatctttacgcgaagggccttacctgcg

SEQ ID NO: 617095 - DNA, 279 bp, Homo sapiens
cgtcagaggttccggtgttaggcatacaaatcaaaatcacagtatcacctcacctctgttagaatggctattctaaaaaagtcaagttgattgttagcaaggatgtggagaaaaatgaacccttgcaccattgttggtgagaggttaattggtacagccattgtgaaaaacagtatggaggctcctcaaaaaactaaaaatagaactaccatgtgatgcaccaatctgacttcggggtatatatccacagaaattaaaatcagtatatcaaaaggaaat

SEQ ID NO: 617096 - DNA, 189 bp, Homo sapiens
attgtgaatccatgatgcccaacaaaggtcaggaagattggctgagctcgtgagataccatgaacaccaaccctgtgggtggactatatggagtactgccctgatcccatggacttatgctgctgaattcacagttggtctgagcagtccgtgacctcctacacgagcccaagttctgtttaccaatgc

SEQ ID NO: 617097 - DNA, 232 bp, Homo sapiens
ttcagggcttcctaccagagaatctgcgcgatagccatcagcaatctctgtctctgtagctgagaaacagaacagttcttatctggcattttgtacctgaaatgggtgcaaaatggatcagtgtctagatttcaggctcacctctgcactggtgcattgcccctatactcacttttgttcagggactgagttggtcatctcaagggagcacatgggatgtctacttatccat

SEQ ID NO: 617098 - DNA, 1183 bp, Homo sapiens
  misc_feature (327)..(327): n is a, c, g, or t
  misc_feature (357)..(357): n is a, c, g, or t
  misc_feature (363)..(363): n is a, c, g, or t
ctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctnactgggacctggcaaggcctgacctcccgnccaaanttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaaccaaaatgaaaaaaaaa

SEQ ID NO: 617099 - DNA, 113 bp, Homo sapiens
tgtctgtccatccagccctggccctcagcccatgatggttccggcagcaataaggggtatggggtaagggtgcacaaaatcaaatggttagtgtgtgtctggtcgaggctttg

SEQ ID NO: 617100 - DNA, 1155 bp, Homo sapiens
  misc_feature (327)..(327): n is a, c, g, or t
  misc_feature (357)..(357): n is a, c, g, or t
  misc_feature (363)..(363): n is a, c, g, or t
ctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctnactgggacctggcaaggcctgacctcccgnccaaanttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaaccaaaatgaaaaaaaaa

SEQ ID NO: 617101 - DNA, 278 bp, Homo sapiens
tcctgtatagtgctcaacgggcagaagacggtgcgcgtcccgaagacggggaatcggagaagtttgctgctgccgggtcgcctcgcgacgctgagagaatcgcccagtcctccgaagaccgcccatttatgaatcgcagctgcggccccgcatcgggcggttagtcctctgaggtgacacgccgagccggtagtgcctttccgagctaggaatgtgccgtgaactccaaagtttggactacgtcacaccggaattcccagcccggcgccgggtaccga

SEQ ID NO: 617102 - DNA, 308 bp, Homo sapiens
tgggaacggactctcctttgtcactccagcctaggccacaaatcgaaactccatctcaaaaaagtaaataaattaaaaaataacacatttctctgcacacaccctttgcacactcgtggtttcctccgtgcattgagacccgtggttaaactcagccttctcctctctgccgtgcctgacacccaacacaggcttgagtgaggctaaaaaacaacacagcccccttgccaggttatttccaattctgtaaacttgaccctcaggcggaccccaatgctgccgtggaaccatatgactattctctgata

SEQ ID NO: 617103 - DNA, 189 bp, Homo sapiens
  misc_feature (12)..(12): n is a, c, g, or t
  misc_feature (184)..(184): n is a, c, g, or t
gatctggttgtntagaagcatgcagcacctcctgcttcactctctctgtctctcctgctccaccatggccagaaacgtgcctgcttccccttcgccttctgccgtgattgtaagtttcttgagggctccccagccatgcttcctgtacagcctgcaaaactgtgagtcaattaaacctcttttnttcat

SEQ ID NO: 617104 - DNA, 1150 bp, Homo sapiens
  misc_feature (3)..(3): n is a, c, g, or t
  misc_feature (9)..(10): n is a, c, g, or t
  misc_feature (17)..(17): n is a, c, g, or t
  misc_feature (21)..(21): n is a, c, g, or t
  misc_feature (40)..(41): n is a, c, g, or t
  misc_feature (44)..(44): n is a, c, g, or t
  misc_feature (895)..(895): n is a, c, g, or t
  misc_feature (1049)..(1049): n is a, c, g, or t
  misc_feature (1051)..(1051): n is a, c, g, or t
  misc_feature (1072)..(1072): n is a, c, g, or t
  misc_feature (1076)..(1076): n is a, c, g, or t
  misc_feature (1102)..(1102): n is a, c, g, or t
  misc_feature (1136)..(1136): n is a, c, g, or t
ttnaagggnnaaccttngganaggccgcggcccattttgnnatngatgttactccctgggtaatgtctgggcccatctatggagcactgtgagttcgacgttgatcgctctcagtgatacacgcaggcagcttggcggagatgtgtgtcaagggaggaaccggacgctgcagcgcataccggcccgcgatctcatcggtatgaagcgatgagcacacagatggctcaagatagcatgatctcacagtcatgcctttgtgatacggtgcagctcacgttgtgtccactgctgtttgagggcgtaatataaccctagttgttgatccaaccctagggcactttacagtagggtgtgcagcgatacccgatagatgccatagaacacaacatgagtttaaagttctcacttgtgtggatattaaaggcatataaggcaggccctcgacgacaacagaggagcgcaaaacgagaggtacaagtgatgaaataataaacatatatttaggtattggctaccaagtgtttcaattcaactatcaacccaagttcttgatgcagtagttttaattatattgatacattatcttgtgctgtcatcgtatctgctctcgtagttcttgtttctgtctccttcaccgtgctccgcatatctatgtaatacctacatcttactgcacagcgagaccacttgactctgcactctttctcgcgattctataactgtaattatatataagatctgtacagtcattgtcttgtaggcatactcagtgagtgtgatatgtgtaggactttcatcgagatcatacaataagtgctgtgcagaagaagattgcgtctgatttatacattgtcaacacgcgcgagactagcgtctcaaccagcagatccgatgncgacgtgagagacagagcgaacgcattatgtcacaccacgtgtaaacattatatcgtctgttaataagagataataatctccactcatgcacgcatattacatgtaagtattgcccataatgtgcgttattcacatactgtagtgctgattgtntnctatatctgtgatgtgtggtnattngctgatactctagcttgcaattcttnactactactgtgtctcgtacgcataatttctcantgtatcttatcgcg

SEQ ID NO: 617105 - DNA, 291 bp, Homo sapiens
attatcctaaaacccccccccccctttttaaaaagggggagaaaaagggtttcaaaacggtttgtttcaatgggccctttaagtttagaaataaaaaccgggttaataaaaacaatgcctggtaaaaccttcaaaaaaaaaagaaaaagttttggggccccccttggtttttttttttggggggggcaggtttaaggtattagtttttaaaaacaggcctttttaaggggaaaaattggcccaaaaatttgtccaaaaatttttgggccccttaaaaaagtttattgggga

SEQ ID NO: 617106 - DNA, 1122 bp, Homo sapiens
ccgcaaaccttcgtgcccggcccgtcctcgcccccgcctccgacaccgccatcgagcgcgcagagcttgccccctccgcacaccacgcagacatagtcccgacgtccaagagcggccccgccgtatgctatcagataacaatcagcacgatacatgcggcgccctacggaccgaccatggctacttcaggcgccctggagcgctgcactatggacacagccaagcagcgcgtacgggccatctgcgcgcccatgctctagtccatgctggccgtgagcagcatcatgcaagtcccatcatacccaaggtggtccatggactggccatccatcgcccatctacggacctgcgtgcgtggcagatccatccatcgaccacaatcccgtgaatgacgaccatcagccatctacacagagcttccatccagacatggcgcagccggacctgcaccgctggcgcacatggcagacggcgcctgcgaccacacacgcgcccttcggccgcatacgagccaatcgatagggggcacgcatggacgctgcagggcgccacccgccacaggcaagcccccccgaacctaatatcgcaggcagccagtgcaatcccgtgaatctcgtcactcgatctcggccccgaagggtgcaatcagagcccgtcctaaagagctacgtcacttcggctccgcccccgtaaactcccggtccgtcccgaccggccgcggctacgcacgccccgatgcgtccgcgggagcgccccccgagcccccggcacccagaaaggaagagtcgtacacccgcggatcgcgcgggaaccccggcgcccccgaaccgcggccacacacgagccgcacggacacgccggcacagcagcaggacaatatcgacccacgcacaataaaccccgcgcagaccacagggggacgatgaaacccaagcaccaagcacagcacaccacaagaaagaaacagaggagttagaggcgcaccccataacggacgaaccgacacgtaaggaccgcgcgatacgcgaagggtacgccacgataccggcgataggcgccgcacgacatgcgcgggccacgcaccggaacgaacagccgcacagggagaccacaccagcacgg

SEQ ID NO: 617107 - DNA, 135 bp, Homo sapiens
ccccctcgggtaaccaatcacttcaaaattacttttcatgtctgtaatccatctaacctccattttagtctttattctctcagtcctatatatatcatctttatgtttatatctatactagtatcgctacacatt

SEQ ID NO: 617108 - DNA, 194 bp, Homo sapiens
agcttgtctaataggctatacgaaccaaagagtgtatcaaatggaagtggtcatcaggcataattggttccctgtggacctcgtgcaccgactgtccatgctctgtggggacttacacattcaagtttgacagttgaaaaaccaactggagctgcttttccaagaatgttctgttgtccttcaaatagaattcc

SEQ ID NO: 617109 - DNA, 103 bp, Homo sapiens
cggaatgtggtgggtactgggctgaggagatcccaggcgaccgaactccgctcaaatccagtaccaccagagtaaccacccttctgcccctgatcccagctcg

SEQ ID NO: 617110 - DNA, 524 bp, Homo sapiens
atcccctgtctcaccacctcagagtcatcattcaggcggtgcagtgctccaactgtatctcagcactgtgggaggcgaggcggtggatcacttgagtcaggagttcgagacagcctggcacatgtgaacctgtctctactaaaaagtacaggtagcactgtagtcccagctacttgggaggctgagacaggagaattgcttgaacccgggaggcagagttgcagtgagccgagatcacgctactgcactccagcctgggcgacagatcaagactccgtctcaaaaaacaataaaagtcaccattcagcctgaccaaggagggggccaggaaagaagtcggaaccgtggccttcgctgcttcagaaggggaggcccgtgctctgacttcagcttgattcactttggcctcagtcctcagttcccagggggtaacggcgttctgaggttgtcacctggtgcaagaccagctgtccccagggacacatctggatctcttggtgccaacaacggcaactccagagggg

SEQ ID NO: 617111 - DNA, 663 bp, Homo sapiens
tagcgtgtgccgggcaccaagttaagagcccagtaaatgttggctgttaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaggggggacgccccggccgctactgcaataaaaaaagcaaccaacagtagggggggataaacagaggggcatgcccaccccccaccacgcggccgggcaacaaacacagacggccccgtggtcgcaccaacccacaacacaccagcttagcggcgaacactcatcgccgacccacccgccgcaacgtaagcgccggggcgctgcagcgcccagactcctgcaacgccgccgccccacaaagcacaatactatgcggggacggcgatcaagcgccgaaccgggaagccagtccaaacgccgccccaacaagacaaccgacacaccacgagacgacacagatcgcaaaacaccatagcagcacaggcagagaacacgacacaagagcaacaacaccagtcgacctaaccaggagagacaaaaccaaccgcgcggggtctaccacaaacaaaaaaccacacaacactacacgcacaacaaacacgagaacacactcacgccacacaaccacaccacc

SEQ ID NO: 617112 - DNA, 321 bp, Homo sapiens
ggaaaaataccagcattaagctattgatgatacaagaagtgtccaggtgccgttgtcacgcctataatcccagcactttgggaggccaaggcgggtggatcacctgaggccaggagttcgagactagcctggccaacatggcaaaaccccatctctactaaaaatacaaaaaattagctgggcatggtggcatgcacctgtaaccccagctactcgggtgactgaggcatacgaatcgcttaaacccgggaggcggagctgcagtgagccgagatcatgctgctgcactccagcctcagtggcagagcgagaccctgtctc

SEQ ID NO: 617113 - DNA, 934 bp, Homo sapiens
gcacactagacatggcgcttgccagcgtgttggatgagaccgctaccggtgaaccatgcgcgggtttttcggacttgggggttgtgcagatctgctggatctaggtccaggagtctcagtgatggtctgagcctggtcgcgccaggttggggtgtcccagaagagccaggaatcgaaatgcttcatggaacaaccaccctgtgaccttccaacgttccgccatggatgtcataagttgcatgctgactcctagggagtacaggcgggtgcttacatgtgcctcccagacggtgaagacagtgtgatagagatcaacccatacctgctaggctccatgtgctgggggctgcatgggattgctggcttcttggtgaacggctgttggttcggcaaatgtcagaatctatgagcttcgaaataaggaacgcatctctgtagcaggtgcctccaaactgacttgccagccatgttgtatcagtacaaaaggcatggggctgtccatgggcaccatgatctgtggctggataagagaggccctggctctattacgtggaacacgtgaaagcgaaccgcatttcatggccaccttctctgtagggttctggctctgtgtatgccatttggggtcatgcatcggggctattcctaatgaacttgaggttggagcagcctatgaatctggccggcgagcctcttaccaagcactacagagatgcctaaacagaggtgcatcacctttacagtgcggaagatgctgaaccgggcccgcgaaagttgtgtctaatgaagtatggcccccccgaaagggggcgcgtgtgtttgggagagacggaagacaagaccaccacatttggggggcggaacattcgcgatacatgccaaggaggattaagttcacaaaaaagtgctgcttcgttttctcttgctttctggt

SEQ ID NO: 617114 - DNA, 999 bp, Homo sapiens
  misc_feature (783)..(783): n is a, c, g, or t
gctcattaagcatcatagaaatcactacaggagagaaaacctatgagatgcacgcgattgatgcaaaggatgcttgtactttgagaaggtcacagactagacttataacacctcagaaggaattcataacatgagagcagagacgcatgactaaatgtaggtgaatgtggagaaatcgtatgtgcacaatgaaacgtcaacagccctctatggagagtccgatcacgaagcgcattcatacgaggacatgaaactactagtgggatgcacatgacgtgtgggaccacctttcaatgcagggaaaggtcagcacgcctcatatgagtagccattcatgacgaacaggtcctactagatagtagacacaagtcattgaccctttcgtgctgaactgccaggagacaagggggtgcgtactcgaagctgctcgaaataacctttttcttggagcagctctcttcgaccgccgtatgcaggtggtgcgtgatgcagtataaaccgcctcaatttggagaggtagcctgaacctggttggaagagagagcgtgtggacactctgcagagcagctctgaagcagatcacctcaaccccagtcaagtggctatcagagagcagcaaggtggttcctatagatcaagtctcagacgatgctggtgattccatgaggggtcctgcgtcctcggacatggcgactcggaaacgtccccgtatatatcattttgcttcgtgattggaagcttcgagtttagacagtgtgggacgttagaaatcttggttatctnagaaaggcgttggctgaatgagcgttacagcgaaccaaggggctggtgttcacagtttgcgaagagaaggtcccaggttggtaattcccagagattccgtcacactggcaactgactcccataccggcgggggaacccgtaaactatggacgaagccagccgggaacaacagcagaggccaacatgctgggggaatacttcggccccgaaaaaggg

SEQ ID NO: 617115 - DNA, 368 bp, Homo sapiens
  misc_feature (14)..(14): n is a, c, g, or t
  misc_feature (66)..(66): n is a, c, g, or t
  misc_feature (92)..(92): n is a, c, g, or t
  misc_feature (95)..(95): n is a, c, g, or t
  misc_feature (100)..(100): n is a, c, g, or t
  misc_feature (140)..(140): n is a, c, g, or t
  misc_feature (178)..(178): n is a, c, g, or t
  misc_feature (183)..(183): n is a, c, g, or t
  misc_feature (276)..(276): n is a, c, g, or t
atgggaaacttatncttccttccaagtctgccatattggtgcgatgagctaaaagtggaacgaaanacacaaggaagatgcttcccactccnagnacctncccccaagctccgaccccacattgtggatgcaaagaaaantaatttgcccaaaacccactgcccaggggccccttccnttttngggaaattcatttctctctggatacccaaaagctggagcaggggccaattactcttgtctggacaatacttttattttgtaggagtggaggtngcctctgggcagaaggcagggaagacacccccgggtctgcttcagttgcaggcaaggtatttagctggggaaaaagaaattctctccaggac

SEQ ID NO: 617116 - DNA, 524 bp, Homo sapiens
aagtgtgatgtcgaacctgaccatagcgagttaatgtgtccatctccccaacatgtcctaaaaagcacctggttttggcatggacctaacaaatacccaatgctagcagtgtcacacgacggcagtccatccagggtgggtgccagtgtcataaaggttaggaacagctatccgcaagttactcctggccccacccagcaggaagttggggtccccccacaggctatgagctctatgggcccttgcatgtgacatagctcataagccctctcatccatattgtaatagttgagtacacccaattggcacccgctggcagcaaggggcacaacctggtgatggtgccaataaaactgggcccctctccaactactcacttcccttctcacagccccagccttgttacaccattggagcaatctggttgtccggatcacgggatcaatcctgtccggctttgaacaaaggtggttagtttcctaaaaaacccattgtgtctcagtattcaaaaaacattacaaaca

SEQ ID NO: 617117 - DNA, 236 bp, Homo sapiens
taaaatgctaggtttgtaaaggcttacttacccttaatggaaaccctggaattctgcgggggagggaaaggggaactgttatctcccaaaattacccttcattttaaaaaatttattgtccttgtgatttttttttttcctctgtgttccactacatttgtggtgctgcccattgttactctcttgttggcactcttacaattaaacattgtgtttgtggacaaattaaacacagc

SEQ ID NO: 617118 - DNA, 337 bp, Homo sapiens
atcgaaatacacatgtcaacgtcatatacatgtacattaactctacagtttctaaactttagaatacataatataccatataactagtcacctctcaaaatcacattgtcccaccacaatcaaaccaatacctacatataccacaaatctcagtacaatgcaattacctcctagctaggcctaatagcttacactccctcatgcacatacatttctcaaagggctagcaggttagctgggctcccaacccacctctacattccccaaacaacaacctctcaccccctcacctcccatacaggacagctcctaatacacaaacccaaacacaaaatac

SEQ ID NO: 617119 - DNA, 208 bp, Homo sapiens
tttcactgtgtagccaggatgctctcgatttcctgacctcatgatctgcccgcctcggcctcccaaagtgctgggattacaggcgtgaaccaccgtgcccagccttttctttttgagatgtaatttcactgggtgatgcccaagcgtggagtgcagtggtgtgatctcgactcactgaaacctccgcctcccaggttcaagccatttt

SEQ ID NO: 617120 - DNA, 292 bp, Homo sapiens
  misc_feature (144)..(144): n is a, c, g, or t
  misc_feature (178)..(178): n is a, c, g, or t
  misc_feature (199)..(199): n is a, c, g, or t
gcacttcctctgtaatatttggggtcatctctatcatcatcatagtcttctaagaattcttttagtcgcttagcttcattggccatttctattcctctttcttcttctctttcagcttctttctcatattcctgggttgtcttncgttctctgatttcccaattcttaggcgctcttnataagcagcttctttctctcngagttttctttcaagttttcttcgttcgtatgcatcttcatcatcttcttcacggtcccgtttttttgtctttttctctttctcgctcccgtt

SEQ ID NO: 617121 - DNA, 190 bp, Homo sapiens
tcacagccagtgtctgattatcagatacaagcttcagacatttcttttcgaaggcttattccagtttcgtgaggctagcatgaggctgtgtgcattctgccaggggcgaatttctagttctcaattatacccatgcagctagatgcatacgtcatctgccgatgtccgctgtcattgggtaccgatgctc

SEQ ID NO: 617122 - DNA, 310 bp, Homo sapiens
ctcgctatgtcttgctaattcaactacaagtatacatttatgaatctgatcacattttccagcgtaagctcaaaaccttatagtatctatccagggtcaatcgcagcatagaagtaggagcaagtctggtaagtacgaacaatcttgcaggcaatatatgaatctagtcgttaatgtgttcattacaaatgagaactagaaactagaatttacttccaaaactaaggcaaagaaaacttccaaagctaaatgaaggtaagccactataaagcttatttctgtcatgcacattatgaagctactcactggg

SEQ ID NO: 617123 - DNA, 115 bp, Homo sapiens
gccgtagtccctctcacgttttcgataggtcacttcggggtttcttctttctccttccacctaaataggatctggctgcaggctggagtggcatccggtggtgtgaagaatcagg

SEQ ID NO: 617124 - DNA, 192 bp, Homo sapiens
gtaggctaatgtaaatgttctaagcacatttaaggtagactaggctaagctatgatgttcagtagggtaggtgtattgaatgcattttcaacttacaatatctacaacctacaatgagtttattgggacataacgccattgtatgtcaagacgcatctgtataattaaaaaatttggagataaaaaaaaaaa

SEQ ID NO: 617125 - DNA, 123 bp, Homo sapiens
cctcacaccgagctctgccacgctggcctgccacccctgaaagctggccctggtccccgccctcggtctccacgtgtgtatggatctgtggtcattgtccctctgcagaataaagattgctca

SEQ ID NO: 617126 - DNA, 405 bp, Homo sapiens
gggaggatcccatcggggcttggggaagatatacctttgtattattccccctgggcgtagtccgttgtcttccacctgcttgtaaatcaatctctctctctctctctctccccctctctctccctctctctctccccatttcttttagagacaggctcttgctcttgcttgttgcccaggctggaatgcagtggtacaatcatagctcactacaatcctgaaatcctgggctcaagcaatcctctcacatcagcctctcaagtaactaggactacaggcaagcgccaccaagcatgacctggaatctcttttaaataggatagaatccttcctgaactggcaataatcttaacatgaaaatgcctagggtggtgatattgacctaaatctacaataggtatagac

SEQ ID NO: 617127 - DNA, 424 bp, Homo sapiens
ctttccatgaagctgtccctgacctctctatttaaaaccgcacttcctgccagggcgatggctagtgtctataatcccagttactctaggctgaggcggatttgcttgaggccaggaattcgagaccagcctgagcaacacagggagatctcatctctaaaattaaaaaataatccattgtggtgaatcacacctgtagtgctagcttctccagagactaagctgggaggatcaattgcacccaggagtttgaggctatgacagtgccaatacactccagcctggacagcatagggagaccttgtctttaaaaactaaaagtttacttcctatccccttctctggccttttcccataggaattagcaccctctgaaactgtattttacttgttcatttactgttccccctgccatctgtttagt

SEQ ID NO: 617128 - DNA, 426 bp, Homo sapiens
gggagtctgtgcttgctgtcggcaggggcttcagttcctcaccaagtggacctctgcttagggatgcctgagtgtcctcacatagcattcacatagagtgagtgatctcaaagagaggcagaagctgtaatgtcttttatgacctagcttcaaagtcacatgctgtcatttctgcaatgtcctattggtcatacacaagggtctccttggtgaggatctgaaaaggtctgccctatttggtgtgggaggggactgaacaagagcctggaaaccaggaggcaagaacccctggtggctgtcttgggtgctggctacctctggactgtttaatacctggcactgggaaaactacctcaccctatggaagacaaaaatgagctaaatcccttcacaatcatatttacaaaagtgagttccatttagatt

SEQ ID NO: 617129 - DNA, 382 bp, Homo sapiens
gattcgtgcgacggcagagacaccactgatagctcaagatgatttctgatgattttgcgagggagaatattatatatttcacaatatatcacaaaagagttgtgtaacactgtgaaagagagaggtgtgcgccacacttggagcacacagcccggaaccttgcaaagacaccgtgcaaatacacgatatcactgggaaagaatgtgaagacattggcaatatagggagcttaacagagcgggctttactttattaaacctctggaaggttaccaggaattcttaggctactgtgaaatcgaggggtctggaaaaggatggaccgggtgttgagacttgatggcagtgtggatttcaagacacaattttggctgtgtgaggtt

SEQ ID NO: 617130 - DNA, 348 bp, Homo sapiens
acacagttgaccatgagagcacagcgcatgaatactgcctcatagctcgagctgctggagctagtaactgtagagactaggcaagctgcctatttcagacagcgatctctagaatcaactcacaccatggcattgctgcacgaagaacctgtgatagcactgccaatgccaggagttggcccatcccatgtgagtggaggagaatgctattcttcactgacagaggatccactcgtaagacctgactatgatagtatggtcgacgagatatgccggaaggtggctggatcattggacggggctctacctgatccgagatggccatctgaggcattagatagccctctc

SEQ ID NO: 617131 - DNA, 213 bp, Homo sapiens
  misc_feature (213)..(213): n is a, c, g, or t
gtggtcgcagctaatctagaggtggtggggccaggctatgggagtggcaggaataataagactcgacctggataggtatggaaatggaatatggacgttccagagactataatggcagataccaggtgtggttatgaccgatactcaggaggaaattacagagacaattatgacacctgaattgagacatgcacatatatagatacacaaggn

SEQ ID NO: 617132 - DNA, 517 bp, Homo sapiens
tgtgtagtgtctagaggatccctgccataactgtgtgccaggaggaagggaggcgaatgctggggctgctggatgcttacttgaagacgaggacttttctggtgggcgagcgagtgacattggctgagcatcacaggttgtctgcacctctgtggtggctctataagcaggttctagagccttctttccgccaggcctttcccaataccaaccgctggatcctcacctgcattaagcagccccagttccgggctgtcgtgggcgaagctgaaactgtggtgagaagatggtccaggtttgttgctgataaagttggcatgagacccaaccgtaaaaggacacgccacggaagagagaagggttacaaggtgaagatggaagcagaatgccccaggctgagcgggaaggaggagaacaaaggcgggctgccccggctccatgaggaggagatggatgaatgtgagcaggcgctgggtgctgagcccaaggccaaggacccctgcgctcacctgcccaa

SEQ ID NO: 617133 - DNA, 1112 bp, Homo sapiens
gaggccaacgtcacgcgcggcgctctcgaattcggcgcggctcatggtccggttcgggtcctcgcgcaggtctccgctctggcgtgtctagtgcgcacggttcttagatgctcttgttgagataaatgactaggcttcttattcctctcccacggttcactcactgaggcttcatatcatctcagcatgcattgtcaatcgcttgtgtgcagacggtatccacatctgacatggtgaataggttctgcctaatagccctgcattgaagcgtttacttgatattgctacttggaatggcacgtgcataggaggtacccattcgaacgaaacaggtgaacgatgatttctcatgtgatacgcgtcgcactggagctaatctgcctgcggcggtgggcaatttgcgactagagtgcagggatctccagggcgactgcaacgatccgagtccaaagctgaggctgtctacagccttaccatgggctaagatgtgcttggcatgctgtcagatccgtatgattgatggactcgttggccacccgggtggaaggcactatagtgtacggaactctgtgtacgctgtgcaagggccagtcactaagtagagagagcgaagcaagaggcgacgcttgctggagagaccgtctagccagcactgttggacccaagcaagagcatattcggtctcaggaacattggcgccagtgtgggaccttgcaactcaggattccatcagtagttgaagagactcgtgacacaaagcccaaacgatcgtggacgatccccggtgtcggcccattttcatgaacggttggaatccctctgcctttcgaccaggtatcccactctgtccacttctccacctccggggtctccccactggagcaaggcccacattcccgatagcatctaggcttacggggcaccgcaacatcgcaccttgctccacatctcgagacgatagcatacagcgggtccccacccaacttcgcaaccatgcggcgctcccggccgcccatcttgcgcactccttacacgcccgagtataccctctcgtacacacccactcgcgcaaaacagcactccccctcgagcaacacactcaccccgaattc

SEQ ID NO: 617134 - DNA, 122 bp, Homo sapiens
tctcttgtctcaaaacttccagcagtctacatctcacccagaggataaacaatgtcaatacaaaaactctaagtgcccttgaagacctggcccctttacctttctgatgggacgaagatgcg

SEQ ID NO: 617135 - DNA, 1450 bp, Homo sapiens
  misc_feature (1384)..(1384): n is a, c, g, or t
ggcttggccaagccctgctctgctggactgcgggctggcggcgctcacccagctcctcacccgtcccgcatcttcctgtttttcttccctttctggttgggcagcaagagttgagaggaggcagatggcttccatcccagaaatcgctctcctctttccatccctacagagagggacagagaggcaaagttccttgcatccccggggcgctgtccctgtgagctcccggtgtcctgcaaacgttggcccctgaatcaccgggccagtgtgtgtgggatggggctgcgtagccaggctggcctcctggggttcactttcggctttcctaccccaactcttcctgtgtggctttgctggccttccactggggaggcatgtgggtttggagggcagatgagggcccgctggagaactgtacccctcagtgagggccgccaccttgatggtttttaatggataatggggttgacctctttgttccttccacatgtttttatgtttgaccatttgctcagctgagcttgtcttaataattggattcatggttaatgagccccacatgggagagagggcggtcttcattctgaacccatttaggcagcatgggcagccctcctcgccgtgggcggcatcagagcccccctgcccagtcttggggttgctcctggatgctgtctgggaggcttgctcatggtggacatcctcatctccccgtgcacgttaccgcattcagagcttgggtcacctggacactgaactcaggtgaattttctctgagatcccgggagaaggaggacagttctttggaaggttttccagggccgatcacggaaaggatgagaagggagaggtcctggtcggggacacaattacggtggcagtgtaacgccgggaaactttattgcatgaagtccctctcactccctctacctccctcttttacgtggactctgccaaagaccaggataccagaatgcagtggagtgaccaagtgtagtgggaccttgggaacccgagtctggagccaggcggctggggtttgcatcctggttctgcccctccttagctggctgacatggcacaagccacttaccctctctgagccttactgtcttcagtggcaaatggatctgtcaacaggccccattgcctggggttgttactgctgagattaagggaagctcgtccatagaagcacttagcgttgtgcctggcacatagtgtatggtggataaatgggacttaggactaaaactcatgccttggtgtgtttttgcagtgatgttttgttctggggtgcatcacaagagacaaggttcttggctgggcatggtggctcaagccaataatcccagcactttgagaggccgaaaggggaggatcncttgagcccaggagtttaagaccagcctgggcaacatggtgaagcctcatatctaccaaaaaaaaa

SEQ ID NO: 617136 - DNA, 101 bp, Homo sapiens
tatagaggatcccgacatgacccaagcatgtatgcttgctcgtcgacgtgtatacaccactgcggtgattgcctccctgtacaagttccgtcgagacgtga

SEQ ID NO: 617137 - DNA, 351 bp, Homo sapiens
  misc_feature (337)..(338): n is a, c, g, or t
gctacatctgaaaaagtaccttttcagaatctacaaagttgtgtagcaattcctgctctgtacacatctcttccttttagctctgaatcctgttaatgcaaggaagtaaccaagttttccttggcactcgtggccaagaacataacctccatcccacagtcagggcaacaggtccgtattgcaggtttcctggccatagtcaaaatagacagctttgtctgtacgccaactcgtaaattcgcccagtggatctcgagacgacgcaactcgcctagtagataaaaaggcaaaaaaaagaggcgggagggaagttaagacatatttgtttaaaaaacannagcaaattcacac

SEQ ID NO: 617138 - DNA, 380 bp, Homo sapiens
ctttttccaaattttagtgaagggtgaatattttttgtccatggctttctcaaaaagaatgaaacttttgcccccttttcagagtttttatagagatgcccaattgatatatttacctgtaatgggaacctgaaaaagttttattaaaccattgttcatagctgtggaggcattttaattccgtttcccaagctctccaaaaatcgtattttttaagtacggagttattcggtttggggggtggcttacagttcccacgactccattgtcccgatactcagttctttttacagggatcaggttcgtgtttaaccctgtatgttaactatgactggaattttgtgatattttggtaataaattaagtggggtcctttcgga

SEQ ID NO: 617139 - DNA, 1255 bp, Homo sapiens
cgtgacgcgtgggcggacgcggtgggtcgaaccacgcgtccgtttcgtcttagcagcgtaggccgagtcggtcagcgcctgtaggacctcagcggccatgtcgaagtccctagtagatgaagccgggagtggcttcattcagatgcctagctaggctgcacgcgaggcatggttgagacatgtcctgtggcacctgtgccgcctggacattgattcaccaaccatcacagcccgtgcaacactggtgatcatcgtgtagccatcgggccagcttcccgtatcaggtggcagacgttgaaggagtatgatgacacgtctggaacatgcatgtggctcgtcgtggacttctctcatgtgaaagctcatgcagtaaccatggggagacgcatacaagaatgttgcgcacaggcacggaaagaggctacgctgtctgaaccccgatcctactaccggtcccgtaggtgtgtggactctagaagcactacacagggagcctgagactccagaatctggcgttcgtccagggtgcggcgggaccctggcagcacggtgggtagctgaccgacacgggagccaatctcgaacatgtcaccgctggactaacaccgcctagaattgggagcaagtagctgatcgcgcaaacaattccctagagaggtaggacctaacgaagcaaccgtactcgcaaccgcgataggatcggcaaactccacgcccgcctacgattcgaacaagctggcatatgctcgctggtataaacacatcaccaagagtcaaaccctacaacagaatcgacaacgtctcccctggattcgcctggggaggagtcgaacacactagacatggccaccctaaggatcctaggcaagaaatcgggggaaggacagcattcgcgagttccatcgtagctagcactcgcctaggagtacagagtggcacacaacatccccctcagcaccagggtgacgcggaacacacaagaaagtaaacaacaagagaagcagaaagaacctcgagaaagctacaggttccagagtccttaaccctcccacaccacagtcaccactccactctcctttcacacccaacatacaccccgatcccctaaactactataatcaatataacctcagcacaccctaccacttatcacatcaacccatcacttgaatcgatcttccacctaacccaacacaaccaaccaccccacatacatacatcaataaaacaacaatactacaaatatccacaccat

SEQ ID NO: 617140 - DNA, 479 bp, Homo sapiens
atcctgggaacaagcatccaagagtaacggaactttctgagctggcaaaggcttaaacatctgcctgggttccagcaggcaacctgcccgtctgtacaaaaaactcaaagggctgagatgaacgtctttcctctcctgcctcccatgagacagtctcctaggaattcttggggaagtttggctggaagcttgccaactgtaagttggagaaacacacacctgacactatccacagatatagtcaagtagatttggatagagaatactatttccaaagtagtgtttagctcatctagggggatgtgtttatatatacatttgcatatacccacgggggattatgagctaattttttttataggacacagaattctattcaatgctgttaaatatgcaaatagtttaatctttttttcttttgttgtttgatgggaaattgtgacattccaagttgacttttttttattatctgaattaaa

SEQ ID NO: 617141 - DNA, 411 bp, Homo sapiens
ttcatcccaatacacaggaaacatggataaggaagttggcagaagtccaactgtttcccaatcagtcaaaggcagcaagcagacagacgccaggtatttgaaaggtcttctacacagaggatatacaactgtaagttggagaaacacacacctgacactatccacagatatagtcaagtagatttggatagagaatactatttccaaagtagtgtttagctcatctagggggatgtgtttatatatacatttgcatatacccacgggggattatgagctaattttttttataggacacagaattctattcaatgctgttaaatatgcaaatagtttaatctttttttcttttgttgtttgatgggaaattgtgacattccaagttgacttttttttattatctgaattaaa

SEQ ID NO: 617142 - DNA, 226 bp, Homo sapiens
gctcggccggttaagcggtctcacaccctataacgcctgccatacccaaaaacaaagcagagtgtataaatacaataagcctaacttacactaaacaacatttaacaacacaaaccaccatatcttataaaacacttacttaaatacgtgctacgaaagcaggcacctacccccctagatttttacgccaatctaccataaataaataagacgagaagaccctatg

SEQ ID NO: 617143 - DNA, 357 bp, Homo sapiens
  misc_feature (329)..(329): n is a, c, g, or t
  misc_feature (337)..(337): n is a, c, g, or t
gattaatacttctactatgcatatgtaataaatatccttattcttgggaaatacatgctgaaggatttaagggaaaaggtcgtaatatatgcaactgaatctaaaatgatccagaaaaaaataatatgtaaataatcagagacagaataagacaaatagagcaaaatattttttaaaatcagtgaatctgtctgaaggataaactgaggttctttgtactatttttgtaacttccctgtaactttgaaattatttcaaaataaaatggtttctaaaatagatactggggccaggcatggtggctcatgcctgtaatcccagcactttgngaggacanggcgagtgaatcacctgagg

SEQ ID NO: 617144 - DNA, 775 bp, Homo sapiens
ggagaggtggtcggagaagtaggaacctcctgccgggctcgtggcggcttctgtccgctccgcggtggtgaaggcgccttccccacaggacatcaatgcaagcttgaatagaaaaacaaattcttcctcctaagtcatggcttatcagttatacagaaatactactttgggaaacagtcttcaggagagcctagatgagctcatacagtctcaacagatcaccccccaagcttgcccttcaagttctacttcagttagataaggctataaatgcagccactggctcagaggcgtcaggcaacagcagtcaatcttcaggggctctctaaatacgtacagattcttgcgataatgtgtggacttttgtactgaatgatgttgaacttcagagaggtgaccagaaacttattcaaacgtggataaacgtgacatagatggtagcctgctgatgggttcacaagatactggctccaatactcacagaatgagataggacaaacaatatgacttttttaccacccatcttctgttatacattgctctttgaagagaagcataagaaagagactctttctatttattctagaattgccgcaaatgactacctgtgctataccacgagaattcccgtcgaaagaaacttgtactctgtagcctcttacatcacctttattatacaggatggaaaaaccataacttctttttaggacaaagttgttgccgtcctaagaaccttcttattaagctcctttaacgtctgacacaaaaaaaaggg

SEQ ID NO: 617145 - DNA, 1463 bp, Homo sapiens
gctgagtgagacctcacccactcctcagagagaggccgccctgtgtgcccacccatcagggaggcatggtgcgggagctgagagtgcccccaagagccccacgaacaacacacaacacacatatgaccaagcccagaacaccctgcggggacccagtgatggcaggaggaggagaggaatagggccaaggacgagccgagagccaacggatccagggactaagcaaaaggcacctcatggcagcctgaggacatggagaccaaggaatcagagctgtgatggattaatataggcacagccgaaggcactactgtacagacatcagggcctagccagcctggggacacgctaaccagagccaccacctggcagacacaagaggacactagaccagcaatcggcgacgacagcccaccatggactaaattggggagcaaagtagcaagtaatacacccacacgtgaacaaacacacaaagccacacggccaccagcgcgagactcagatagaggcagccaccattggacgcccacccgacacaataactacagcacaggggcccactggccgcgccatacaacacatggcggacatacacaccaacacacagaccccccacaagcgcaaacgcaacccgtaggggaatcacgcaagataacacccacacaccacaagcggcagctgggaacccgcccacaaaccaaagagacaacgaacagcgacggcacaacaagcggcgacaaacaggggaccagaaccgcaccgcgccaagcaccgacgaccacgggacagcacgcagccccagacaaaacggcacaaaaagaaacgaaccagaaacaaaacgaacgaaaaaccgaaccaacaaacaagagagaacaacgacaaaacagaccccgacagaggcgaaccaccacgaccaaaaacacgacagcccaacaccggagagagacaaacacccaagcagcaacaacgccaccaagagaacagaacgaggaccaagacgagaccccggagaaaagcaagcagaaaagagggaaagagaaaaacacagcgcaacgcgccccaacgaggagccaaacataagcacacaccaaacacgaacgagggcagcgacacggaaggaggaccaacaagacaagaaacgagagaaaaaagacggaccccacgacgaaaagcaaaaagggccacaaaagagaagaagccgaaaaacgacacaagaagagaagcaagaaagcaagacaagcaaagcgagacgaagagaaagagcagacacaagatggagacggaacggagagacacaacagggggcactcaagagagacaagaaaacaagagagggcgaccacagagagagaaaaacaaaacatgcgaagagaggagagaagaaaaacaacagaaagagaacgagaggagcgaggaggaaaagacaaaagaaagaagagacaaaggaacagagaaagaaa

SEQ ID NO: 617146 - DNA, 224 bp, Homo sapiens
tgcatgatagaatcggctcggtcccatgatgttgcagagagcccaacacgttaggtgctcaaatgttgtcctgctgtctgaagcaccctctctctgtatgaccatgtccctgaaacctcagactcaggagctcacaagatagtgcaaatgtggacaacattgccctagtttatgtactttacctaaaatctcaaacttcttaaaataccacatgatcatttcca

SEQ ID NO: 617147 - DNA, 721 bp, Homo sapiens
tggacaccgctaatcggttcgcaggacctgccgagatggggttgctgtggaccccacagggcggtgcccctccgttagagaaaggtgaaggccactggaggtggacatagaggagaggcctaagagcttgtacggaagccctatgtgctgaatgacctggaggcagaagcccgcccttcccagaaaagaaaggaaatactctgtctcgggacctcattgactatgtacgctacatggtagagaaccccggggaggactataaggccctggccccgtgatgagaagaattactatccagatacccccaaaccagattctggagtaagatccaacagtcgtataaacgcgttttaccccagcagagtggccagacttcctcgattctttgcagaagaggaagatggaggtggagtgactggtttacaatcacagacgtgcccccaggctgaggcgtcccccggacccagtgaagactggagcccgggtgtaaggcaaggaggtgctgtgtggctcccgaggagctggcccaggtcccctggaaatccagaaggttacaccaccacaacagtgcacactccccgcttctggggaaggaactgttttcagaggctcccatttatattcatctgggggttcacggaaaagccagaacctgctgttttcagggtgggtgatgtaatatagtgtgtacataattaagccaatatatttttaaaaacca

SEQ ID NO: 617148 - DNA, 938 bp, Homo sapiens
ctccggccgatcaagatttattggaggtataattgacatacaacaaactgcacatacttaaagtgcacaatttgatagcgaggggggtaaacagcatgaaaagtgcctgataacttaaaaatgaaaaaaatttcaatttacacatattattttaaaatagtacattctaatttttatgagacatagatatgtatttataaaaaggtagatggaaagagaagaaattggggggggttctaagagccaaatttactcagaaggtttagaaacaccaaaattaacagccagttttcttgattttcttcttgaagaagagattggtgttgacttatggtgagatatactatggccttgagaggcagtttcaacttgaaaagaagatgcaggttgagcaatcggagaggacttcaaagaagctgatgagctctcccgtggacttactttgacaatgttggaagaatctggctggctagtctgaactggagtgggttgagaactctgggcttccttattctcaaaggtctttgtggttggcaccctttttttaataacctggcgcctatagggagtgggatactcgagcctggggctggctggttccgggagtgctggtgagctggggacattgacgtcgggtcgtgtatggggggagatggaaggtgggactaagacaggtttggagagggctttttgggcaaaaattcctgggaataccacgggggtgtatccaggggatgggaagaagattgtaggggtttaagcgagtgctaagggctaaagcagaacagtggggagaggctgaggtggtgtggttggggggggggtcggaggtggggaggaggggagggaggggaggagagggaggggaggtggggagacagaggggaggtggggcggaggtgggggacggagtgtaggggaggtccggggagggcggg

SEQ ID NO: 617149 - DNA, 319 bp, Homo sapiens
tactaagtgccacattttcttaagtccagctctatcgtattttgggcattcgtcgattggtctccaagatcttagcgatagtgaagtggtgccgcgaattaaacatacggtggtgcactgtgtcgtttatagcagcatgatttatagtccttagggtattacccagtaatgggatgggtggtgtcaaatggtatttcgtagttctagatccctgaggaatcgcacactgacttccacaatggttgaagtagtttagagtcccaacaacagtgtaaaagtgttcctatttctccacatcctctctagcacctgttgttta

SEQ ID NO: 617150 - DNA, 652 bp, Homo sapiens
ggtctaccatgagagacacagctaggtcgctgaggtagtgagcccaccacagagtgccacagtgcagggcccccactttcagcgcccaattgcctgtgggcggggggaacagtcactggtgtctcacatcctgagactgttgtgtgaggcttacctttctgctaggattggcttcccgcagagggcagggcccatcctaagcagcttccaagtcccacaaaggtggcttgtgggaggattcggaaggagctgcattgtgggcggggagtgtgtgggtgcgtcggacgcagcaagtaaactagggaaccttgatgtgcacagagaaaaggggggacgtgatggtgacacatggatggtatgggagtgcggtcaagggtgggtgacgtggtccaatacagtcgaggggggaagataaaaaaacaagggtgggggctgcagggtggggcgagtggacctcatggggacaactaagagttagagttgggaaagttggaactatggaacgtccagagaatgcgaaagcaaggagaggttgcaagtagagtcgtcgtcaagagaggggaagcggaaggtaagagtgcttgttgactctaggactggcctttgaaagacggctgagggcctatgcatcctgacaagtggagtgaacctt

SEQ ID NO: 617151 - DNA, 1234 bp, Homo sapiens
  misc_feature (1234)..(1234): n is a, c, g, or t
gcgttgtcctgtgcctgcagatgacttcctggatgcagcagcatggaccccatgcaatgccatcggcatcgccaacttcgctgagcagataggcgtcgtgtggatgttgcaccagcgtgcccggtgagtacatctacatgcatatatggaggacggtgtgccaaagcaagacggatgttcttacaaccctgtacccacttgcgcaagcttggctgacccctacatacagcacgtggaacgacctagaaccgttgcgctagcgcagtacctgatggatcttttccacatgcccttgccactcacactatggcgtccaatgtacggaccttgctgaatccagcgcaccagcgccttcgtacagatcccaggcctgcttgcctagccgtggccggtgctgcatgcacaagctctgatatggcactgaccagcacagctatctcatgccagcactgccaggcttgcacaggacagtagccgcagaatacgctggcgagctaccggacctacactctggctagacaacgggcactaacactagtgctccacaaggcactcctataccggacgccgcaagcctacaaacacacataggagacaccacaacggcccccagacgaaccacgtgctcgcactagccccccttggaccccagggagcctggcccaccaacgcgcctagccgcgccccagggccctatggaattacctaacaccaaccccggtccgccgcagcccgaggcccacaagcgattgaaccgcggaaggagaagggcacctcggcgtaccaagagcgataagccccctggtctcacgcggccctcgatagcacaaatcgcacgccaaggcttgacaccagtcggcacatcccctatgtggtgctccatcacgagaggactacagcggaccgctgcacactacatgcccccccggtgcgctttgcgcgaccgggctcacggcggcaaaagagccgagggagcacccacaatgtgagagcaccacccggggtggacaacaagggacccagcatcagcgccaacaggcgagaagacaagcgagacgacccaaacagggcaaactaggacaaaccccgcgccccaggcaaggggggacgcacctagtcagtaacctcaggccacacaaccgcacagagctagccagggcacccaccggaggaaaccaagacgcactcaccattagcagccaaggacagcaataccaccacagagaccaaggcn

SEQ ID NO: 617152 - DNA, 259 bp, Homo sapiens
gggcaatggcacatacgatcacaaaggaagttcgacacgctgaagctgcagaagaaggcgcgcaaagagctacttgggaaaggagagctgcagccccagctggacagtgccctgcgggacgtcaacgacatgtacctgctgctggaggagacggagaagcgggccgtgcgccgggcgctgatcgaggagcggggccgtttctgcagcttcatcaccttcctgcagcctgtgttggatggagagccgaccatgctaggag

SEQ ID NO: 617153 - DNA, 540 bp, Homo sapiens
cggccgccaatgtaggggtttgaccttgcctttgaggttttctaaaagccagaacattggttcagcataaaggtaaagtgaggcagcttgcattctcctcaaatacaggtgacaaacaataagtgccctagggccttcaaggtgttaacttttgtggaacatacgtcccgtgatttggtatttccaaagcaactgtagattgtgatcactagggcggcaatgtcaaagaggtctgacgtcagatattgttaaaagggccttgttaggtttttagacttcatcctgtacgcttgtgttttgtaaatgcctgacccggcaagtccattatgttatatgaaaagagacggtcattcgggtagatcatgttttcacacgcagtggtgttttgtcctgagtctttactgggaagtctctgggtacccaaggtccctctggcacctttcattggaggaccacctggcttaagcgattttatgtaggctagttcctaaccgtgacgtgtcgatgtgatgtgcaaaaatgtctgccctgaatgtatat

SEQ ID NO: 617154 - DNA, 340 bp, Homo sapiens
acgcagcggcgtggtgggagccgatgctgcccgccggtgtctggctgttcgccgccagcctcgttcttggggcggcccggttgttgctccgcttcggcggcaaacggtatcgcccggtgatcctggcgatgcgcaagtcggggaggctgtcgcgcgccggattcaattcgtggcgctattgggagggaagatggtgatgagcgaactcacgacgacgggccatgatttcctgatcatcctcgccaagcttgctgccgctttcctgttcggtggcctgatcggcttcgaacggcagatcagacagcgcaatgccggcctgcgcacgatggtgctggtggcc

SEQ ID NO: 617155 - DNA, 152 bp, Homo sapiens
gatatctttctcttcccagtctctcatctcctgccttccccacacactgtgtggttctgtcctcacccttggccaaagaaattaaaacaaacaaaactaccaacaaagaagagagaaaaattattgaaataacacaaacgggctttggacat

SEQ ID NO: 617156 - DNA, 971 bp, Homo sapiens
  misc_feature (42)..(42): n is a, c, g, or t
  misc_feature (45)..(45): n is a, c, g, or t
  misc_feature (107)..(107): n is a, c, g, or t
gctgtggtgagatagttaaaagggtgcagatgtgttctcttnttntagatattttctatctctcacttctcagggatgaaatctttttcaaagtttgaagttcctgnaacttagccatgatgtgagtggttatccctagataaaattaaaaggatttttaaaaagtaattactgcacataacaactgataaataggtaatttgaactacacttttaccttcttacagctccttggttacattatttggtctattgtctcagctatacaattcaaatttataccatactattgagctattacactattctactagattctcagggaagaattctagtcagatcacatgtatgattatgtatttatgtattaacatatcttataccatgacacttgtaaatatttcatctaactattgcctgcaatgatgacgaccagaccaagtgtcatacagactttatcattgtacagaaaaatctataagtctgcccattatttacacatgatgatctaaaaaaaacaacagcgtacacatattagcccacaagagcagtcctaagccaatcacaattacactgtactaccccaagaagactgtaaatcgtgaagcatatacctttcaaaaaatcataacatttcctatctcttggtgggagcagcacatcgtggacatgtgaatcttcactactatcatagagcttgtcaacaaggacatcgatgctgcataagtggtctataggataacatgtctcacaccatctggtgacgactggtaggcctatctcataattccggtttatgcagcacagctgacacattggcacagcgatcaagtgaaccactccgatcacccgtacacaggcgacacaggacattggccacgcagacactgacatcgacaagaaacaccaaaaaacaacgaccccaacacacccgaaaaccaaaaaccacccaacagaacgccacaatcgca

SEQ ID NO: 617157 - DNA, 683 bp, Homo sapiens
aatgttcgatattcatactgcccttcaccctcccatctgtgtacagaaggctgctttccgtaagctggtggcaaaccatgccttgctacattcccgggccctacacagagaaatcctggtgggcacgcagacaaggatttcaagggagaaggcagtaaccgaagtcgaactgtttctaagagtatgcaagtgcccggtgattgacgtgcacaacatcagcatcctgcaattgacatttcaacatcacaggatgatgcgtcaaaagaagaaaagtgagggcctgtgccctcgatttcttctgaaattgtgctgtttgtgaaattcactcgtccacaaagagtctgctaatcactaatgtgaggaactatggttgttggcctatgggcaggggaggtgataaggccttagaactgggaatctagattcgggatctgatcacttgactgagcaaacttgctctttccttttatttaaaacacaaaacaaaacttcctgaactaaagtcacagtacagaatagaatgggatggacagaaagactcaagagggcagctccgcaatggctattttcttgattcagtgctatttctggcatcatgtgctgcaatgtgaatttttgcttttctctcaggcctgggattcctcaggtcacacaaggtgccagcagctctactcaatcgttta

SEQ ID NO: 617158 - DNA, 213 bp, Homo sapiens
cttttggggtctttgctgcatatctatctccctgaggtttttataaagagggcattgatgaatacagagaatatcctcaacaatatttcagcaatcacaatgaaatgttttatgaggatatttttatactgaacttcaggacaagcctagagtaacggttgcgagagaaaagagaaaaaaaccatttcggtgcctgagagaaaaaaagaatgg

SEQ ID NO: 617159 - DNA, 161 bp, Homo sapiens
gcagtctataacctggaaactgctcatgatctgtgtaagttacggtaagcagttatacccttaacagctcctcccagagagcctacatttgtccaggggcttaagcggataagctgtgtctaactgcgtatatcagggcaagcagagagaagctgtagcga

SEQ ID NO: 617160 - DNA, 363 bp, Homo sapiens
  misc_feature (125)..(125): n is a, c, g, or t
  misc_feature (128)..(128): n is a, c, g, or t
  misc_feature (131)..(131): n is a, c, g, or t
  misc_feature (133)..(133): n is a, c, g, or t
gcgcttctgcaatccaagccgactgatgactggagaggatggctactatttcaccaatctggtgagtaagtgagttcttggcgttgtggagaaggactaggaaggtggtggttttggggatgtgntangtnanttatgcccatgacaggtgaatgcttatgtgtgagaaggcaatacggttgaagaagctcactttgtattagggtgaaatcactgtttgtcctgccggatgcttgcttgattttttggcttcttatttttaagtagatcgaaagcaataaaaattctttgaaatgaaagaacttggtcacaggtttttcggtacaacagtaacacatctttaatccgcctaattcttgttgg

SEQ ID NO: 617161 - DNA, 254 bp, Homo sapiens
  misc_feature (189)..(189): n is a, c, g, or t
  misc_feature (215)..(215): n is a, c, g, or t
  misc_feature (225)..(225): n is a, c, g, or t
cctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtnagccacttcaccaggcccattttctnctaaaacttnaagggcaaatcattaataatgtaaccagg

SEQ ID NO: 617162 - DNA, 151 bp, Homo sapiens
agctgatgctgtggtcgttctagagatccccattactaattatgacattcagactgtcccagtatttggccgtaaagccccttcaagctggaccctgtgtccttttgaaaagttcccatcattctttgagcactttcttgctctctttcac

SEQ ID NO: 617163 - DNA, 429 bp, Homo sapiens
acttttatatgcttggggagacaggatctcagtcggtcatccaggtaggagtgcagggtgccatcagggcttacggcagcctcaaccttctgggctcaggcaatcctcccacctcagcctcctgagtagctgggaataaaggcacatgccaccaaggccacctaatttttttttcttttttggtaatttggtagagatggggtttagccatgtggcccaggcgggtctcaaactcttaggctcaaacgatccacccacctgggcctcccaaagtgctgggatcacaggtgtgtgccgccgcacctggcccccagtggctttttatacacaagttttagtccctctctggctggctcagcacactcccttccacagaagcagcttcggaactccagtggccgtgcggctgcccaggacaagagacgggaa

SEQ ID NO: 617164 - DNA, 303 bp, Homo sapiens
tggttgctggtcaaagggaggggaggctttacaagcaggtgtgggttcccacgtgggcacaaagtggccccctgggcaaattcccctgggtatgcctttgtgccacaggagcgattatagtgaccccagttttctgcaaaggctgtgaaagtaaaggcgttgggaggtgggaaatgattgtatatgtgttggtttcgtccagggttcctagctcataactcacatgaccatggttacagtcttacgttgtcatgttggggtgcctcaggcctcaaaaaacagccttttgtttttttgaaaaaa

SEQ ID NO: 617165 - DNA, 691 bp, Homo sapiens
  misc_feature (613)..(613): n is a, c, g, or t
agcagaaggttgggttccagtcaagtgaagaggctttctcctgtgagatgtagcttattacttggactcatttaagaaagagacttatattacctaaactttgcaaatagattcttccagaaaattttgcctgggcagtccctcttgctgctctcacatatgctggtttttttttttggtggtggtggttggttggttggtttttttggggggtaataggaatcctttataggcctgaaaaaaatttagatctagtactaaaatatacatattcgggtggacacggttatatataggtgctagcctgatgtatctctggtgctcgggatcttaactatttcatataacttgggaaatggtccagctagaaactctggagaaaagaccattagacttgtagccagaaaggtgtcagctgacctttcatttcacggcttttaaaagctttaaagagagtgcgtaattttctccaaaagcattgtggagtgggccattgggacagtcacctgtcggctttacctgcatcctaggtgctaaaactttacaagtgtttctctgggacacaggcatggatctctaccaatgaataatcgcacgaggggaatgaccgatnctcactggcgttgaaagatacttgacgactgcgaagtgcacctcttcgcctttggcacacaacacaaacaacacctgc

SEQ ID NO: 617166 - DNA, 334 bp, Homo sapiens
cgtgcttcagaccggtttggggtgcggcgcccccctgggcccgtgcagggctcagctcggcaccagctttgagggcagctcaatgaaaaagtgaatgcccccccccttgttggggtggcctggcatggcctggtgctatcggcacccgctctcccctccccgactgatactcaattacgtgaagccaagaaagatgttttttagaccctttgcctatattaggttggacttatggccatattttccagtgtttcccaggagaaaggggccttacctgcccctttttctctccccccgttgtaaataaacatgtgtttaatccaagttaaagcta

SEQ ID NO: 617167 - DNA, 121 bp, Homo sapiens
acagcagcaacaagcaaccaggagcccaaagacacctactacatacctgctcctccaggcctacatacaccaccataagcacaagggtcagcataggcagggtacacccagcagacaccga

SEQ ID NO: 617168 - DNA, 911 bp, Homo sapiens
cgtggtggctcaagcctgtaatcccagcactttgggaggccgaggtgagcggatcacaaggtcaggggtttgagaccggcctgaccaacatggtgaaaccccgtctctactaaaaataaaaaattagccaggcttggtggtgcacacctgtaatcccagctactcaggaggctgaggcaggagaatcacttgaacccgggaggcggaggttgcagtgagccgagatcatgccgctgcactccagcatgggtgacagagctagactcagtaccccacacaaacacacacacaaaaaagtcacctaccaatagccacagtccctggaatgatttcttctactgtacacactgactaagagaaatacaacttaggacatcttactgattcttaagaggttaaggtgtcatccggccttcgtcactctgacctgggctttacacgtatacagatctatccttattagctatactgacttcgggcaaagtactcgaccaactcgaaactgcggcctctccttttggtcacaagtgccggcaactaaaaactacaccagggtggctgttgcacgcatgaaactgaggcctttcatgtaacgtgaattagaagacatgtcttgacgcaagaacagccagaaaatcgtactactacggaaacagctgggagagaggggcagtaccgagatagaagcagctccaggccaccaacgtcatggagagacagcaaatacagaacaacaagaaaaatggaaccacaaacaccagataggctaaagggggcaagttggccaaagacatggcccgaaagaaacctgaaacaacacaaaaggagataagaaataaaaagtaacaacacgggaaaacgcaaccgaatgtacaaagggcaagccaggaagagggcaagcgacacacaag

SEQ ID NO: 617169 - DNA, 1256 bp, Homo sapiens
  misc_feature (1256)..(1256): n is a, c, g, or t
gggtagaggcataaagttcagcacagctcacaggccacatccgttggttatgggccgtcagaagccatcatccatctgccagacctggtaccacaaagctcctaatggtaacacatcattgtcctcattcaacattggctgtagtgctattggagggctggaaagtcacatctcctggtttatccgtgtgctctgttaggtgtcaggcgacatccgccgccccatatgcaagattgactcgagccatggtaggtggccagactgtactaacgacagactggatatgtgtcaagtcatcctggtgagcctgcagcttcaggcaagtgatacactcccgtacaggtacgatagcatggcagagtcgatgcattaaacttgccattacaacacgacgcaaggccgtgtcgtggagaaggtcgcattgtccgtcaagcatggtcatcagcaaacacccctcgtggcaacagtggagtcgactaaagaactcatcttcttctagacacgagggccacggccaacgcatttcctatttggataaacacgcgatggccacgaagtaatgagatcaggcttcaatcggcagtccacacgtggcgttatgagggccctaggtcaatctagaagatcgtccgggcacttaaagggtcctccagggttctccatggcccctggttgcgttgcgttgaagcctccggcagcgcgaagttggcctcagtatgtccctgaagacctcatagtcttctcctgggtggtgggccaagggcccctgcattgcgacaggcacccttgctgcccgggcgaggccccaccgtgggggttgctccaccctatggccgccaggccagaaacgttcctcgcagggcccggcgccggcaaacaagggcaacagttttcccgccaaggggcagcgggcaaaaccgggccaccgtgagccccgggccgccccaccgcagctcccaccgagacgggcctccacgggcgccgcgaaccgcgcgccacaagctcgggacgcaccactggccaaaccgccgcagacccccacgcactacgggggggggcccccacccccagagaggcgagctctccccccaaggagcgccgccccctgctgcagcggcgcgaacacgcgctgtaagggccacccccaacgaggcagacgacgacggcccaggcggcacaacgaaccggaccagtcaaaagcggcggtacaaacagtgacgagacacccttcgaaccctggttatggctggctgccn

SEQ ID NO: 617170 - DNA, 803 bp, Homo sapiens
tggacgcgtaggtcagcggaaaacgcgattgagaaatggaaaagaaaatgaaataaatcagcagttatgaggcagagcctaagagaactatggcaccatcaggtgactgtcccagaagtgaatcgcagggagaagagcctgctgacgtgcagatgaggcgggatctcctgcaggagggagtacagccagaggagtgtgtggccatcgcgggctacgcttgccatcagattgagacccgagctcagttttgtgaagaggagaaaaaattcttatcctgcatgactagaaccatctgcagatctgcgtcggctgggaggtgatgcgtgcgggctgctgtgggtacattccggcaaaccatgtgtgggaagcacgtggcatgcagttacagaccccggaggtacatcgtggccacgggggatgacacgagtacttcagcgcagctatggaattcttgaaactccacttgggggatcgttcggcaagaccaagcgcgacgaacaattaatataccaacagtgtctatcctgcagaataaagaatccctgaccggataacaagtcagtcctggacgtggcgctagtgcggactgggatcatcgagtctcttctgtgctcatctaatgcgcggcctagagcgggtgtacggcgttggacggccaagtgagatggcaccagccacacggggctggctggtcctgcggagcggttttgctgactttttcacgtgtcccgccgcagggtgggcgtgtggtgttgcccggatggggacgtggcgggctggtggatggggccggccggcggttg

SEQ ID NO: 617171 - DNA, 415 bp, Homo sapiens
gagatcctttggtgcttctgatctagcagcaagaaaatgaggctaggaggtatccacgtggtctcatgtgttgatttgagaaaagaagaagtctttcgtttgacagctgagaagtcgtgttaggagggcaccgtcaacaaaataaacatgcgctaatggaagccgattgaaagcaggtgacagagcacactttggaagcactgctggagtggggcagaggggtacttgcatgaaaatgcctggggacctctgacgacactgttgggatggtgaggcacttgttcccttttggtcccaccggtggcctaaagtgtggtctcagagtgcttgtcttctgcttgctcactgggtggggcttgtgagcatctgttctctcttcctaggatcacagaagaactggaggttcctggggaga

SEQ ID NO: 617172 - DNA, 138 bp, Homo sapiens
gtacccacgcttgtgtctcaggtactggctctgtgccatgcctgctgtggtagagcacctcctgcagagggtgggaggagagatgagtccgtatgccggcccctcacggaaggctgcatgctgggctgtggaggggcc

SEQ ID NO: 617173 - DNA, 497 bp, Homo sapiens
gcgccgggatataatgttctaggccaatgtatttcaggatgcaagaactaatcctaatttaaaacagactacaaacctagagttaaggaaaggaagcactcatggtcatgtccaatgttttcattgcccttctgttataacactgcctgggagaacacagaagttattagtgacaatgagctattaaggcaaaaagttattttaaaaaacagtaagaatacaagaaaggactggaaaagataatgtatggttttgcttaaatgaataaggattagaaagaaaaagaaacagggactagacaatcaaacaaaatggtgtaagagggccgagagcagtggctgacgcctggaatcccaggattttgggaggccgaagtgagaggatcatttgaagctaggagttccagaccagcctgggcaacatggtgacacctcatctctactaaaaatacaaaaattagccaggcgtggtggcgcacacctgtattctcagctact

SEQ ID NO: 617174 - DNA, 187 bp, Homo sapiens
  misc_feature (6)..(6): n is a, c, g, or t
  misc_feature (67)..(67): n is a, c, g, or t
  misc_feature (129)..(129): n is a, c, g, or t
  misc_feature (131)..(131): n is a, c, g, or t
  misc_feature (176)..(176): n is a, c, g, or t
ggtggntagctggactaaaagcggctcatgtggagaagcgggtggatccagaggcagatctgtgtcnggcctctcccaaggctgcagaagctgctcccaaaccctcccagaagtcaagatatttttttntnttacatgaatagggggccaagctgagccacaccgcaggtgggctngtgactacctc

SEQ ID NO: 617175 - DNA, 481 bp, Homo sapiens
aaaggaagtctgcagggaagccagttccaccagtagttccactgctttggcataattccgctttagtttagccagctgctcccccacctctggctaaaccggtcagttcatagctgtcagttccttcgtggtaatgttcaaacactggcaaggtaacacctgctacattgtctttctttgctctgatcttcacttgggctttatttacattttggataactgtggtgctgaagtcccctgctgtgaatttgcctcagccaatgagaaggcagcttctctcatcacttcacccatcagcattttagtctctattatcttcttcaggatctgtcgaaatcgaagagttaaggcatcagactttttcttcagaaggtttcgaccagtctgtgctccttttaatcgagccttcatgatggtctgtgccattcgcgaagggaagatttcaatccggtctttgcccgacatctgacggtgactcggc

SEQ ID NO: 617176 - DNA, 80 bp, Homo sapiens
caggagagaggaagggaggaagggaaggaaggaaggcaaggaaggaaggaaaggaaggaaggaaaactttcaattttctt

SEQ ID NO: 617177 - DNA, 547 bp, Homo sapiens
  misc_feature (42)..(42): n is a, c, g, or t
  misc_feature (142)..(142): n is a, c, g, or t
  misc_feature (156)..(156): n is a, c, g, or t
  misc_feature (179)..(179): n is a, c, g, or t
  misc_feature (194)..(194): n is a, c, g, or t
ctgaaggtggcctcaccttccaggtgcttgacaatgccccgnaggctgttcccgtgggctgcaatgagcactcgcttgccggccttgatctggggaacaatctcctcgttccagaagggcagggcccgggcaatggtgtccntgaggctctcgcangtggggagttccccgggcttcangcctgcgtaccgacnctcctgggggacacatgcacgctgctttccctgccaagccagtgggcccgcacccgactccccactctgcagcttaccagaggccttcccagcaaaggcagcccaccttgctaatggagttgcaatatgggtgcttttcgtccatctggggcagcgggatgtcgaaggagcgcctccagatcttcacctggttctacccgtgcttggcggccgtttctgccttgttgaggcctgtgaggcccccgtaatgccgctcattgaggcgccaagtgctcaccacatgcagtcacatctggtccgtgccggacaggatggcccaacaggtgctgatggcccggttcaccactgacgtt

SEQ ID NO: 617178 - DNA, 152 bp, Homo sapiens
  misc_feature (11)..(11): n is a, c, g, or t
tggcgagtgantggttcaggttattcgtgagtgacgtggcggcaggcctgaggtcggcccagtggtgcggctgcaatgcgctcatggatctggaggtggtgttcccactgatgaagagcaggcgactggtgtttggcagacgggagatcaat

SEQ ID NO: 617179 - DNA, 1016 bp, Homo sapiens
gagctttacatacagcatcccgttgggacgctgccgccaaatccgtccatgaccatgtccgtagcagatgactcccccatcatgcctgtctcactcccaagctactcgtgtttagcacttctttcacctctaactgatcatcatagcgtctccgcgtcgaggcagaaatgcaagacagattgcgctgcagaaagagacagtcacaggactaggaagggtgtcctgaaaggtcgattttgatctcgtcattcctagtgcacaacgagcgaaggtccccatccggacgcgtcgcactgatcaaaactatagggcactctcgcccccggtgacgcttgtccaagacgcttggccggccttgagccaaagggctgcacgccgggaagccccaagtatcagtccgggaggccgctgcgctggaaggagggcgacgcttgtccctaacgtgcgggcgcgggtaatgccccaggcaggcccgggggccctggatgacacgcctgccgatttttcggacccaacgtagaggcgggcctcgggcccctgctggagggttggagctggcatttgcaggctccgtttttggcccggctctcccgtagcgcctccccacagtgtcccctcacccgggggctccagcgcgcgccgctggggctagcagaactcttgtacaggtggcctatgatttaccacaattacccaccttatggaagaaaggctgtttgttgaaacaacggaccattccaaagaataagcgcctccctatctggggtgttatgcgaaccgagtggctccaacgggtcaggggcttgggcttgcaaaaacactttattggatgtaacgaagctggggtgtccttaagattaaccggattataggaggaaaatgtggggtgttgtaacctggtttaatttttgggccaaagaaacaggtttgaaaggtccaaacaaagggtgaatccgaatttgcaccaggctcattttgacagaacgggatttttttattccagaaacattagaaga

SEQ ID NO: 617180 - DNA, 407 bp, Homo sapiens
ctcacactcctgggctcgagcggtcctcccgcatcacgcctctcgagtggctgggactgcaggcctgtgccgccacactcggctaattttgtaccattctttgtagagacgggatctccctgtgtcatcagactggtcccaagtgatcctcctgtcttggcctctcagagtgctgggatttcaggcgtgggccattgtgtccagcctcaaaaatgttttgtgcatttggtagccagaataatggcccccctaagatggccaggtcctaatcccctggacctgtgaatatgtcaccttacatggcaaaagggactttgcagatgtgattaaattaatgacctagagatgaggggattatcctggattatctgggtgggccagtgtaatcagaagggtcattagaagtg

SEQ ID NO: 617181 - DNA, 219 bp, Homo sapiens
  misc_feature (42)..(42): n is a, c, g, or t
  misc_feature (170)..(170): n is a, c, g, or t
  misc_feature (173)..(173): n is a, c, g, or t
ctgaaggtggcctcaccttccaggtgcttgacaatgccccgnaggctgttcccgtgggctgcaatgagcactcgcttgccggccttgatctggggaacctccaggagagaagggtcctcgggcttggccagggcctgtcaggagagcgagggggctgtagacggtcaccncgntgcctgccaacgcacgtcaagctaaacccccccccccccccccccc

SEQ ID NO: 617182 - DNA, 709 bp, Homo sapiens
  misc_feature (1)..(1): n is a, c, g, or t
  misc_feature (95)..(95): n is a, c, g, or t
naggcaggtcgggttgtcatagattctctcgcatcccagattggtctaattgaccacctttgagaaacgcgtttccaacttatttccaggactcnaattagttctattagatctttgcctgacttcacatttaatcacttactgatttttcttttagcctttttgtttcattttcttggctcttttcatttatatcttcaaaatcccttattttacatttggttgtatctcttcttccttagatactttataattgccttcacatctgatatgtgtttgtctttttctccgaatttttttcctgattttagccagtcattcacatctgcattttgtttgtccagttctgagtttttaagttgctatttcagattttttaaatatctaataatttaattcatattagcatattgtgttaaagtttactctcctttttctcattttcaatttctctttagagtgactttattttttttccctagggatgtaattttatgttgagttaccagcaatactaggtcatcaaatgggaagaaagggtctgggttagttcaagaatattttctgcttagttgtttgttttttgtgagatcaggtatcattcaataataaagctttttatggaggtcttacctcctgattccttattagaactttaaaaaatatttttactttcaaaaaatcatagattcacaaattgaaaaaaaaa

SEQ ID NO: 617183 - DNA, 197 bp, Homo sapiens
tgacacaaacctagctacagcaatactcatcatgctcggtaagtccatgcgcaatagtgtataacggactaggtgggcaagggaaagcgacaggcaacgcgctagcatctgcagtgatgcgaggtagctgagatacaacatgaaggatggcgcactctgcaatcccacccaccatcgggtatcatcgcgatactccg

SEQ ID NO: 617184 - DNA, 909 bp, Homo sapiens
tgggggataaatggtcttaatggggggaaaacaggaagtcttcaatctcttttatcattttgataaaacatctgtgatttgtttacttgatggtcaaggcaaaaaatcattggctaaataaacccatgaacaatttggcagtgtgccgcaaaccctaattgtgggtttaacaccttcttgcagagctttataacagtgcaagttggaaataaatccaacagttccccctctctttgggacaacacatttgttcttccactgcggaaaattgtgacccaatttgcaacccgtggtacatagtaagagtgcggggacaatcccgtggtttaggagtgtgcgaaactcttctggggaagcattcgcccacctgtgtggggggggacgctagaaacagaaggggcaagaataacctcttattgttgtcgggtcgacaaaaacgcccattggacgacgattggtcccacattgtttcactctctgggaccaagaggggtaacccttcaagaaggtcacttctccaccccttgaactcgtgccgacctacacaaactaaacctggtcgctccttgaaaacactttggggcgccccccattcctttccggacaggcaaaaggactcgtgccttgcctgtggcgaatgtgtccggcgtcgaatttcgtgcccccccaatttcgggaaacagcaaatttcatgttccccctcgtgtatatggggccccaagttggcgcccggacaagggcaagctgtgtgcgccggttgttcacggggtctttcgacgagcacaaaactattcccgaccgtgagtgttcttggctcctttattaaggtcccatcactgacagccggtggttgtccacacccgtgtccccaggggccccttgttgcccctaaagtatgcaggggtctat

SEQ ID NO: 617185 - DNA, 1519 bp, Homo sapiens
  misc_feature (175)..(175): n is a, c, g, or t
  misc_feature (213)..(213): n is a, c, g, or t
  misc_feature (784)..(784): n is a, c, g, or t
  misc_feature (946)..(947): n is a, c, g, or t
  misc_feature (949)..(949): n is a, c, g, or t
  misc_feature (1132)..(1132): n is a, c, g, or t
  misc_feature (1229)..(1229): n is a, c, g, or t
  misc_feature (1256)..(1256): n is a, c, g, or t
  misc_feature (1397)..(1397): n is a, c, g, or t
gtgcctttttactgttgggggccacgtccttttgcgtggcatggagggaagtgttgtgttctcgccaggtggcccacaacgcagcgtttggtagtttgtgcacctctacctcctgtgattttgcgccttttctctgtcgtgtgttcaatgacacctgcgtttcggttcgccgcgntgttccggctgatgttggcacaccgcgtgtgacatctntccacgggggggttggcttgcgtctgtttttcttgtgagacgtcaccctttgacgagtccttggggtggatacgggaagaacagattgtgggtgaagttcacccacgtggaaattgttttttttgggcgtggggccaccttcttatttttcgtggccaccatgtttctctggtacctccccacaagttgtgcgtcccccccctctgagtgttccctccgtgtggggcccacctgtttggcgccgggtgtttttgtgacgccgccggtttgcacccctgtggatagcccctctgcccgtggtgctgttgtaaaggagaacccttggtgtgtcctcacaccccgagggaagggccgctggccggggccgggggacccctgtggggcgacactgggccccccctcttggcgccattttgagaggttcttcttttgttggttttttggaagtagtgggtttcttttgtggtgggaaaatgttgtagcgtcttgggtctcacgagagccccaaagtgatttgttatcccgccccctttgtggttttccaccgcgaaaattttttctgtcttaaggncgttcccccacctttctggggctgtgtgggagaatttctccgggagaacccctctccccgctttgtccctaatggtgtatttccccccccctcgtatgagtggtgaccccccttggtgggcaccccaagtggcacttctggagccccctatatagggggccnncncctctgggtggagccccccacgccaccactttgcaccacgcccccgcgttgtttttaaatgtgggccctccgcctctttttgggagagatttgcctctgggctcgggcctctttcacaggggccttctcccccggagaagacgcaccctcgcgcctctttccctctctttcacagagttgtcntctgaaagcgggaggttgtctcttttgagaggccagcggtggatattgcctcgggaagtttgggcgcggcctcccctctctgggccccgcgggcccntctctcgtggagccctctgggctcccnctctccgctggagacctcggggctcttcgctggtgaggcacctcgcacgccctctccctcgggcacttccctcccacgcgccacgcacccacctgccaccactatagacctcgaggtgctatttgtaattttgggcttggntgtgtaatgcttctttacattgtgtataaaattgctgtttcttttgaccacacatttaaagtgagttttttttgttttctgttaagtttgtaaaattaaaattaagaacaaaattcccatga

SEQ ID NO: 617186 - DNA, 307 bp, Homo sapiens
ctacttcgctcccatctgcggcacttgttgcctccgctagcgtccccacttcgtcgtccaagccccgtcgcgatttccttgcccttcttttacacatgtagaaggagatgaaggcccaggagcagaggctggcactccgaatctccttctcccatgaagaggatcctttggggaacagctgtgcccctggtcctggcctgtgacctactctctgagactgctgaccctttcttcgtccttcacattcacgtgatctgcgatttcccctttccgagccatggtgcagttccaccggcaccatggccag

SEQ ID NO: 617187 - DNA, 980 bp, Homo sapiens
catggcagcttgcacctgtaatcccaggactattgtggaggctgaggtgagcagatcacctgaatgcaggatgttcaatgagcaagtcttgtggcaacactggtaataaccaccatctacccaagtagaaacgtcactcgaaatccaagacggggagtaggttggtcgcacagcacgcgaggtccaacggcacgtcaaggaaggcttgacggtatcgcagagatcagcttgaatctcggcgggcatagtggagtggtcggacgctggaggcactgagcattagcgccaatctgattgcatcccaagttctaggggtgaccaaggatgccaaggaatctcctaattcttcgcaggagagaatcatctcatcgaaccaatctaaaagaagagacgggcggaaaaccctaagcaaatgactgtcctttgaaatgggccaccgcggagtaaaaaaactctgcttgggcaaagcacaacggcaccagaagtacgccaggcgacacagaaggccccgagcaaggggagagcaccacaaataggaggaatcccccacgcaggaaacgcgaacacccaggaacacagtcggtgagaacgccgcacagccgcataagagtgatagccgtggcgagtccacccgaggagaacaccaatagccggccgggcgagacagagagcacagaaacagcgttggcatgagacacgagacaaaccccaacagcaagacggtgagtcagaaaaggaccgagacacccagggggaggaggtacgacacagcagcgacgacaacaagacgcatgccagacataccataaggaactagtgccccccccaccagcaaggaggcccatatgcacaggatgtcgaaacaccaagcgagaggaagacagtaccaacaaaaagggagcagagcattcgtaggaccaacacacagcaaagggcatagaacagcagttaaagaaacgcacgcggcacagtgaacaatg

SEQ ID NO: 617188 - DNA, 109 bp, Homo sapiens
ttccttgcagaacaaaattttccttgagcagccaggtgagcacagagtccctgtaggggataaaatccgactttcgcttctttgattgcatatctgcaaggaacccacg

SEQ ID NO: 617189 - DNA, 200 bp, Homo sapiens
ggttgttagggggaagagtgctaagtgaaaatacgatataaactgtatactttttgcaagcagttgccatttttctgcccagcctgctgccactggccgtgcagttatcctgtccagcccaccaccattggactgtatgtaaggtgcttctcctgcctagcttgccaccactggctgtctcccctttatgtagccccaca

SEQ ID NO: 617190 - DNA, 151 bp, Homo sapiens
aagtctgaaggagagccaaagacaataaaaacagacagcatgaagtaagttaatgattgcaaaaatccttgggttttttttttttggagacgggggctccctcttgttgcccaggctgaagtgcaggggaagtttttgggccaactgaaac

SEQ ID NO: 617191 - DNA, 861 bp, Homo sapiens
ggcgcaagaaagatggcagtggtcctgatcgcgtggcctcgttggcggcgtcactgacgcttcgtctccggtcctcgagatcccgagcgcggggaggcagaccggatgactgacggtgcccgggacggacagctgtagagtctgctggggtcaatgtgtagcgccggtcggaactggactgagggcgaggtctggatggccgtcgccgactcccgacttgaggctgcggagcattcgtccgtccgactctggccttgagccttgtgcgaggactcctgccgaactagcgggggctcccgggggacaagagggactaggccgatcgaccgcatgggacgtcccctggttcgctcgtggactgttcctggtctctcactatcatggcctcgaaagaaactatcggaagtgcgcgacgcgggggatagagcggagtgccctaagaggcgtcttggattggactcagcagttctatcaggcagacggcggaccttggactaaggctgccccgcttcccttgcgccttgctgcttcctggttctgaaaccgtcgtggaccactcatccccgtactgatgaagctgcttgtccccagtcctgcggccagtcctgtgggacacagtagccctccgttggatgcctcgggggattgggattggacgcctaggatcctcacgttccttaccttctggttccccgtggtccactgtgcccctatcacagacacactgagcccaagaggccatgcaagcaccggacaccaattggtcgtgtgccccttgaagttgagcagaattgcgaggtccaaggatgggagtcccacttcagtttagcggcttggtctccaggtgccttgccatcatgg

SEQ ID NO: 617192 - DNA, 89 bp, Homo sapiens
cccccccaaaaaaaaaccttttttttttagggggggggtttttttaaaagggggcccccctttttaaaaaaaaaggggttgtggttgga

SEQ ID NO: 617193 - DNA, 860 bp, Homo sapiens
  misc_feature (753)..(754): n is a, c, g, or t
cgatacctcagataccttattcctcctatattaaatttgaatctatgacagaaatatttttagtgttttccaaaatatttttaaagtgaaaatgtaagttctcatttgcttgtactgtcttttttccgctcctccttgaatttgccccttgctctggagagcctacaaaagttaaaacttttgtgaatgagcattgtcagaatgctatctcaaaaatggtatttttttttccagtggaaaataacttttaagaccacacctggctaccctttcagttttaagccactgcacccagcccacagacagtcattagtaagtattctcttgtaagttttcctaacaattaacatctgtgtacattggttttcttgctaaacttaactctaatttttgccagtactaatatgtagtatccactcatagttttaggacttcaaaatctgagtgtattgggtatatggtatcagcgtcagcattcatatgaagcctgagagtcctttctgtgtgtcaagtcaggaggtgtaggtgtaggaaatgctgatccaggtaggactgtttggcacctagcaggtactcaagaaatgtttactggaaaatgttaacttgaatcaagggagattatactgttatgcactggccattaagtcttcactgttgacttttgctctctttggtttttatgccagagattgctaacccctggtttagaattgttactacaagcataaaatcatttatgggccgggcgaggtnncacgcctatagtcccagcactttgggaggcagaggcaagtggatcgcttgaacccaggagttaagaaagcctgggcaacatggcgacacgcagtttctaatacaga

SEQ ID NO: 617194 - DNA, 774 bp, Homo sapiens
ctgcgagctgccatgccccatgcgccgacgcctctccgcacgatgttcccctcgcggaggaaatgcggtgcagctgccctgtggaggactggcatgtgtcctgggttgctctcctgtgcggcactccctctgtgaatgtgttcctgtcttccaccttgttctgttggccgtgcctcatcgctgtgtgcttcttcgtccgctatctctgtgcttgcatgctcatgcgtgctctgtgtgtgactgtggccgctgattgggcaagatcacttagtggggaccaacaagtgtgcgacgagaagaccctctgtagtgccaccatcgccaactagactgacacatagcacagcacagccgaagaatagccaggcacaacgcagctatggaaaagacaacatagtgtagaaagagaatacagtacactgccaaattctcggttgagctgagatcgcacccaccacaaccgccgagtgcccggttgcgcacgaacgagatgggcattggatctgagttttggctcgcatcccgataaatcccccgggggccataggaacataacagcgagcacatattcccaggagagtcgtcggcaatcgacgcttcccacatcttagcggggattacagtctataacgagggctattgggcaccagccccgcaatccgcaagatttggccttaggccaccatggcgcatgtactacccacccgttcgggaaaatggcaaaagtcggtggggaacacagggaagaacagcagcatttaccgcgcctggtag

SEQ ID NO: 617195 - DNA, 365 bp, Homo sapiens
  misc_feature (4)..(4): n is a, c, g, or t
  misc_feature (44)..(44): n is a, c, g, or t
  misc_feature (61)..(62): n is a, c, g, or t
  misc_feature (66)..(66): n is a, c, g, or t
  misc_feature (198)..(199): n is a, c, g, or t
  misc_feature (201)..(202): n is a, c, g, or t
  misc_feature (222)..(222): n is a, c, g, or t
  misc_feature (225)..(225): n is a, c, g, or t
  misc_feature (234)..(235): n is a, c, g, or t
  misc_feature (305)..(305): n is a, c, g, or t
ctgntttactctaggaggacccccattgtataagcggatgaggnacaagcatttatcttgnnaagngccccaatcctccggtgcaggagaattttgacgtgaataagtatctcggaagatggtacgaaattgagaagatcccaacaaccttgtgagaatggacgctgcatccaggccaactactcactaatggaaagnntnngacaaagtgttaaaccaggngtntgagagctnnatggaactgtgaatcaaatcgaaggtgaagccaccccagttaacctcacagagcctgccaagctggaagntaagttttcctggtttatgccatcgcaccgtactgatccggccaccgactatgagatcat

SEQ ID NO: 617196 - DNA, 181 bp, Homo sapiens
ccggctgctcactgtatctacggaacttgtacaggtgaggctggcagctggagtgataaagacacgtcgagcaggatccaggtgaacgatatttggaggtcagcacgggctcacgtgtgacggaacttgtccagggaggcatgcaccgcagtggtgaatacacgtcgagctggaggcatgc

SEQ ID NO: 617197 - DNA, 160 bp, Homo sapiens
agacgccggataatatagatagtcgaagatgtgattaaggcagctcgcgtaatgatcaagggtgtcgcctgataataggggaaatcagtgaatgaagcctcctatgatggcaaatacagctcctatagataagacataatgaaagtgagctacaacgtaa

SEQ ID NO: 617198 - DNA, 115 bp, Homo sapiens
gcctgtaatcccagctttcgtgaggctgaggcatggagaatcacttaaaccccggtgatgggagagtgtcgcatgctgacgccatagtatcgctaatcactgctcctccagaccg

SEQ ID NO: 617199 - DNA, 104 bp, Homo sapiens
accgagatacccgcaggatgagtcgccaactaccagaaccacgttcgccgacggccgccaggtaacgagcacctccatcggacatcaagggactccagccacca

SEQ ID NO: 617200 - DNA, 121 bp, Homo sapiens
ggggccccccccccgattcctttccccagaaggggtgggatgggcccccatgaactgcagcagcatgttgaggtgtccatgttgtttgcctttgtataaagaaacagcctttgccctgcca

SEQ ID NO: 617201 - DNA, 437 bp, Homo sapiens
tctcacggaactttgacacattgaaagaatttccaggtattccacgtatcagccagttcgtgtgtgagataagacgcagatactgcaagtgcattaaaacgctgtgaaatactcatcagggcatgttgctagatctgtattggttgtctaacgtagtagagttagaagtagagacagggaagaccaagtaggcagtctggtctatcatgattgagagctcaagctcagaggtattcgatgtgatttacagacctttagagaagcagctgaaacatgcatcctctttcagccgagttgtgctggaggatggatgaaggtcaggtttaccaatccttcaaaagagcccagctttgtgatcttgttatgagtaagctgcagatcctccagagatttgggaagtgggcccacagactctgtcaggttgttgtggtttatat

SEQ ID NO: 617202 - DNA, 412 bp, Homo sapiens
gaggttcaggttttggtgttttttaggttggtttttttttttggaggcgtaatctcactcggtcacctaggcgggagtgcaggggctgggtctcggctaactggcaccctccaccttccaggttcaaatgattctcacacctcatcttccggagtagcggggataacaggcaccggccaccacgcttagccaattttggtattttaagtagagatgggggtccaccatgctgggccaggctgggtctcgaactcccgagttcaagtgatcctcccacttgggcctcccaaagtgctggggatcacaggcactcgccaccaggcccagctaatttttctatctttagtagagatgggggttcgccaggtgggccaggcggttctcgaactccggacctcaggtgatccaccgg

SEQ ID NO: 617203 - DNA, 415 bp, Homo sapiens
  misc_feature (327)..(327): n is a, c, g, or t
  misc_feature (330)..(330): n is a, c, g, or t
tgcagataaataaaagtttattaaaaaaaaaaaaggagtgttgcaaaactacaagtatttcatgaaattaatctgtcagggttatatttcacgtcggtcatagaaacatttttcccaaatcaaatgcagtgatttgtcctagaatgtatgtggtttttataaaatataatggtcagattgccctttcaaacgtctcataaaaaaggcatttacgtttaatctaccttaaaaagaccctacctcaaaacaaaagcctttagaaaggcacagtgcacctccaaaagaaggggcttcagaaggcaggtcagctcgtgccgaattcggagnggnagccagccaagatgaaccgattcctttggtgggtggctctttgactgcccttaccagtcattgaaacacaggctggtgatgtgtc

SEQ ID NO: 617204 - DNA, 295 bp, Homo sapiens
  misc_feature (263)..(263): n is a, c, g, or t
cacagtgcctggggctttccaaaggcactcgcatgcctattggagcctgtcagccccagcacaggacaacgtctgtgatgcggatgacgtggaaggagtggagccacacccggatatggaagccatctttgccacagcttttgaccgatgtaccttcattggcacaagattcgaggcagccgtccacgggcttcagacggacagcgtgcgtcaaactttcatctgactaccatgtggcccataagagcggtaaactcatccancttttacccttcttccgccccaggtcaaaaat

SEQ ID NO: 617205 - DNA, 494 bp, Homo sapiens
  misc_feature (4)..(4): n is a, c, g, or t
  misc_feature (7)..(7): n is a, c, g, or t
  misc_feature (74)..(74): n is a, c, g, or t
  misc_feature (104)..(104): n is a, c, g, or t
  misc_feature (112)..(112): n is a, c, g, or t
  misc_feature (138)..(138): n is a, c, g, or t
  misc_feature (152)..(152): n is a, c, g, or t
  misc_feature (168)..(168): n is a, c, g, or t
  misc_feature (219)..(219): n is a, c, g, or t
  misc_feature (234)..(234): n is a, c, g, or t
  misc_feature (239)..(239): n is a, c, g, or t
  misc_feature (248)..(248): n is a, c, g, or t
  misc_feature (252)..(252): n is a, c, g, or t
  misc_feature (267)..(267): n is a, c, g, or t
  misc_feature (285)..(285): n is a, c, g, or t
  misc_feature (317)..(317): n is a, c, g, or t
  misc_feature (319)..(319): n is a, c, g, or t
  misc_feature (347)..(347): n is a, c, g, or t
  misc_feature (350)..(350): n is a, c, g, or t
  misc_feature (372)..(372): n is a, c, g, or t
  misc_feature (381)..(381): n is a, c, g, or t
  misc_feature (384)..(384): n is a, c, g, or t
  misc_feature (425)..(425): n is a, c, g, or t
  misc_feature (444)..(444): n is a, c, g, or t
tcanatncactctattttttgcagttatggccacgggggatggagttaggctcttacattgttttcactttttnacattcttacttgttaaatgaagggttggngactctgngggttccctggctttctgcaaacccncaaacctgagttcngctggtcacgcatgtncacagcaaagagccagagttcaccgccctttctcccaccttcttctccagnttgtttcaatgccantcagnttgcttggntggngatggaagggggggnaggggctcggataaattnaaaactaaaaccccgcgattttcatataatanangcgaaaagccaaagcagagcaggaaggngcngccagagaccaggcagcagggnggccaaggnggngggggcacgggggaaaggggacacggggcccaaccccggcntcccccccacggcgggggnggcgcagggaaaggccagacgggggaggccgcggcccccgggcggcaggg

SEQ ID NO: 617206 - DNA, 644 bp, Homo sapiens
ctacactgcacgcgccttcctgagagtgactattttctatatcacggggtaaatgttacgacgtaaggtgatcagccgtcagactgtatgtccagcagacatggttctgttcactagatcctctgtaactagagccagtttggtcctgtcacagcggtcctttcctggtggcatatgcgccgtatcgctgagtgcgttacatgaacgactgtgaaggatcctggactgtcagatatgtcaacggttaatcacagccgtcttcgataggtccgccatttgctgcaacttagcgctttgttctgtacttcactcagacgtatgatgcactactacgtcataatgcgtgctctcagagccatgctcatggcatactaaacggcgctgacagactgaccatttgagactgcgctcacttcagtgctgaggactcggactgctccctgcattgccggagcattatgcaagctgcactagtatgaacagcatatcctaacaggttcgtccctctaggcttatatgaccgatcagaattgcagtcctataaatgtggctcatgctgctacgagcaaggctcctgatgcgtcttgtagtctacactatgactctcttgatcttccgagccacacataggtgtatatcactcg

SEQ ID NO: 617207 - DNA, 215 bp, Homo sapiens
accagcctacttagcaaggatcgggaccctgtactgttcggtcattacttacctccttttttttttgagacggaatctcgctctgtcacccaggctgcattacaatggcacggtcccggctcactcaacctccatcttacccaggttcaagcgattctacctgcctacaggctcccaagttagctaggactaacaggcgttatccaccgcgccca

SEQ ID NO: 617208 - DNA, 427 bp, Homo sapiens
  misc_feature (1)..(1): n is a, c, g, or t
nacatgagtcatgtgtagatctctgtggtgatatgtgaattctcatataacatgtttctggaatgatatgcagcagcttgtgtgcatataagctcttcatgattctccagcattctaagtgacctggagtgccattaccattaggtcgacatctgacgtgctgtcttcagtttgatgtggtatgtcttccttgtctgtacatctatgtcacgttcggtctatatagtaaccatgttcatatgctaatgccaccgtaggttagacaatacaccttgtatcgctcggctaatatgcagcagtcgtctgtggtttcagtatttgatacccagtctctagagagagatacgccagaatacaaggataggtttataggccaggagcgcccgagtgtgctcatcatatgtgagcgtccgaagctcagatcaag

SEQ ID NO: 617209 - DNA, 225 bp, Homo sapiens
  misc_feature (66)..(66): n is a, c, g, or t
  misc_feature (143)..(143): n is a, c, g, or t
  misc_feature (198)..(198): n is a, c, g, or t
  misc_feature (206)..(206): n is a, c, g, or t
gatctcccaaaattctcccattgttggccacctcatccaccatcaaagcctctgagagggatgggncagacaaggcatgctcctcagagccaccatcccttcaacaaggacaaaaagtgaagaatcacttgcactcccatagnctccttgggcctagccactggaaggactgatgaggccagggcccctgggcccggngcttcccngcccccactgccatcactg

SEQ ID NO: 617210 - DNA, 125 bp, Homo sapiens
ccgtctagtcctggatagaggggctaggatagtcagcgagctggactggggttagaaagaaaacagatgtctagggcctagccctgttagtcagaaccaccagggaacagcaaagaacagagtga

SEQ ID NO: 617211 - DNA, 654 bp, Homo sapiens
  misc_feature (32)..(32): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (99)..(99): n is a, c, g, or t
  misc_feature (103)..(104): n is a, c, g, or t
  misc_feature (122)..(122): n is a, c, g, or t
  misc_feature (125)..(125): n is a, c, g, or t
  misc_feature (127)..(128): n is a, c, g, or t
  misc_feature (157)..(158): n is a, c, g, or t
  misc_feature (173)..(173): n is a, c, g, or t
  misc_feature (178)..(179): n is a, c, g, or t
  misc_feature (205)..(205): n is a, c, g, or t
  misc_feature (208)..(208): n is a, c, g, or t
  misc_feature (220)..(220): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (250)..(250): n is a, c, g, or t
  misc_feature (259)..(259): n is a, c, g, or t
  misc_feature (262)..(263): n is a, c, g, or t
  misc_feature (312)..(312): n is a, c, g, or t
  misc_feature (333)..(333): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (402)..(402): n is a, c, g, or t
  misc_feature (477)..(477): n is a, c, g, or t
  misc_feature (546)..(548): n is a, c, g, or t
  misc_feature (555)..(555): n is a, c, g, or t
  misc_feature (557)..(559): n is a, c, g, or t
  misc_feature (561)..(561): n is a, c, g, or t
  misc_feature (564)..(564): n is a, c, g, or t
  misc_feature (571)..(571): n is a, c, g, or t
  misc_feature (591)..(591): n is a, c, g, or t
  misc_feature (596)..(596): n is a, c, g, or t
  misc_feature (598)..(598): n is a, c, g, or t
tctagcgccgccccgcagaggcacctgccctnctgtaaccgctatctgacccacacgcagcgcccgcgctccgcgcncncnccatatgcccaggtgacnccgnnaatggaggagacgccgcngcncnncatgccctggattgaggtgcagtccctgnngaaggcagttgatgncctcnnccagtgtcgtgccacactcatgtacnctnatgtcttcgctntctccctcnaaangaatncccagcccattntctttgagnatnnccacgcagacctagagaatgccacagaggtgctctcgggctcccttgancgagatatttcccaagattcnctgcaggatataaagcagaaagtacaagncangtncagatactgtgagagtcgacgaagggttttgttncagcatgtgcatgaaggctatgaaaaagatctgtgggagtacattgaggactgagaatggccctgcataaaatgnactctgaaaactttaccatctagagtgctcatgcaattaaaacaaaacaaacacaaacaaggaggcacnnngcctatncnnncnccnctggtcngtagtaccagaattttttgntaatnanagtttaagtaaattatattgtaataaaaaggtagataaaccattaaaaaaaaaaaa

SEQ ID NO: 617212 - DNA, 258 bp, Homo sapiens
gcggagggtgactgggatcaattattaacctctctgagcctgagttcctcaaatggtacagtaaagggataatgatattgcctctgcgttagaggactaaatagcaaatcacttttttagtcatggtgataatttcctggtcctcaagtaataactgtctcataactgtaactatcttatgaagtccttgagagcaagggaaatggaagtggtggaaattcttcacagtgcccaccaagtgcctgccagctggctcag

SEQ ID NO: 617213 - DNA, 175 bp, Homo sapiens
aggctccagctataacgatatttggaggtcagcacggtgctcactgtgtcgacggaacttgtaccagggaggcatgcaccgagagtggtgaatacacgtacgaccagtgctccagtctaacacgatatattggaggtcagcacggatgctcactgtgtcgactggaactatgtcc

SEQ ID NO: 617214 - DNA, 507 bp, Homo sapiens
  misc_feature (167)..(167): n is a, c, g, or t
gacctagtgctgctagtaagtcgtatggcttgggtacatatctttgggtggatagtgcatcactacttgcttacttatatattaataatgaacaggcgatactctttaattttattcagattttggcttggctgtcccacaggcaagcagggagaattgtagctcangcctcagttgaagtgggcataatattagcaattccctttataatcatccattaaatttgatgaccagagggacgtcctcatagcttataacagaaaatagtgtctctaggagtcaaggggagctttcccaaatgttatctattgagcaagattaaagagacagatcacccaggaggctgatggtaggtggtgttaatccattagtccacacgcagataactcgttaggtttcctgagcatcccccttaatcttggctgcagagatagaaaaggagattgtagaaacttgccctgcagcaaagattattgatatgttttcctcttacatgactcaaaacca

SEQ ID NO: 617215 - DNA, 258 bp, Homo sapiens
gttattgagtgcccccacccacttcagacaccagttgcaagtccaggcttctgaatcttctgaccgacagacttcaagtgagggttcccatgccgccctccttgaatttgattaatttgccggagcggttcacagaattctgggaaggttcttacctacatttagcagtttattatataggatattacaaaggattcagatgcagagatgcatgggaagagatgtagggtagtgggcacagggattctctaggacctc

SEQ ID NO: 617216 - DNA, 335 bp, Homo sapiens
agtggtacagtgcatggtaaaaccagtatcacttgcaatacatagaagacaatctcaaaaataaatacataaattaaaatgaaacatgatcctttgcatcccaactttggaaaaccctgaaatgatatatgtatctttctttggtagaatagagtagataattcacaagttcatttctcttcccctctactttccacatatagtagccattttccaatagggtaaaataattcataaatgtacttgttttctggattcatctacaccaaatggctttagccaccatctttatctgtttgtgccattaactgtgctgctgagttaaaaaaaaaaag

SEQ ID NO: 617217 - DNA, 130 bp, Homo sapiens
ctaaatcaaccacctttgagacagtactcacgcacccgtcatagtcaccagctcctgactgcagcaggcaggctgtggtggcaccaggaccgctgctctcagaggttgtcaatccccccggttgatttgg

SEQ ID NO: 617218 - DNA, 246 bp, Homo sapiens
ttacgctcggccccagttattgtgcgtaacagtgaatcaagcgttagctaatgagacgactgggctttggtctgcgctttgtcggtgggagtgaagtgggtattcgggctactcattactcgaatgccgggatcagcagcaataacgatggtgtcgagagctattcgttgcactacacgatgccactgtaattcttcagaacaccgcaaaaccattgtgggagcgggcttgctcgcgaaagcggcg

SEQ ID NO: 617219 - DNA, 485 bp, Homo sapiens
caatgtagtccagtttttaagatcatgttccaagctaattgaatcccccttcaatacacactcatgaactcctgagggaccaataacaggcccaaccctgtggtataatgtgcccccttgctagactcaaaaaaaatactactttcataaaggggtgggagtattttggtgccaccctactttgcttggctgagtaaaggaataatattcaaatattcatttatcccagggccatttagttagtgctttttaaaacccaggcatgatgttgagtgccactcttgggtatatttccaaatttttgtccagtccctgcccatatttgaaatcatatattaagactttccaaaaatggggtcccgggtttttcagggcaacttgatcagtaaggatttcccctctgttggtaactaaacccatttactatatgttagacatgccattttttttttcccctccctgaaaaataaagtggggaagagcca

SEQ ID NO: 617220 - DNA, 119 bp, Homo sapiens
aacagctaaaggagcacaccgcgtctatgtagcaaattagggggaaaattaataggtagaggcagacaaacctacggagccgggtagatagctgggtggtccaaaataagaatctaagt

SEQ ID NO: 617221 - DNA, 192 bp, Homo sapiens
gtaggaggatggtgatcattggaggctgttgtcatacttcgtcatgggttacacccgtgatgaagcatgggggcgtcagcagagggggcagagatgatgacccttatggctcccccctgcaaatgagccccagccttctccatggtggtgaagacgccagtggactccacgacgacgaattccggcaccacg

SEQ ID NO: 617222 - DNA, 804 bp, Homo sapiens
  misc_feature (196)..(196): n is a, c, g, or t
gagagaagaagaggagaacagagttgtagacggaatcagcacgtgcagcgtagcaaagcatacgtgaggtaagagaggagatggggaggaacgaatgcgatgagtgcaatagcattcctagcgtgagatcggagtgaagaagtagaagagagtagatgagtgagataagtgtatcatagcgcaagtcgactagtanggaatgggaaaatatgataaaggggggagggaggaaggcacgccaccaccacggctccctccctcaacatacaatttttttttattttaaaaaaaataagagacggggtttcgccatgtttcccaggctagtctggaacttctggcctcaagcaatcctatttctgtctcccaaagtggtgggattacaagcatgagcccctgcatccatccaacacaaaatttttaaaatcggaatattttaaagccaatcacacaaattatttcccttataatacttcagtaaggcctttaaaaaatccccagtgatattattactcctaacaaaaacaataattacttaggatcatctaatatgtgggtcaaatttaaatttggtgttttgagatgggtcctacaattgggttaatcaaatgcattttttttaactcgtgtcccaagtgttttaaaaatctactggacttataatgacttaaaaaatgtatttctccttttaccttttttccaaaaaaggaaataatggccaaccatataatattggacattccctgtcaaaaaacaaacccctgttttgataacttgttgattgataaaagttttcccaattta

SEQ ID NO: 617223 - DNA, 133 bp, Homo sapiens
atctctgcttcaagctccaggctctagtgagtatggacaagctctctcccttcagctgactaactgcaactgactctctgacagctgtgctgtggcgcctggcagaatagggtacccgagctcgaacttcgct

SEQ ID NO: 617224 - DNA, 404 bp, Homo sapiens
ggcgaggcgggggcggtaatattgttgaagtgtgataggacgttgcgattacacgaggaccagtgactgtgtccctcaacgaacataatcgagcgatcgccagaagtgggaaccggagcaatagcaaatgtcgtaccatcgcatggcatttggcctggactgtttaccaacactccaggaataaactcatgcaagactgtatcagaccaaaacacaattactgctgcgaacgacatagggaagcatacacagacatccatcgatgtctacaagaccactggagcacagcaaaaacaggccaattgatcaccacaaccagacagatgccaggcatagtgcattgagatgcgcaacataagaacagatatggaaatggaaagtaaaagagaaatcacaaggaatgc

SEQ ID NO: 617225 - DNA, 128 bp, Homo sapiens
tctacaggatctgaatagagcatacccctcaagggtaaggttggcatatgtgctttaaattaggagtaggtttttaaattcgggggacatgccagtctagaactttctttagttgaataaatttgacc

SEQ ID NO: 617226 - DNA, 134 bp, Homo sapiens
gggtcgttcttcggtgggtcgttcttcggtgggtcgttcttcggtgggtcgttcttcggtgggtcgttctcggtgggtcgttcttcggtgggtcgttctctcgtgtgaatgagggttttatgttgttaatgtgg

SEQ ID NO: 617227 - DNA, 743 bp, Homo sapiens
gctgctgtatgacggttgctccgagcgtcggttgcccgacatgtgacgtgccatgccttgtgcgtgcattttctgccactgcagccctcaggcctgctgctatgtggaaggacacgagacttgacaaatttattgtgtctctgagttgccgaagtcaatgcatacaatttattctatgcgaccagtttcctcatgccatgcaacctgctgtcacccagtcatgcatccctattttaacgggtacagcctgttgtcaatggagagttcaagtgacctaacgccttgtatgactttgaccggggaaactatttgctgcttgacttctatcctttggatttcaccttctgtgtagtcctacagaaattgttgctctttacgtgaccaaagctaaacgagattttcacgatgtgacactgtgaatcttgtcgcagtctcacgtgtgattcccatctttaggccatcttgcctggataaagtacaccaatgacacgaatcgtggtttgagccagcattgaaagatctgcactcttgttctgacttatctagagctgattttcccccgaagacttacggtgtggcccgtttagaagcgttcctggtctttgcccctatgaaggtctcctcctgatttggcccccactggcgtcctccagctttgagcgtcacgatctccagtggcctcagccgttggaaaacctccgcttggggaggcgtcccttcttccaccttgggcccctgtcccg

SEQ ID NO: 617228 - DNA, 201 bp, Homo sapiens
  misc_feature (96)..(96): n is a, c, g, or t
  misc_feature (110)..(110): n is a, c, g, or t
gcagcggtctctatttcagtttttcctcctctactaaattttttcgaagtatgcaaacatggagttcccatcacggctcagtggttaatgaccccngactagtacccatngaggacacaggtttgatccctggcctcgctctgtgggttaaggataccatgttgctcggatctggcattgctgcagcagaccgcccttacc

SEQ ID NO: 617229 - DNA, 228 bp, Homo sapiens
aagtcgactgctgtgatttaagacggatcagtctaaccatgcgggtgttaggtagtcatcgattttgcgactcagagagatatttattcttgtattaatagcctccctggtcaataatctccatagtacccatacgcctacatcttcgatcctgactcctgttcctgtaattcacagcgagttccgtacgttcgtccgtatctcttcatctccatggtctctatagcc

SEQ ID NO: 617230 - DNA, 278 bp, Homo sapiens
cgaggtcgtctagaggatcccggaaaattagccgaggagacatgaggttgcgggtcaatccccggctcactcagagggttaagaatctggtgttgctgtgagctgtggtgtaggtcacagacatggctcagatctggtgttgctgtggctctggcgtaggctggtggctaaagctcctattagacccctagtctgggaacctccatatgccatagtatggccctaaaaggacaagagaccaaaaaaagaaaaaaaagactagcatattaataaacttg

SEQ ID NO: 617231 - DNA, 219 bp, Homo sapiens
tgttgtttgctatcagactgctaaggagagaagtttgtcatgcaggaggagttctcgcgtggatgggaaggctctggagaggttcctgcaggattactttgatcggcaaacggttctgaagagatacctgaagtctgaacctatccccagaagagcaatgatgggcctgtgtgcaaagcgtagtggtagcagagaatcctcttgatgaaatagtgaata

SEQ ID NO: 617232 - DNA, 126 bp, Homo sapiens
tcaagctttatacttcctcagctttatacttctctcatggctttttactgtcgtattgtattgcgttgtggaagtataatagggttgaggaagtctaaagcgttgagggggaactgaggtgttgag

SEQ ID NO: 617233 - DNA, 112 bp, Homo sapiens
ctgatgggggtctgagtcctttgtgctggatactggtctactaagaaaatatactttggtgatttttttctctctcctttcttatgtttcttttttcgtgtgcactctaatg

SEQ ID NO: 617234 - DNA, 258 bp, Homo sapiens
ttaagagagaggcaattttattcttccaaaaaaatgccccaaaagagggtgagcccaggagcccccctggccccatcccccatcctaagcagggtttgaaatgaggccaggcctgacgtgggcttgggaaaaactgacggagctccctgtggccttggggagggaaccaggcttccttttttgcttttggggcctgatgtggtcctcgatgatgagttcgatgccagcctcagaacgcagcccctccttcaaaattca

SEQ ID NO: 617235 - DNA, 105 bp, Homo sapiens
cggttgcattgacagctcccgagtcaggcatcggcaacgaggtcacagtttctggtcttcactcatcctcttccccgagccgaggggtccggcagctcgcaattc

SEQ ID NO: 617236 - DNA, 486 bp, Homo sapiens
  misc_feature (250)..(250): n is a, c, g, or t
ttttaaggtagaggggaattgtggatgggaagggggatgcgggggaaatgtggtcagtaatgagaaatcctgcgaataggctcccggctgccaggcgtttaagggggttaagaagggtggggtaatttccgtaaatgtaagtaaggttagggaagcgaggttgactggtaaggttgagaagaataatccgagtgctataggcgcttgtcaggaaggtagcgatgagagtattagatggggcacaggcgtnggtgtatgatatgtgggcggttccgataatgtgttcttgggaatagaacccggtgaggaagggcatccctgctatttatgtcgcattgccctatgttgatgggctccccaaaaggtatcggtctttccagcatcttacggtttaattactgagattcacactgtccacctatgattttaaaatctctaaagccaactgcaaagctttaaagatctcagatgacccaacctaattcc

SEQ ID NO: 617237 - DNA, 302 bp, Homo sapiens
cagcgggcgtcacatgtggtacccgttcggtatgcggtacagcctacaaccgctgtttcagagcagccacaagatggctgtgaggactaacaagtcgcagctcaactagaacaaatgcactacctggtctgctttctagaagtagttcaagccttgggactggtggatggccactgtgtctttgaccaaccagcgcacggctaggctctgccgcaactccacgcagctgtaccgcataccgacgggatccgtgcacgttaacgattactaggactatgcagaaaccagtccgacgaaaatca

SEQ ID NO: 617238 - DNA, 212 bp, Homo sapiens
  misc_feature (156)..(156): n is a, c, g, or t
  misc_feature (193)..(193): n is a, c, g, or t
ggtttatgtggtatggatgtaagtcctgcagcctgtgggcttacgtggtacgtatgtaagtcctgcaggctataggtttatgtggtatggatgtaagtcctgcaggctgtagggttatgtggtatggatgtaagtcctgcaggctataggtttatntggtatggatgtaagtcccgcaggctgtgggtttatncggtacagatgtaagtgcc

SEQ ID NO: 617239 - DNA, 117 bp, Homo sapiens
taccaaacttaatggacaggagcgcataatcgccgatcttcacgcgtgcagctcggcgctatcggcctgctcagtatggttcttcggcgtgtgcagtgtgggcactcggcgtgtgca

SEQ ID NO: 617240 - DNA, 878 bp, Homo sapiens
cttttgtgttgtgaaaatcggcgtggagtctctttggggtcctctttgttccgtgtgttccccttgttttgggggcccccccctgtggtgtggtacgtgtagcccgttttttctctgctggtgcccgttagtactttcctcacgagtgggtttactctgtccccttgtgtccccccttcacgtttgtgggggcgtcgaccctctgttgttgctccacactgggtgacctctgtcactgcggctctataaagggggtccctcatgtcctttcacgctgaattcccctagtgctcgtgctctgccccccttttggtgttccccacggacggcggttatagttctgtagccaccctctttttcctggttacgctgtccccccgctgtgtccccagcaagtttcctctcggcatcactccaggctatatcacgcgtgttgtacacttttccccaagccacttgtttccgacaccccttctctaagggccatttgtgtctccaaaggaggccttttgtgtgactcccacgactcttggggttttacaaagaggacttgtgggtatggaaagggcaaatgtccacccatagacggtggatatagcccccgcccccccggccgctggtcctagctatgttgcttggcccagtagtgtcagcctcttggaccctggccactttgagggggtcttttacctcccccttcacaggactgcagggggacccccatgcccaaccattgctgttccccctagggccctgccttcaaatggggcttttcgatttctgtgccctatgtaatccccttcctttccctgccctagggaagaggagacatcttaaaaagcgtacaaattaaaaaaaaattatgataaatttttgga

SEQ ID NO: 617241 - DNA, 934 bp, Homo sapiens
  misc_feature (19)..(19): n is a, c, g, or t
  misc_feature (569)..(569): n is a, c, g, or t
tcccgcggcaccattgtgnagccccctcggctgttcccggaggttccggtagcccccctgcccaggcgttctcccgccaccgtcgccgcgcttccgcagggcgtattccaccgaggaaaaggaatcgtatcgtatgtacgctatccagaaccgtccactctttcgaccctgtgctgatgcaagtaagggtgatgaccgtgtcttcctgctggcactgaggattatatccatataggaatgtcagcagagaaacggcaggaagaccgcttactagtgtctcaagggatcgctgatgattacggataacacaacagaagctagtgaaggcgtttaagagagagtttggctgcaatggtactgtaattgagctatcctggaatatggagaagtaattctaggctctgaggggtgagcaaggcgagaacatatgcacagttcctcgctagagatgggacgggttaaggaggatcagctgaaggttcatgggtccgcaagtgcttgtggctccctgaagcttacgtgaggactttcctctgcaaggagtagaagttccctttcgtctccctggntcaacaggtttatcaaacctcaccaagcttgtatgatgtaatcctgtttcgggggtccgccttttaaccttgggcacgtagatgtagctcgttacagtgcgaatagagctgaacaagagccatgctgtctagtctggctaagtccctccattttaaaccagaggtcaagcaaataggcgcctggcagggtccaagccggaaagcaaggcaataccgtcgtgtctcagcaaagcccagagccctagatacaaacactatggcggaacctcctcaggttcttccgctggagagttcctaccctagagatggacccccgaacgcccggatctaacgacagtcggggagggacaccagggcacaaaggg

SEQ ID NO: 617242 - DNA, 988 bp, Homo sapiens
cggtagtctggttgtctcgcccgccagtagaatggtgtctcccaagtgtgatatttccggggccagttttagtgtgttgcaggaccacccttcttgttgtgttcacagggtgcacccacaaggagagacagtttgaacacacagggtgatttgcggaggagaacccacaagcgtgtgtcaagagacacgacgcgggccaatttcttagagagagagcacgtcgggtgtcgaataaatacagaaccccatttgcggcaatggtgggcatccatttatgcagtaaatccccccttgtggcggatggtcccacacagcgtctcgaccgtgggtttccccggggggaagactctcaatattgtctggctggcaccacatctcttagcgcgcgtttcttattatggacgttttagcgtcctccggagccacgcgagttcccgccccgcatttgcggctgtggccgccccaccgctggggaggtgcaccgctgcgccgcccgcgccccgcttttgtttgggtcccgcggtttcccccaggagctttctaggaacctctttcttggccgggggtgcggcgctccctcgccagtggttcttatgacggtccctctctaatgcgtgcggcagtgattccgccccgggggagattgcttattggggtcgctccctgctacttctggtgagaaatggagggaggccccgccccacccgctccgcggagcgggcgcacataacaggacgcgcaccatcctcgcggagcccgagtgcgggggaggcgcggacgccacaggggggaacgacacaccgcccccgctgttgataattagacgacgagcaagtcccccggggggaaacaaccggggaggggaaggccaggtgaaagtcagcaggaaacaaagcaagacaatacaaaatagcaagtcgtccgcaaaacacacaaggggaacaacccaccacttttttcaaaaaaaaaacccttttcaaaccaaaac

SEQ ID NO: 617243 - DNA, 182 bp, Homo sapiens
aactcggcaccgttcgggggagagggtatttgtgaagtaagccatgatatcgtactatcacctatcgtacagggagcaatgtgaagtagatagaaaccgacctggattactccgagtctgaagctcatgatcacgtagagacgtattaactgcgttgaactaaacgaagccttgaatatgcg

SEQ ID NO: 617244 - DNA, 411 bp, Homo sapiens
cacgccgaccggtatcaaaacggatttggattcctatcttaaaactcgagcaccagtcactttcctgtctagatctgcgcagcaccatacagttatccaatgaacctgggaatcagaacaatctcaagctcatcaatgcatgtggtgctctatgtcgggactcaggccattgcgcatattccaaaacaagggcagcacactcttcaagtgagcaccactcactctctcagcacacagtggatctcttccagaactgtggctgtggacttggactctgaggctcgctaatctcttctggaatgcaattgaaactcagctccggtccccaaatagccactctcaatacttcagttgcaccagtgctgtaccttattgcagaggacaatacggaagcatccaagaacagatcac

SEQ ID NO: 617245 - DNA, 118 bp, Homo sapiens
aagaactctgtgagtcgtagcgtctagtgaatcgcgtcgactggtatggggaagatatcgccatctagtagctgtccctcgaagttcctcagatagtgggctctcaaaccagcggtta

SEQ ID NO: 617246 - DNA, 337 bp, Homo sapiens
  misc_feature (52)..(52): n is a, c, g, or t
  misc_feature (101)..(101): n is a, c, g, or t
acctagaggacccctctaaatggctgtataatttgtttctaaactgtatatntcaaagaatttcctgaggttcagaatatattaaataaatgaatgccttnaccttgctatcactaaacctcaatatgtatctaaaattcagaaaaaacaaaaccaaaacccgggccttctcacatgggtcagccctgcataacttgggagctgctctggaaagaccttctcttgccacttcaccccttgtcaggtgcactcctgcctgggacaggtgggtgcagagcctggggtgagggaaacaacccctggtctgacctctctactcaggacagccatttaggta

SEQ ID NO: 617247 - DNA, 419 bp, Homo sapiens
cttttaccacaaggagaacggacgagcctaatgtgaacaggtttacgattgtctagtttggatatctttcaatgtgctctggctcatctgggtctgttcccctatttgtctggttcgtggacctgatgtgattaaggagggggattgtggccctgagtgtgagaactctatagagaaggtggtgctgggagaaacctttggattggttggtttgcacatgaaaggggcgcccctaggagagttgtttactttctgggaggtggctaaccctagaagtctctccaaggtcagcaagacctcagatgtcaaagcatcagaaaaaacacatggtaaatacaatccccaaggtccagaacaggtcctggtacttaggaagggctcagtaaatatttgtttagtgagggagagaagaaaggatg

SEQ ID NO: 617248 - DNA, 942 bp, Homo sapiens
ataaaaaaaataggctatgtacgaggcctggtgtaacgcagctccgcggctgcgtcgagctccctatgcagtaccctccatgtacccgtgcgccactactacccctatcctaaggcctgccgcttaccccggggtacctatggaagtaatggaagtgacccctcaacctggctcatcaacagagcagacgagcagacctgtttattactgcaggcaacactacgaacgagtgctactttcttgtcacacaaacggctgcagcatactctttctcgaacacgccactgcacgcctgaccaccacgctcacgacccaggctcatctctcacctgtgcccttgcaacacgggaatagccacctactgcacacaccacgctcctcctcatccaacgacgacgactggacacaacgggcccacgcccgccttgaccccacacaccgactcgacaaccgccccacgccacgacaccaccacgaccacacggaccgacccgcctgcccacctcctccccacccactcctcaccacacacccacctcctgccccaccggactgcccgacgggcaacgacgtccccatcccacacgacacgctacacgcccaccttccaacacgacgacacactgcccctggcctagacgacatatcaggggcgactctctccgaccccgcggactccccgaccacccccctaccatccacctctacccttcagccaacaacacgaccgtgaacgcccagaccaacgccactgcatactacggcacgccaccacgcccccaccaccgactgacctcacacccaccaccacacgcgacgccgcgcccacccacgcccttgccaccccgcccaccgcctgccgcgccctccccgcgcgccgccaccgccagacaacccggcccaccctaaccacaacggcgacccggccccctctcacggacg

SEQ ID NO: 617249 - DNA, 155 bp, Homo sapiens
gggtgaggcacagaaatcatgaacatctcaataaggtagtgaacgtaaccctgatctgaagactgatggttaatgcattgacacatgtcgcagcatggtggccgtgatggatagcgacaacacagacgatcaattccaggaacgacggggacgaa

SEQ ID NO: 617250 - DNA, 371 bp, Homo sapiens
  misc_feature (92)..(92): n is a, c, g, or t
  misc_feature (347)..(347): n is a, c, g, or t
tcctctctaaggagtatggatttgtgcttctcactggtgctgccagctttgtgatggtgctccacctagccatcaacgtgggcaaagcgcanagaagtacaaggtagagtaccctgtcatgtacagcacagatcctgagaacgggcatatgttcaactgcattcagcgcgcccaccagaacacgttggaggtgtaccctcccttcctgtttttcctaacggtgggaggtgtttaccacccgcgcatagcttctggcctgggcctggcctggattattgggcgagtcctttacgcatatggctacttacacaggagaccctagcaagcggtatcgaggaaccgtgggntctctttgccctcttttgccctga

SEQ ID NO: 617251 - DNA, 295 bp, Homo sapiens
tgtagcaacaaggcggcagcgacatgctggtccagctcgacaacggttcgagcatcaccatcaagcaaggtgagaccatgggcacggtgaccgtcccggcgcctaccgatgacgtgttcatcgacaagagcacccagaccgtcaagatcaccggcaccaccggcggcaatttcgagggtgtgaccatcacacctgcgggcgccacgaccaccatcaacgacaccatcgacgacgtgaccgtggtactcaaggccaccggttcggtcagcgaaggcgggcagatcgtctacaccgc

SEQ ID NO: 617252 - DNA, 414 bp, Homo sapiens
tggtcacatacctaaggaagaggtggacttccccagctttgcatgagaactccccagagagttgccaatactccgtgactccacttatcttcctactatcctcgtgttgaaaatatattatgtatttaacttagataagcaataggtgcatgtgggttgaaattccgaaagacacccagaagtatacagaggaaagcctcactctcaatccttctcaaggtttgctaattcctcttgcatagccaatccgttcttccagctttgtgtttatctttccagagaagtttcctgtgtattaagcaaatatgtatatctttattcttgctcaggattttcgcaaacagcacctgtctaagttcactgttctgaactttattttttaaattaaaaagatatggctatgtaaaaaaaaaa

SEQ ID NO: 617253 - DNA, 186 bp, Homo sapiens
atctaccgatcgcttattgaggtccgggtggcggacagttgagtactacctggagggcacgtgcgtggagtggctccgcagatacctggagaacgggaaggagacgctgcagcagagggaccccccacaagacgcatatgactcaccacgcgtgtctctgacccatgaggccaccctgagggtgct

SEQ ID NO: 617254 - DNA, 191 bp, Homo sapiens
  misc_feature (10)..(10): n is a, c, g, or t
  misc_feature (25)..(25): n is a, c, g, or t
  misc_feature (57)..(57): n is a, c, g, or t
  misc_feature (102)..(102): n is a, c, g, or t
tgtgttattnaggttgtgttttatntttgttggtgttttttgtgggattgggttttntgggtgagagattgaatttttttttttatttttggtatttggttnttgtggagagggttgaggttggggggttgttttgtttttttattttttgttgtgttttgtattttaataaagagaatttgtttttttta

SEQ ID NO: 617255 - DNA, 249 bp, Homo sapiens
  misc_feature (91)..(91): n is a, c, g, or t
  misc_feature (198)..(198): n is a, c, g, or t
  misc_feature (213)..(213): n is a, c, g, or t
aaaaactgtaaaaaagcaaaatgacacagaaaaacaatcttattccgagcattccagtaactttttgtgtatgtacttagctgtactatanatagtggttgtatgagatggttaaaaaggccaaagataaaaggttctttttccttttgtctatgaagtgctgttattttggcctgtttgatgtatgtgtgaaacaantgtttgtccaacaantaaacaggaacttttattttgctgagttgttctaac

SEQ ID NO: 617256 - DNA, 362 bp, Homo sapiens
gagctgctaccttcaagagaagagacgagatgggaggatcacttgagcccaaggattcgaagctgcagtgagctactattataccactgcactccagcctgggccacagagcaagactgtgtctcaaaaaaaaaaaatcccggttttttttccttttttcttttggtcctattttggggaaccattaccctctattaatctattaaaccctctcggtggattttttaattccggtgattataatattaatttcctaggagagctttttctggtcctcacagtatctgtttttaatagcatccttcctttttggcttggtggttgcaatatgtttacccctctgggggtcctaattaatgtat

SEQ ID NO: 617257 - DNA, 167 bp, Homo sapiens
ctctgagcacgctggcaggcaaactgagggtctattagggaggacagtatggactgatttccctatgctcatttcgtcctctttccccagacacccccaaagtgtcgctgatgccagcaatccttgcacgggccgccccaggggaggcaccccctggaattgctcag

SEQ ID NO: 617258 - DNA, 432 bp, Homo sapiens
ttttgtattttcagtagagacggggttttcaccatgttggccaggctcttagttctttttgagcatagtccttgttacttcttgaactcaggccttggagtccttggtacctttttttttaaatttttttgagacagagtctcactctgtcacccaggttggagtgcagtggtgcaatcttggctcactgcaacctctacctcccaggctcaagcgatcctcctgcctcagcctcctgagtagctgggattacaggtgcacactaccacacccagctaattcttgtatttttcctgtagagacggggtttcaccatgttgccacaagctggtctcaaactcctgagctcaaacaatctgcccgcctcagcctcccaaagtgctgggattactggtgtgagtcaccacgcttggcctcctgtctcttaaaaag

SEQ ID NO: 617259 - DNA, 799 bp, Homo sapiens
ggaatcttacagatctgggtggcatacgggggtggggattctgagtgtctgggacgactccgggatgcttttgttccgctagggtttactgggcgtgcctaaccgttactcccggagtacctcgatctccattgtaggacgcctatgcggccctcctaccgtggcgtgcccttctggaccaccaaaggacgggaagggctgtacagagcaggttacgtcgcacatgctgtgctcggagagcccacacgaagacctcgagcgacgttgaacttggaagtacgcgatgttcgatgttgcaatcgggtgctagtccgttcagagacattatagctggcatgcattgatacgcaggctccacattcgtgccttatgcatacgtacggaaatagcccattggagaccaagggtcacttgactggcactaggagaatggggttggagtaggctgtgttttcatggactggagtatctgccgaagatgaccgggcatggacatagatggcgtggacgagtcgggtgaatgcatactagtgtgactgagtaggaaactcgtcacaactgcgagggtatattgaaccatgggatggtggatttgggctgtggagattgatcctggtagcccagaggagaggagaatggttgggccaatggaggtcaaggcaaggaaagatcggtagagagtattcaagtactaataatcattgagatgattacgtgtataaatctaagagtgatgcctaaatggccccgtagaaggtgctgctgggtggaatgtcggggttgggaatatggaaggagt

SEQ ID NO: 617260 - DNA, 913 bp, Homo sapiens
agagcggtggtcgtgggatagaccagcatgaggtcgataatcttcgccaattacattgctcgcgatacccggcgcctgggggccaccattgacgtggaacactcccacgtccgattcctagtggaacctggtgctgaacctgtgggactgtgggcggtcaggacaccttcatgggaagattacttcaccagtcagcgagacaatatcttccgtatcgtgtatagtcctgatttacgtgtttgacgtggagcatgccgctgaactggaacaaaggacatgcattatctaccaagtgccgtgtctgagtacgtgccatctctccattgaagcattctcctgatcgccataaaatcttctgcggctggtgcacgaaaactgtgatgctggtctcaggaggactcatgcgtgagctgattttttaaagagcgagaggaacgacctgaggtcgtctgtctcgcccgcgtggacgctgtgctgggtctgttctgaacgtccgatctgggatgagacgctctacgaaagccgtggtccagcatcgtctaccagctgattcccaagcgttcagcaagctggagatgaagcctcgaggaattttggcccaagatcatcgagggcgatgaagttcgtgcttgttcgaaagagctacattcttagggttatgtgcacactaccagttgtaaaggagctgcggcgatgtccaccgggttgatgaagatgaggaatgattcattaacagtcgaagtgagcttgagtaaatggcgctgcgttcagagcatgaaagttggattccattcgtggtttcatcgagttctactcaatagttctgatgttggctgtagatcggatccttgggctttgttaattgagcggaaattggaatgggaatgtgccacattcttgtgatgaagtttga

SEQ ID NO: 617261 - DNA, 267 bp, Homo sapiens
taaacatcaacgcttcatgggatggctggctgcagaagcaactggcggtgcgcgactcagaacctccttgtgctagaggcgctaccatcaccttcacgccgtcccaacatgggtcacgaaacaacagcagcacagggttctactgctgtgagggtaaactaactcagtggaatagggctaggttacttcgggctgtcccactcataagtttggctgcattttgaaaatagctgatctaaataaaggcatgacaggcctggacatgaa

SEQ ID NO: 617262 - DNA, 391 bp, Homo sapiens
ctacgtggcttcattgtgtgtcggtcaacatgtactttctcctactgcttgctttggtaagaatgatgggttatcgggaggctgaggcacaacaatcgcattaacctgggaggtggaggttgcagtgagccgagatcgcaccacttgagcaacagagcaagactgtcttgaaaaaaaaaaaaagacaagaaccaacaatgggttagtgagaaacaaaacacaaattaacagtccccaccacaaacctagtgatgcacaggatgaacacttagaagacgcttccttggaatattacagacattcttaaatctgcttataaatgggtcccttctttaaaagctcaggaatggtggccctaggtaggcacacctgagtgggtattacctgcaat

SEQ ID NO: 617263 - DNA, 381 bp, Homo sapiens
ttgacatgatacgactcgagttcggtaccgtctcatcttctgactccattcctttgagtccattccattcgattccattccatttgagtcccttccattctagcccattacattcgagtccattctgttacagtctactccatacaagtccattccattccattatttccattccattccattccattccattccattccataccattcaaagccattcctttcgattctattccaatcgagtcccttccatttgactccattccccttgtgtccattgcattccattccactccaatccactccactccattccattcctctccactccattccattccattctattacactccacttcactacccttcacagcattcca

SEQ ID NO: 617264 - DNA, 117 bp, Homo sapiens
tgactctacaggagttatgcggagtgcatggtgcgggagacttatcatggcaggaggtgaaaggcttttttttttggagacagagtcttgctcctgtagcacaggggggaatgcagt

SEQ ID NO: 617265 - DNA, 134 bp, Homo sapiens
aagtcctcatggcaccatgctgacagcactaaatcactgtaaattccttggagagggctacagaattgcagaagttcagaaaaattactttggtcttttacatgtcaatattcagcgaaagaggttctattctc

SEQ ID NO: 617266 - DNA, 129 bp, Homo sapiens
tgagtcaacatgcgcctccctatctgaatttgaatcgagttcccccagataatgagacagaggcggaatgacctctactgatgcttcctctttacttcagtaaaatccccgttacaccctgaacaatga

SEQ ID NO: 617267 - DNA, 153 bp, Homo sapiens
ttatgtctgacccaccagtaatgacaaaactgtcttaacctcatttttttttttggagacaagagttcactctggtggcccaaacgagagcaagggcaccatctcgactcacggcaacctcggccggggcaacagagcaagattccatctctc

SEQ ID NO: 617268 - DNA, 779 bp, Homo sapiens
tctggggagcgcagacaggcatgtgcgaagccgtctcctggctcgaacaagctggcgccaatgatgcccatcctggggttgggtacctggaagatcccctccagggcaggtgactgaggcctgtgaaggtggccattgacgtcgtggtacctgccacatctgacttgtgccccatgtcgtcacccagcaatgcagaatgcagtgtggcgggttggcccattcagggcagcaagctcagggcagccagtgtggttgcacagcgtgcaggcagctctctccactctgtcgacgcaagcctgtgcgtgcacgatacccactgagaccaggtgcctgtgtgcacaaggacgacctgagcagaaaggacactcagaccgaacctgacaagcttggaacctaccctgtgaccctcatcacgctctacttccagctgtggcctggacctcggcacttcatagagcccctggagacacgtggacaccttttctcccccattatgcgccatgcaggttcgcgcgcaacactaggtctgggctcacacacacgatgcacaaccccaatgcatccctcgcgcaccacgatgggcgccgggccccatgggaacagcagccatggacggcgacttgcaactcgcgcctggctgcgacaccgcctacttgggccgctcgtcccacaccttcacacaccgaatctccccgtgctgcgcagcctgccccgatacaaaaaacacgtgggcctcgcaccgtatcacgacctgccatttcacccagaattgaggtgcc

SEQ ID NO: 617269 - DNA, 180 bp, Homo sapiens
cggtaagatgggtgcaaggtgctcctggaaagctcacccagcacagctgccctgagctcggggcttggttctgtccctggggatatttatatttaatacaatttttatataaagtacacatgagaaatagacgaatatacaaatctggaggcggtatggggaacgaaactgtgagtggac

SEQ ID NO: 617270 - DNA, 1740 bp, Homo sapiens
  misc_feature (907)..(907): n is a, c, g, or t
  misc_feature (1003)..(1003): n is a, c, g, or t
  misc_feature (1341)..(1341): n is a, c, g, or t
  misc_feature (1352)..(1352): n is a, c, g, or t
  misc_feature (1374)..(1375): n is a, c, g, or t
  misc_feature (1466)..(1466): n is a, c, g, or t
  misc_feature (1475)..(1475): n is a, c, g, or t
  misc_feature (1480)..(1480): n is a, c, g, or t
  misc_feature (1496)..(1496): n is a, c, g, or t
  misc_feature (1533)..(1533): n is a, c, g, or t
gcgtgccgatgtgcgaggggggtagacgaatgggttgttgtgcgtcgtgcgttcatgtaagtctgactatggtctgggcaccacgcgatgctttgtgggacgctcgccaccacaaatcgtctctgatgagtctgtgcgagacgacgatgaatgactccgcttgccgctctgtgtatagtgacacactatgtgtgtggccgcccctcgtgggggggacgcccacactagtcccctcgctcgctcgtccgccttttttgatagtaagacggtggggggggtttcccgccgttctgtcgggtggcaagcgcaaggagcacaagtgtggtgcgccctctctccgcgggtttgttgcgcgcggacgatctccgggggggctacccaccgtcccagtggcgcgcgcgcccctccgaatggtgagagttgtgtgtgtcccgcgcagatctgtgcgcgccgcttttgttagtagaaggtacccccctgttgttgtgaggagccgggggtggtgtgtgaagagctttggggaagatatctcccccccccgccccccaggtgtgtttccgcagacaagactgttgtgtgccccgccgcgtttgcccaggcgcccccacggggggagaggtcgtgttcggccgttctgccgcgtagggatagcctcctctggggcccccgcctggggtgggagggccccaaatgtgataaggtggatccttttgtaggggccgccaggacagatgtgtgttggtgtgcccccgcgctgctgtgggtggggagatgtcgcaggggagcgccccccttttgagacgtgtttgggaggggagccgccccctgctgcgcgcggccacccacagtggcggcagcacacacgcaccccgttggcgcgtccacaggctgtctgcgcgccaccacncgatggtggccgccgccctctcttctttcaaaaggctctgtttgccccaacagagagagaagaagcgcgcacattgctcctttatatgggacaagngtttttctccacaggcgtccccctctgttggagataagacacccccctcctcctctttttagaatctcgctgggtttcacagagccccccaaccggcacacattgtcctgatgaggctttgttctcctcttctcgctctgggttcccacacatcgttgtgtgagaagtgtggctctctctcgaaaaggggggtggtgtataaagatgctctgtcgagaagcccgcaccgagcacaccacagcgccccttcggcgctataacgcctgtggctccacagctttgcgttgtggaagaccttcgtcgtggctctcggggagaactcgcgagagtctcacagncccccacagcncttgtgggaagagaagggcgcnncctgctgtggagagcgatatccttgtcacagctggagaagcgccggcaggggcccacagggtctagtggtgttgagatgtcccacacaggncacaaagcntgtgntgtaagagagagaganaaaccacgcgaatacacggggcgcttttctcatgaanattgtgtataactcgggaaaaggaaagtgacgcacaacttatagatgtgtcaccacacttaatcaccccacagtgtaccacaggaattatgactgcggtttaataatttaaactcttgtcttcacataaggtgtacccacatttaaagagatgttatttaatgctaagatttaactgctttaataaagctctattttttaatatcca

SEQ ID NO: 617271 - DNA, 278 bp, Homo sapiens
catgttcagtcattggtacatattttcacgaatatttgacttcagagtctcagcatttttctaatatgtagagtggctggacattaagaactttactgcctctgcgaaattggaagaattttcatattgatttaacgtgtagggagtcagtggcacattgatggggcattattcatgggcacttagtcacatacatggaatcattagattgcatttccagcccactttactcaacaatgggatcaatcgtgcacattttcaacatttgccttatgcaa

SEQ ID NO: 617272 - DNA, 142 bp, Homo sapiens
tataccctgtgacagccagcagagcacaatgagagagagagacctcactgctgggagtcctgccacactcagtcccccaccacactgaatctccccttctcacagttgccatgtagaccccttgaagaggggaggggcctag

SEQ ID NO: 617273 - DNA, 162 bp, Homo sapiens
aaggagataaataaagagtatgggccacgaactcacgaaacgggaaatatttcaccaatcggaatcaccaccaccagagcacccccacccaccggcaaagaggcttttattgttgtgcgctctctattccgtgaaatttaaattcagccacccacgcgcacg

SEQ ID NO: 617274 - DNA, 675 bp, Homo sapiens
gagcaacggggtgggggcacacgtgtgcccagctgccagccctctggaaagccgtccagccgcggtgaagcactaccagtcctgtaatggcatggccaggaagcccagcagagctgataagatcgaacccttattggccaggttcagtggctcacgtatgtaatcccagcactttgggaagccaaggagggaggatcacttgaactcaggtattcgagaccagcactgggtctacatagtgtagaccacattcttctacctatgaacttatataattaagtttagtccaggccaaacggttgactataagtgccttgttagtccctagccatctgaagccagaggatcgagttgaaccagggagatcatggtcacagtgaactatgattacgccaacgctggggtcaccatatgcaaaggatctctgtcttctaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagtatcgcttgatctcgggaggcta

SEQ ID NO: 617275 - DNA, 186 bp, Homo sapiens
  misc_feature (179)..(179): n is a, c, g, or t
aaatttttttaaaatttgatttgcatttccctgaagtttatagttatgttgagcattttatcatatgcctattgaccatctatatgtttatagttagataggaaggataagttactagtgttcaatagtactatagactgactataattaacaattcattttatattttcaaatagctnggaagaa

SEQ ID NO: 617276 - DNA, 647 bp, Homo sapiens
tcgaggatctcattcagtcaatctgttgcacttaaactttttaatgcttcctaccatgtttaatacaggattttccctttagtcataaagccgtcttagaatgactccaggactgtaagaatgtgagtcagaaatttatgtccagactgtgatattgttatgctcttggattcccctgccaccgttgtcactgggctagtgagcgaatttattattgacttcacagtctcttttagtgactttgttcctataacttttctttactccagaattactctttctcttgcagtctttttcctatgcctcagaaaattcttattatttacttcgacattataagcatatttttactttctctatgagtatcttaaaacccactcatcctttcatagaaccatggaagtctgttataataaaacttactattccatagatttgcacacaatccagaacaatcacgctcctataaatcctattgagaagaacaacagggactccactttttgcttcccatcactgctgggaggacaagcatttgagcatttctttgtcccagtttctactggagaaactgtgcaaggacatcatagaagtacccacctcacaggatcgtcattcatgttcaatgagttctacatgttaaaata

SEQ ID NO: 617277 - DNA, 432 bp, Homo sapiens
  misc_feature (280)..(280): n is a, c, g, or t
agcaaggtgatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgccctgcacgccatttcaactgagaaaatcaaagccttgtaccccgactacgaggtctcctgggctaacgacggctactgagcactcccatcccggggcncttgcctccagcagccacttcagagcccccgcctttgcctgcactcctcttcgagggctgcctgtcctgctctgcggcagcctctggtgacgtgctgtcctccctgccttggagacaggctagcctggccacagaattaaacgtgttgccac

SEQ ID NO: 617278 - DNA, 1589 bp, Homo sapiens
  misc_feature (476)..(476): n is a, c, g, or t
gttgtgcactctccatcctgctgtgcgctctcgtcggtgatgtcccagccatgtccgacgacgagagaggtatggtcgaggcagcgtatccggggaagacgcctcttcgccgcctccgaaaatcgaggcagcgatcgaccccctagcatcccgtcggcctccgataggggccgtcgccgtcgccgcactcgccgccatctgtctgacgctgtcctagtgcctcactcggctttggaggctatcgaacataggtgaagctgcagagtccggccggcagcgcccccggttccccgtgggcccggccagctgacgctgcgtctgtgggcctgcggtgctcaacttcgcgagacctcaatggctaggcaggggctgtacgaccgtctcccgcctctgcctgtcactccgcggcatggcagcggcgcgggtgttgtgatcgcacttgggctgcaggggtcagcgaccgcaaggcaggagancgggtgatggtgttgaaccggtcagggatgtggcaggaagaggtgactgtgccctcggtccagaccttcctgattcctgacctctgaagaggttgggaagtgaccattatggatgtctgggccctgcccaaggcgacagggagggtcagagggaggccggctgcttacctgacccaccaccctttcccacgggaactgctgtgctgctttttgtcgccaaggttagcacagtcaccccctgtatgtgtaccatgtgctttcagcatcatgacctcatcttatccatcccgataccttgagccctgcgcagacatccgccaaagaatagaaagcgtcagctcaggatataggggccaatctctgtgagtccagcatgtaccgtgtcatctccctagatgtcccttcagacctgggactgacacaggatgcccgactcatgggctatgacacagattacccaatacctacaggtacctctggtacccgcagagcttccttaagccacaatatggcgataacttccaatacatccaagggtttcactgcacacttctataaaccaaggcatgaactcattcacaaaaagggaggggagaaatcaaagaggctaggtccaataaggttaaaacagtctgggaaagggattacagaagaacacacaaagctatagacgtgaagattctagttgggattatgtactacaagtgaattaagagaaggaaaaaacctgtgattgtagtgagtgtggagggagagggaaaggagggaaaccgtgggcagccacaaacaaagaaacacagaaagacaccgggacatcgcccgaagcagacccatccagtagaacgcaggataggcaacagaggcaggacgcacagcaatccgcacaagtaaccaacaaaagactggaccaaaaaataggacgaagagagacaaaatggagtgcggacagcacaaacgaacagcatgggcaagcaagggcacacaaaagggtgccaaaaatggggtcaggacgaccgggagccgacaaaaagaccgggagaaggccaaaggtcggagaaagagccaaacaaccaagaagcaaaaacggggacagcacaaccagagccagaaacg

SEQ ID NO: 617279 - DNA, 708 bp, Homo sapiens
  misc_feature (476)..(476): n is a, c, g, or t
gttgtgcactctccatcctgctgtgcgctctcgtcggtgatgtcccagccatgtccgacgacgagagaggtatggtcgaggcagcgtatccggggaagacgcctcttcgccgcctccgaaaatcgaggcagcgatcgaccccctagcatcccgtcggcctccgataggggccgtcgccgtcgccgcactcgccgccatctgtctgacgctgtcctagtgcctcactcggctttggaggctatcgaacataggtgaagctgcagagtccggccggcagcgcccccggttccccgtgggcccggccagctgacgctgcgtctgtgggcctgcggtgctcaacttcgcgagacctcaatggctaggcaggggctgtacgaccgtctcccgcctctgcctgtcactccgcggcatggcagcggcgcgggtgttgtgatcgcacttgggctgcaggggtcagcgaccgcaaggcaggagancgggtgatggtgttgaaccggtcagggatgtggcaggaagaggtgactgtgccctcggtccagaccttcctgattcctgaggccatgacctttgaggaagctgctgacttgcctcgtcaattacgttaccagactactatggtcctctttgacttcggcaactacagcctggccacagcgtctgggtacacatggcttgcaggtggtgtgggtatggctgccgtgcattgtg

SEQ ID NO: 617280 - DNA, 574 bp, Homo sapiens
aatgagtgtggtgcattgcctgcttcccgacatccatgtccagtgcctgcagataccagtgtcctgaaatgagtgatggttgatttgacatgatggccccatccatcacataccatgatcacaaaatgttgagaattgatcgtacacatgtgaactgtgatcaccatcaagtctaccgaacgtgatgcaatgtggggcatatgggaacgatgttgatcgtttttggacattcctggctatggattcagcaagacagacaacaactatggtaaactcatgtggtaggaaccaaataggacaaaaactggttagagactatggggattataacgtttttgggccccatcatagatgtgggcacaacccgagtgagaacaccacttggagttaggagacacaacaaaaacccatcgttgtggatcgcagagactgatagtaggtgtagctgtagcgaaccagcccaacccgccaacattatttcccgagacgcgagaaaaaacgattttggtgagcaaaaaactatttaccaaagcacaagatgaaaagcgacgagaacacagaccctgagtcccgc

SEQ ID NO: 617281 - DNA, 564 bp, Homo sapiens
acctcattttatgggcaagcaacactcttattccaaaatcagaaaagacaattgtaaggcctttcaataaaaaaattataaataaaatataaccaaccaaccccaagtgtatgtttctaaaaatcattatcaaataggtttatttcaggaatgcaaagatggttcaacatcagaaaaatctattgacatgatttacctcgtgaatggactagaggggaagaattgcatgattatcagtacagattaaaaaaggatttgatagcactggatctctatttattgtttaaactctcagaaaactagtaatggacagaacattttcttaacttgatcaaaagctacctatttaaagactgacagcaacatcactatttattagaaaaactttacacagcatctcccatagaagcgagtacgagataaaggaatatcatgtctatttctcaaattcgtcaccaggatgaatagaataagataagaaaaatgcataggaagtactggattggaaagggaagaacacactgccatcatatgcagatgatgtgattacctacacacaaagcc

SEQ ID NO: 617282 - DNA, 352 bp, Homo sapiens
tgagacagagttttgctcttgttgcccaggctggagtgcggtggtgcagtctcggctcacggcaacctccgcctctcatgttcaagctattatcctgactcagctgggattgcaggcgcccaccgccacacctggctgattttggtatttttggtggagacggggtttctccatgtcggccaggctggtctcgaactcctgacctcaggtgatccacccgccttgggctcccaaagtgctgggattacagccctgagccaccatggctgacaataataaaaaaattttaaagcataactaaagatttataaattgttgcggttgtaacaagtatttactgtaccagtattgt

SEQ ID NO: 617283 - DNA, 263 bp, Homo sapiens
accgtaatatgtacaacttaaatgaaacggaacagtgcttgaaatacacaaactatggccgggtgcggtggctcacgcctgtaatcccagcgctttgggaggcgaggcgggtggatcacttgaggtcaggagttcgagagcagcctgtccaacatggtgaaatcccgtccccaccaaaaatacaaaaatgagccaggcgcgatgcctgtaatcccagctactcgggaggctgaggcaggagaattgtttgaaccagggaggcg

SEQ ID NO: 617284 - DNA, 576 bp, Homo sapiens
ccctcaaccaccagggccaagaataattcaggcttttcttcaaacacttttttggcccctgggacttttatattaaagtgaccattttttttcacccaggggaaatttttataagggcccccttgtgtaaaggggcaggaacttcatgccagtaccagttgtggaaaactcaggctttgtccccccttttgcccatctttcagggaaagccctcaagcctgttaattcatgggggggttacaaaacttacaattccagcctttaataatttaccagaaagtaaataaattgccgggcacagtggctcccccctataatcccagccctgtgggaggcttcagtgggagggtccccccaagtcaggagttttagcccagcctgaccaacatggtgaaaccccccctttgctaaaaatacaaaaattaggtggtcatggaaacaagtgcctttaatcccagttgcgcgggagctttaggcaggagagctgcttgaacctgggaggcggagtttccagttagcttaaatggggccattgcactcccacttaaaaaacattctccgtcagcattcaaacat

SEQ ID NO: 617285 - DNA, 856 bp, Homo sapiens
ctccctgaaggaggcctacaggtgttccaatccttgacgccgagcccctgcagagcttcaccaagatcttgtctagagatgaacgcacctgaatttcaggggctaaaacgcttgagcgctagacgatgcctagcttcctcgttgaaccccttcagggtccaaggattgctgttggccaatgggcaagtgtcagtggtgcctatgaaaatctctcggatgctgctcgcgagggctcattcgaccctggggaagcgaacgtgtacggaggtttctagtcgagtctttgacccgtcgcgtctgggtttacctctctcgtcggggctcacgcaacgcatggtcgccgctggacagtggtgtgttttacgctggcttgaaaggaatatactgggctgaattattgtcttccgtgaggagtgagcagctaacgcgccagagtggacgagactaggggtatgcctagacagctgtgctgtctcggaaagtttggagtgtacgtacttcttgcagggccccacccatgtattgattctagatcgagctctggagtcagaggcagggagctgttgcaatgtgatgcacatgccagacattgagcaacttagtgaacgtgatccctgatgcaaccggtctaagactaggtgagtctaaatgtaccccaatgttaactgaagcggaaataggctccgcgagctaagggactcgccgtacgggtctcacacgtgagtaggaggagggcctgggatctgaagcctcaagggtcagaggccagagccgactgccgtaagatgggtgctgagaagtagagtcagggcagggcagctggtatcgaggtgccccatgggagtaagggaagtac

SEQ ID NO: 617286 - DNA, 423 bp, Homo sapiens
gaaccatagcaggatccccatctcgtgcccccagttcttggggggagaaacaggactttttacataatcatatggagctgcaaaagccaaaaagaatatcttctatagatttctttatattttttaaaacccactactaaaattgtatccacattagtattgtacgtttgtcgagagtgatttcctgagactggtttggatctccctgcatgacagtcccccataatcttagtgagtcctggactgcactgatcatccataaagcttccttgcaatcttggggtttggctttagttctcttctcttccttgtatttctcagtatgtgctagaatccagttcacacccttcactgtgcgtgcagacacattgacactctccgccacgagtgctccagagcccactaggcttgcagatcgggtgc

SEQ ID NO: 617287 - DNA, 125 bp, Homo sapiens
atcgtatcgtatgtccgcctatccagaacctccactctttcgcaccctttgctgatgcaagctaaggggctgatgaccctgtctttactggctgggcactgaggcattcagtatgccagtattaa

SEQ ID NO: 617288 - DNA, 916 bp, Homo sapiens
  misc_feature (619)..(619): n is a, c, g, or t
  misc_feature (869)..(869): n is a, c, g, or t
gatagaactgaaaacacctggcggggcgcggcggcacacgcctataatcccagcactttggaaggctgaggcgggaagatcgcttgagtccaggagttcgagaccagcctgggcaacatagcaaggccccgtctttacaaaaaatttaaaaattagcagggtctggttacaggagcctgtagttccagctacttgggaggtgggaagatcgcttgagcccggtaggttgaggctgcactgagctatgatcgcgcccctgcactccgacctggtagacagagccagaccctgtctcaacgaaaggaaagaaatgggccgggcgcggtggctcacgcctgtaatcccagcactttggaaggccgacacgggcggatcacgaggttaggagatcgagaccatcctggctaacacggtgaaaccccgtctctactaaaaatacaaaaaattagccgggcgtggtggcgggcgcctgtagtcccagctactcgggagcctgaggcacgagaatggtgtgaacccgggaggcggagcttttagtgagccgagatcgtgccactgcactccagcctgggcgacagagcaagactccgggaggcggagcttttagtgagccgagatncgtggccactggcaactccaagcctgggcgacaagagcaaagactcccgtccccccccccccccaaaagaaaacaaggaattcaattggaaacctttggggcttagactttaactcggttgcaaagattggtaccgggttggaaaaagttcaaaggaagggggattaggaggcgcttcatatataataggccgtgacgatcctacgcggtacctgggaaagaatggccctggttctatctccatggccgnacctcttgtctgtatggcgacgtcgtaaaacctagggaaatagacga

SEQ ID NO: 617289 - DNA, 215 bp, Homo sapiens
tagaggatccccctggcttgctctggtctccacattgctcacagcgtactgggaaggcgatgcctggcgggtgctgctggtggagagactcgggtatgtctcctgctccgattcattggccttgctcaggaccggggaagagttctggtcgagcgagtgatatgcgggactcagttgatacttggggataactttgctaatgtccccgacatcac

SEQ ID NO: 617290 - DNA, 109 bp, Homo sapiens
catggtctgggagaaagatccctgagcagttggtcaggcgaattcccagcacctgttccagttcctgcgttcgctgctgcccttggcaagatgtgcctgcctactgctt

SEQ ID NO: 617291 - DNA, 120 bp, Homo sapiens
atgcccccctcatccgcttatccaatggtcagcatttccagcagcggcacgatcttcactcactgcaacctccatctcctgggtccaagcaattcttccccctcatccgcttatccaatg

SEQ ID NO: 617292 - DNA, 110 bp, Homo sapiens
ctagagaccgttcgcatgagggccgtgaaatcagttcctgtgggttatgcggttgtgtttgggtttagtttgtttctttataaaaaattcaatcgggcagctccccttat

SEQ ID NO: 617293 - DNA, 963 bp, Homo sapiens
gaatccctgggggcccccccgcccccgtttaacctgttgatgtcccagcctctttccttgtttttggaaccccgacggtaccaccccagaccctttcaaagagggcccactgtgattccccggcccgctgcgggcgcctccgccgagactttgtgtgggttggcgctggccgctccccccattatatgcccgggactttagagggagagtgagcgcccagggacccggtttttggttcgcgtttcgagcaattgttcacacacggttctcggcttgggggggcacaccttaatataggccttaagggccacctctcccccgtgctattgttaaagagatatctctttgagtctgcacccacttgtcacgagaacaccgggtttcccctcccactcgtatatctcacgctttctttttggaaaaaacttggagcacggccacttttccacacccgcacctctttgaaagaaaatggaggccacaaaaccctgggccaccacacttgtctcaataaaagttttagaataggttcttttcttccccttccctccaggaggagcccacccagcttctttttttttataaagagtccctttcttatctgtttgggaaacccaccaggggtgccttttggggccaccatatttttacccaataagattgttgaattaatggcccaaaaaaaaaaaattatttacccagcccctccagattgtgtttgcccgaggggccctttgagccaaagaaaatgggttttgctgggctccattttgcccctgtgtgctaagccttgggtggctgcattcccctcctgtcatagatctgaccccccagcatgattgtatttctttcccctcccagtccaaccgtaataccagtttcccagaaaatttgcccagtctgccaatgcccaaagggtaaaaatctgtatttcaccgttgtatagaataaaggctttagtta

SEQ ID NO: 617294 - DNA, 648 bp, Homo sapiens
gtagtttttttattagaaatcgttattcaataatagtacatgttacaaataaataccattttaatactgaaaaaatgtagactttcaaatcagttagggtggtcacccttatagcaaagggcgattatttttccccattagtcttccttgatgcatgttgctcacgaacaaggaaatgggcttaatgcgtatgaataataagtaacaaacacttgccttctgtcaggccctgtgctgaataccgtctgcatatgtataggaagagggttaactcagcacggtctgtgtttgcccaggactctgtacattctccaagaagaggtctgcctttaggactggtcctgtggccagtcgtcctggagaagtgagctctcagcttttagaaaattctatctgctaagaatagtttgcatgtctcaggtctgggccacaaaatatcagttgaatcagatggttgatgttaacaagtgatgatttatggtaaacatagatcgtctaatctccatttgctctctcatatatctatatttatctatccatagtatatgtacctatatatatcaaatatgcgatatgttgatagcaattgtatatacgtagagagatatatgtagtttgaagagaggctgatattattttcatttagat

SEQ ID NO: 617295 - DNA, 141 bp, Homo sapiens
tagagatcctgatcacgtgcattgtgggtacgcatcacctgaatcaggacgatgctgtcgtgcggcagaggatagagggagagcacagttgaattgcgacgtacgtggagggacttgaaggttccaacatgatctgggtca

SEQ ID NO: 617296 - DNA, 372 bp, Homo sapiens
cccgcgcatagcacggagggagagcgcgagcgagtcgcacgacagggaatggaatgcaatggaatgtaatggagtggaaggcattagaatcaactggaatggaatggagtggaatggaatggaatcaacgccagtggaatggaatggaatggaatggataataatggaatggaatggaatcaatccgggtggaatggagtggaatggaatgcaatggaatggaatggaatcaactcgagtggaatgaaatgtaacgtaatggaatggaatggaatggaatggaatggaatggaatcaattagagtataatataacggtatagaatggaatggaatggaatggaatggaatcaactagagtggaaacgaatgg

SEQ ID NO: 617297 - DNA, 527 bp, Homo sapiens
  misc_feature (39)..(39): n is a, c, g, or t
  misc_feature (41)..(41): n is a, c, g, or t
  misc_feature (474)..(474): n is a, c, g, or t
  misc_feature (520)..(520): n is a, c, g, or t
ctggcagtaacggatctgacaaccggatttacgatttcntngatgggatggattgaatgccagcgacagatggaccgggccgcccggcgtggaaacatccgaggagaagccctgatggtatttcacgtcaccggcaggcaaatcatcaccgtgtttaccttcaaactcagcgaacagatcctgcggcatcttgcccagcgtgttgaccagcacattcaagcggccacggtgtgccataccaatcacgatctcttcgacgcacgttcaccggcacgctggatggtttcgtccatcgacgcgataaagctctctccgccttccagagaaaagcgtttctgaccaacatattttgtatggagatagcgttccagtccttcagcggctgtcaggcggtccagaatgtgttttttcttttcctgcagaaaaaactggtgtggaacggatggattccaatcgctgctgcatccagcgttntttctgccggatcgctgatatacataaattcagcaccgatcgaacnggcagta

SEQ ID NO: 617298 - DNA, 1283 bp, Homo sapiens
gacggactctccgtgattttaggagtgtccctggtcagagatttattgtctcttgtacaaccaaggggcctccgatctggatttccaaggaagaatttcctctgaagtcgaccggtaatttgctactaccaggcaccagtgccctatcgcaatagtccagcagctgagcccggagcttgacgaagtgatctgtctgacatcgctcaccggatcgtggcacctggcaatggagcactgctgagctgcggattacgtccatctgtgaggcattgccaatgcggactgcggtccattggcatccgaagatcaccgacgataaccggcgacttctacacggcagactgctggctgaacagctggaccagacatcgcgtgaaacccctgcatttgagagcggtgtcatccttcttctcatgagaataactctaaccaggaacggcgtgctgatgggcgttgcctatccgccgcaagttagtcaaattccaaggggcgtgtgtaggtgggcatcaaggtcagacgcaaggcgcgtggatccccacttggtcagggcacaaaatgggctgagtattacccatccaagggttaggaatgcggctagatctggatcgacttgatgacccaatgtagatatcaaagggacctggacatcttgaatatttaccaaaagtggacagatcggtgctgcgtgaactactttgggggaaactacagaccctcttaatgtgccttcgaccaagtaattgaacaattggcctagatgttccttggccccgagtatatggcccagtaattcatgcccagtaagacacgtggcgattggtgcgcccattcgctgggacgccctcgaggattacttcccctgattgggggacccaacggaatgtgaagagctggcaaataatgtagacggaaaagggtacgtgtatgaacaggaataaagagcacatattgtcacacccatttacaagtaagagacacctgtatcaaacacaatgtgcaatcccattatttttgtttctagtataccacaaacaataaccaatgtaccaacatggtgaacaaaataccccagcttggacaacatcatttttaacaaaagaaatagaaaacacaaaaaaaagaaatatatcataagacaatataaacaacatataatgaaaaaaaatgaagataaacatatacatatgataaactaacaagcacctccgcttctttctcatcttcatattttaacaaaataaacaaaaaataatcaagatcatataaaaataaacaaaaaaaaa

SEQ ID NO: 617299 - DNA, 88 bp, Homo sapiens
ggatttgctggtgcagtacaactaggcttaatagggacatgtaaggccattacacaaataaataaccaatgttaaaatccaaaaaaaa

SEQ ID NO: 617300 - DNA, 329 bp, Homo sapiens
tcagagacaacaggttgataggacgcaacagattatatctaaagaactgacttacccagataacagactcctccaaagctataccgttactcaccacaaagcttattaccatattctaccattcaaaaacaaaactttataccacatacatcattgccagtcaaaaatagtcagcttctaaattctgtattaactttaccatccaggctgacctcagctgtaccatcacagcagtatgccacgcacatctgacaaaagacctcctcctcctccttactactatagatatcgaagagtgcacttttggggtacccgaagctcaaattcgt

SEQ ID NO: 617301 - DNA, 354 bp, Homo sapiens
cagtacgtgatgtgaataacaataaaacgagtcacatgattttttttggtttcctcgtgcatatgaaagttatgtttatattttagcattatgtctaaaaaacaatgtacataccctttttttttttcttttggagacacagtttcactccgtggcacagacgggagtgcaagggggcaatcttagctcacggcaacttccgcctccggggttcaagcaattgtgggtgcctcagcaccccggagtagcggggattaacagacttgtgcggccacacccagctaagttgttgggtgtgtaagtagagagggggtttggccatgtgggccaggcgggtctcgaactacgggccgg

SEQ ID NO: 617302 - DNA, 124 bp, Homo sapiens
gacctctacagcgcacgcgcggcacatagcataccgtcttcaaaagaaagagagatgcatatatatctactaatagatgtattgatattaacattatactgtaagtgtaaatgactaaaatcgg

SEQ ID NO: 617303 - DNA, 456 bp, Homo sapiens
  misc_feature (11)..(11): n is a, c, g, or t
  misc_feature (46)..(46): n is a, c, g, or t
  misc_feature (264)..(264): n is a, c, g, or t
  misc_feature (456)..(456): n is a, c, g, or t
atcctgaacanttaaattttagacacctacttgaatggattaaganaacaacacatagctggtccaaacacgaatttctgggccatatcctatgaagggtgtttcctggaagacactgaagataaccatgacccaatgtggatgggcactgatatggtttggctgtgtccccacccagatctcatcttgaattgtagttcctgtaatacctacatgtcgtgggagggacccagtgggaggtgactgaatcatggtggtggttancgccatgctgttctcatgacagtgagtgagttctcatgatctgatggttttataaggggcttttccctttgggtcagcacttcttgttgctgccatgtgaagagggatagctttgcttccccttctgccatgattgtgaggcccctgcagccatgtggaactgtcagcccattaaacccctttgttctttan

SEQ ID NO: 617304 - DNA, 293 bp, Homo sapiens
  misc_feature (23)..(23): n is a, c, g, or t
  misc_feature (100)..(100): n is a, c, g, or t
  misc_feature (111)..(111): n is a, c, g, or t
  misc_feature (125)..(125): n is a, c, g, or t
  misc_feature (149)..(149): n is a, c, g, or t
  misc_feature (152)..(152): n is a, c, g, or t
  misc_feature (164)..(164): n is a, c, g, or t
  misc_feature (167)..(167): n is a, c, g, or t
  misc_feature (201)..(201): n is a, c, g, or t
  misc_feature (225)..(225): n is a, c, g, or t
  misc_feature (230)..(230): n is a, c, g, or t
  misc_feature (238)..(238): n is a, c, g, or t
  misc_feature (241)..(241): n is a, c, g, or t
  misc_feature (253)..(253): n is a, c, g, or t
  misc_feature (255)..(255): n is a, c, g, or t
  misc_feature (259)..(259): n is a, c, g, or t
  misc_feature (265)..(265): n is a, c, g, or t
  misc_feature (271)..(271): n is a, c, g, or t
tttaaaacttccacatattcccnggaatccaaacggccacatgtacatgcagggtgagcaaatagagaagacttgagaaagccttaaactctcacctccngctaaccacgnggcttgctcaaatnggaagtgaaaactacggtgaattngtngcttagctgaangtngaaggtgtgccccaacacttacacagagcctacnggtaaagacagagtgttttctttncgtcncggtttcnggnatttacggaaancngttnctctcnccggancactagctgcaaattacgctac

SEQ ID NO: 617305 - DNA, 164 bp, Homo sapiens
cctgttttgaaaaggaatcctcggtggataaactggactgtcctctacagaaggaagcacaaaaagggacagtcggaccgaaattcaaaagacaaagaacccgcctgagcagtcaaattccagagggaccattactaggtgcatctcttgcttgatataattgg

SEQ ID NO: 617306 - DNA, 236 bp, Homo sapiens
cgagagggaggggtgatagaggatcccgaatagtaacacacaagtcgagagagaaagttcagcgccccatttattctttctctttgtagtcaggccttcaaacctaaatactggaaaaactaatctggtttcctttcctatagtttgggctttttcaatgtcatataaatggagggatacagggtgtagccttttgactcatgtctttttttacttcggatgttacatattacggg

SEQ ID NO: 617307 - DNA, 669 bp, Homo sapiens
ggctagccacgcaggcggggccctggctttataaaggtataattgacaaacaagaagagtacctaggccaggtgcggtggcttacgcctgtaatcccagcactttgggaggccgaggtcatatgatactctcagagtgagcgtctggataggaccgagaagacgcagtgacatgtacgttagcaaagcttatcgttatagccacactgatattggtacccgcaataaatagtgcactaggaaacgccaccccagatgaccacacactgccccgtgggcctccctgggccctctccggcaaaggacctggaaacaacggtggttcctttcgataaagaacgcaggatagctcctgtggctcggtggctgtacatgacgcggatgtgcacgcgtgaggggtgcccggcacacacgtgcctgacgtgcagatggctggacgctgctgcacggtactgcaagggcaaacgtgcatggctcgtctacacgtgctcatgccgtggcacatctgcgagactgcatgtacacaggcacgcgtgccacatctggagtcatcatatatccgcaaccagcaccgcatggaccctaggccatgatggccaagcaaaggtgacccgcctacatcattcttcaagcaaacatctacgatacagacgatccgtcattcctagag

SEQ ID NO: 617308 - DNA, 175 bp, Homo sapiens
tcttattgcacggccaagaagtaggtggacaagaacagcaacgagtacctgggtgctggcgcgagcgcaacaacatctgcggtgcgcaagagcctgcgacaaggccaagcagcgcaatgtggagacgcagcagaccggtgctggagctagaccagctgacacatgacctgcctgc

SEQ ID NO: 617309 - DNA, 266 bp, Homo sapiens
tactgagacatagattctcacctgaccttcaaagaagggccaagttccctttaaaggtcgcaccgtaccttggcaccacacgtcatcagatgaattacactacaaggaaaagacgtgctcacaccaggcagctccagctgttacctgagatactgaagtgcagctcaggcagacgattatttaacacctgccctaggtattaatctgttcattattctctattaaacacaaaatcgcaagctcatacacagcaaacagagggcagc

SEQ ID NO: 617310 - DNA, 657 bp, Homo sapiens
agcgggggagggaccggacttccggctggtctgtggggttacgaggttcggggttatcctggctggcgcgtcaggggcagggcaacagagtggctggccgctacggccctggtaacgcggccagtgtggagaagcgtgcgtgcgagatcctgagcgagtctaggacgacagaggagccagggcctgactgcagcaggtcctggagtgcctcatcccttagttgtcaacaccagattgaaatggtttgccatctgcttcgaatgtggcgtgtactttgctattcttggaactggatctgcttgtgtgctatcctgtgcgctggactatataatgctttctctgcaggagttttatacgcctcggcaatcttgctggcgtgtagccagtacatgcttttgtaagtagggacctggtgaacgcaaacttgacatggaaacaacttgttttgaacgcaacgaaagattggctgtgcagagaagtatgtgtaatgcatttggggtgtatcatatttagccctgtgtgctgctctttggtggcataagaagggactggctgtgttattctgcatattgcagattcttgtcaatgacctggtatagcctgtcatacatcccatatgcaagggatgcagttatgaaatgctgttcttctctccta

SEQ ID NO: 617311 - DNA, 406 bp, Homo sapiens
tgcaagccaaggcagcacacactcacagactgagatcacctctcctgagagccttgtatgatgcatgagctgtcccagatgcagacccacatcacaaacacatctgtggtgctgtccttggacaacaaccgcaacctggtcctggacagcatcatcgatgaggtcaaccccaatatgattagatcgcgcagagacaccgggctgaggctgagtcctggtaccagaccatgtacgatgagcaacaggtaggggtgtctaaataatgcagtcaactgtaagcctacttgtgcagtggtaatgtgctactcctcataggcagcgagggatggggacactggtagattgaacctcgggccaaggtccctcgcaattaaaatactgcttgctctgtaactgccaaccatat

SEQ ID NO: 617312 - DNA, 796 bp, Homo sapiens
  misc_feature (402)..(402): n is a, c, g, or t
ggaggagccggccccgcagccgctgacagggctctgggctggggccatggcgaagaagagcgccgagaacggcatctatagcgtgtccggcgacgagaagaagggccccctcatctgctgccctgggccctgactggggcccctggccaatggtgctgactggcccctgtgtggcctgggtgacaccctggcggcctgcctggcctgtgcctgctgcgcgagaccctggacgctgccagatggacttcatcactgtcgtgctgtggtgcttctgccgtgcggcttcgggcaactgtggtggcgccttcaccctacccttgtgcttacaagaaccgggcggagggtgttggttcctatattccctacgtcccttgatcgccctggtttggaggaatccccatntttcttcttagacgatctcgcttgggcccagttcatcgaaggccgtgcagcatcaaatgtctgggaacatcttgtcccctgttcaaaggcctgggctacgcctcccaatggtgatcgtcttctactgcaacacctactacatcatggtgcttggcttggggcttctattacctggtcaagtcctttaacagcacgctgccttgggccaccaattgtggccacacctggaacaattcccgaatgcgttggagatccttccagccatgaacgactggtcgccaattgccacgccttgggccaaaccttcacttgttgaccagctttgttgaccgcggttcccttgtcatcgcaattctggcagcacacaaggcttgaaggcttgcctggcgaactg

SEQ ID NO: 617313 - DNA, 280 bp, Homo sapiens
tccaaagcagcgtaaaaacaaagtactatgcaagactgtaggagaaaaacgtgattgtactgaacagatgagacacttggagaaaagatgaacaattattcattttggtttaagacatcaggagtactaataaagaaccaactggtaaactgctgataatcgcatatatatatctagcatacaactacactgaatcattcttttttttttttatatatatcctaaagtttaaggggatacatgtgcacttggtgcaggttagttccttttgtatactgtg

SEQ ID NO: 617314 - DNA, 552 bp, Homo sapiens
  misc_feature (461)..(461): n is a, c, g, or t
  misc_feature (486)..(486): n is a, c, g, or t
  misc_feature (550)..(550): n is a, c, g, or t
aaagaccatccccaaaataaaaatcaatcaggagactgaaactgaccaaaagaaaccatgaggaccacttgttgctcaggacctgagggtttgtcccattgaagggtgagaagacgaggtggggtgaggtgaagaccttcagtcacacagccagagtgtgcgccttgggtgaaaggggataggatgcgctgtctctgctcttccatacctataaccccttgagctcaagaccacaggacccaccactcagaccaccataaaagtcttgttagtggtcctgccttgggtttctctcactccctccaaaccatcacacttgatagatgagaaactctataattgacacgtcacactctgggtcagaaggtgttaagtagttcctgttattcaagggatggaagtacaaccactttaggcccagtgctcaaggttatactttccttactctgtaaccaattctntagttttcaccttcggagggtggcngggggccttcagacccttcacatgcatttctggcttagggttttccttttgtggcaaaaccgtnct

SEQ ID NO: 617315 - DNA, 209 bp, Homo sapiens
gctttcccttctcaacctagtgatttggtcaggctttcaaaagaaggggagcaaaaaggctgtccacgtatttcgccaaaaccctcaggctgcaaaatcaggcagcatcttcacagccctccttccgatagcatgagtgattaacccactcttcctgtaactccatttcagagactcggtgttctgtaataggtagggtataaatacat

SEQ ID NO: 617316 - DNA, 141 bp, Homo sapiens
  misc_feature (9)..(9): n is a, c, g, or t
  misc_feature (81)..(81): n is a, c, g, or t
  misc_feature (93)..(93): n is a, c, g, or t
  misc_feature (117)..(117): n is a, c, g, or t
aagaggttnttaccgtgggcaactttttcaacgaaggcttgaaccaacctacggttgattcgtgctttgacccctacacantttcccattatnccgttggagatgagtgggaacgantgtttgattcaggctttaaactgt

SEQ ID NO: 617317 - DNA, 268 bp, Homo sapiens
tgtagtagacatggggttaccatgctggccaggctgggtctgaactcctgactcaggtaatccacccactttggcctcctgaagtgctgggattactggccatagccaccgcacccagacagttattgcattcttgtttcctgtaaccaatatttcatttatccctttatgtggagagaattaggtcatcatttcctccgtaagtctagaacatttatctgaattcttagaacattttcattaatcctctccctgcgagacctatgat

SEQ ID NO: 617318 - DNA, 365 bp, Homo sapiens
ggctgtatggtcatgagaaaatggtcatttccttgattacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcatgagatccaatggttttatacatggtagtctctcctgctgccatgtaaaacatgcctgcttccccttctgccaggattgtaagtttcccgaggcctgcccagccatgtggagctatgagtcaattaaacctctttcctttatataaaaaaaataaaaaaagtcgacgcggccggaat

SEQ ID NO: 617319 - DNA, 838 bp, Homo sapiens
atatttctattgtgattgaggtccgacgtcgcggttttctcaagcgcctaaacatgcattgcgattgcgagattacatgccctttacttcattcttccccccatttttcaaggtcgtgctgtacttgtaatgcaccacctgtctgggaatccctatcgtgggcctcgtacaggacgtccacttgtcttctgtggttctattcctcggaccgttgagataatcctctcacggggcgaattgcactttgtcgtgaaattccagtcccagatcgttggcctttccatgtggatgcctcctgcttggagaccctttaggctcttgcttccgagggctattcgtcgccatcaggactctccctgttccttagggaatgccctcggttcctctttgccgtgctcgtgatcttttttgcttgcgtcttccttggtaactgcgacgcgttgtcctattgctcttcggtcttggttgtgggggcatgcagtcacacattagcaacgtctcgatctctttttccccagtccccttatatataaagtagcctagtactccgacgttgaggcgtgcgaaggggtgatgtcgggctcgccagtgcgactagtaagacttactgcagtcgattctgcggatttagctaagtagtttctacagagctagatctgtgcgcatgtgtgtgttcgtgtatatatacatatctagggctagtaccttagtgttcacagcccgggagctgggagacctaacctgtaacagctgcgtctttctcttaattgtttcaataaaatagaagagaatcgcgcatcgtcgcgcgtcccccccccacccccttttctacaatact

SEQ ID NO: 617320 - DNA, 283 bp, Homo sapiens
tcctggactctctggtgggcttctccttctcctactatcctatccccggttttaggggaccccacacgcttgacagtgacactgtgacacagagatgaccccacagcgagggagtggctgagtagaaggggagtgggacacaacattgctaacagagctcacgttgagaaagagtttaaaacaggcttcttgtgggccgggcacgggtggttcacgccgtgtaatcccaggcacttggagaaggcaggaggcgggtgggatcacataggtgcaggaagagacc

SEQ ID NO: 617321 - DNA, 1109 bp, Homo sapiens
ggcagagccctggtgagtgcctggtgcctgggctcgtgggtgccacccctgtgggtgccctgggccatggatgtgctgccgtctgaaggtgaactgaacttctgcgatggagctgcatgctgccgctggcctggacactcgatggcctcaatggcctgagcttgctgagcggctgcagtgcggcgttggaggccgaggagcctgactgacgagctgggagctcgacgccgacgacgaacctgtgggctgacccggtggcacatcaacgatggcaggtcgacgaccgagcggtgggctccgaggctggaggggaccgctgcagccacctgccgccctggagcttgcaggccctgcactgcgtgagccctggctggctaactctggggcccggacggggaacattattgccatggaccaactacttaccagggcagaaccaattctacggatacccaaggtcatcaaacaacgacaaaaccgacgttcaggctacgagaggagaccacttggaccactggcacgcagccagcagggccttatcgtccagacctgccgacagagatgacgcacggaggaaccaccagattcctcccggctgaaagcttctcaagtcaagccagacaggcagcaaattccagagtcgcaaagaggcttatgacgaaaaccggggacggggggtcctttggagcaccgagaggcactggcagcgggcgatctcctagcctccggctgaagaggatgcagatgactttgatgataccctggtcgctattgacacctataaatgcgaccctccattcaggtggccccggacatccgggagctagtggttatccggtcaagccaattagcgggcgcttggagttacctgtgcgcacggaagccccggtcgcccgagtaaaggggggcccaaacgggggcgtcggtattcctccgcaaagaggatctcacgccgggaatctcccggaaaaacctgtccggtgaaaaagcaacaccccaacgtggcggaatccaggtgagcccagaacccggagacccactaggggagacgtcaccgatgggtagacgagagagcatcacacaggcggacaccacacgtggagcaacgt

SEQ ID NO: 617322 - DNA, 279 bp, Homo sapiens
tcagaggatcccccccaaactagagaaagatatcaatagttcaaggtataagaagtatagaacacaagccagtttaacccaaagagtactacttcaagacatttaataaccaaactccgcaaaggtcaaagataaagaagaggatcctaaaagcagcaagacaatagaaacaaataacaattttaaaaaatacagagggaactccaatacatcgggcagcagacgttggagtggaaaccctataggccaggagcgacggacaggagtcgctcttggccg

SEQ ID NO: 617323 - DNA, 830 bp, Homo sapiens
gacagtccctcctctccggagcatttagataccacgaagggaaagcttcattctccttgttgttggttgtttttacctttgctctttcccccttccatctctgacttaagcacacaagcacaacgagcattacccaaaaactgtctttcaaaagcagagcagagcagcaaacaaacaacacatagtattatggcataacccttgcagcggtgtggcggcaggaacgggtttgtgctacagcatgcataagcaggcattttatacccgcaataaatcaactcgcttttcatcattaacatgtcaccttgtattctctagttgtaacagcaatcgcgctattcaaccacgcaacagtgagtgctgtcatcgcggcagcagtgattcagcgttcccaatccgtttcaccgtgcttttctcaccagacacacaagcgtatcaaaacaccattatctcaacacacacctatcaccaaaacttcagccaaaccaattttataatacgtacagaccagcacgggctcatccacggtcagcaaaacaacatataccttgactagccttaaacccgttgataaaaaggcacacgcctgtcactgcggcgtacactcagagacatctactcgtacctctacgcctcttgctcatcattgcattgataggtcccacctttcactaaagttccatttgcaaatgtccatcaataatacccgctacggatagacaagtagctaaaccgttctatcaccctcacatttcatctggcctgacaagctcacacctcttcggattcacaacatacgcgtaaacagtagagacagtgtgcaattgacc

SEQ ID NO: 617324 - DNA, 492 bp, Homo sapiens
  misc_feature (7)..(8): n is a, c, g, or t
agcgggnngtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggtacctccctccacccacccatccacctacccatccacccttgcttctacctatctgactcattcatccctccagtgagcacctacagtgaaccagacctaatgttgcatgctgttttcacgtagtcatttaaaggattctcaatggaattctctttagttgctaattttacctaatcctgcttaatttagtgattaattttaatttacttttaattcatttctaatttcagttactcattcttcattcactgacttttaattaagggggccgaaggttatttccctttaggtgagggg

SEQ ID NO: 617325 - DNA, 630 bp, Homo sapiens
  misc_feature (7)..(8): n is a, c, g, or t
agcgggnngtggggggaggaacatggcgcaagctctgtctgaggaggagtttcagcggatgcaggctcagctcctggaactccggacaaacaactaccagctttcagatgaactacgcaagaatggtgttggtgagccaggagggccttattagatgggggtggctttggggaatggtgtccgaggttttccctcagaggcctggcaggaaggcctttcagtttcttgccactggctgaggctgagtttccctgctttcccgacaccagaactcaccagtcttcgacagaaggtcgcctacttggataaggagttcagcaaagctcagaaggtacctccctccacccacccatccacctacccatccacccttgcttctacctatctgactcattcatccctccagtgagcacctacagtgaaccagacctaatgttgcatgctgttttcacgtagtcatttaaaggattctcaatggaattctctttagttgctaattttacctaatcctgcttaatttagtgattaattttaatttacttttaattcatttctaatttcagttactcattcttcattcactgacttttaattaagggggccgaaggttatttccctttaggtgagggg

SEQ ID NO: 617326 - DNA, 817 bp, Homo sapiens
  misc_feature (7)..(8): n is a, c, g, or t
  misc_feature (738)..(738): n is a, c, g, or t
agcgggnngtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacnagaaagtttggccgtctgcagacagaaaaggagactctgtttaatgacagcaggaacagattgcggaattacaacaggt

SEQ ID NO: 617327 - DNA, 108 bp, Homo sapiens
  misc_feature (7)..(7): n is a, c, g, or t
gaccccncctcaccagaccctggcagaagcaggaagcagccatttggcagaagcaggaagcggcagaagcaggaagcaggggtcttggtgaggggcagaagcaggaag

SEQ ID NO: 617328 - DNA, 800 bp, Homo sapiens
cttccatatatgggttccccttcggtgcccctctatacttgtcctaatgcgttcattgcccatgcccccttgtgaaacagtcgcacacaaagtgctagttgtacaactttccagcgcttcgtggattttaaagcccgtgttgtatatttcctccccgcccttatctcttgtctcattgccgctcccactccctatagacagccctgttaaaaaacacaaacgaggggtcaacaatgcctcccccctgcgccaccacaaaaacacaagtggcgcaccccccggtgggcctgtgaactctttcgggtacccccgcgcttcgggcgggtcttattttgtccacgtgcctcaacaaaacggtcccccccccctatgtggcctctggcgacccacgcgggcgacctcgtgagactccctggacgcggtgcccccatcggcgtgggtgatctccccgcgcttgtgagccccccccttgctattatatattaacctcccaccacaccttcttgcaactcacagagagctgttgcccccaacccacactatagctttaaaacaccaagtccaatttcgcgaacgtttttaaacccccaacacccgtttgctcctcgcgctatacaaagcaacccgcggtaataactatcgcgctcccaatgctctcttaaatactcttgtgaacccaaaaccccagcttttcacttccccctcgctccctttaaatttaattcccccctaaaattcctttaaaaggggcccctttttcccctttcccccccctttcccccctttgagccccaaaaaaa

SEQ ID NO: 617329 - DNA, 708 bp, Homo sapiens
ctcaaaaaaaaaaaaaaaaaagaaagaatgaaaatattgcaggcaataaaataaaaattctctgtaggcctcgatattctcatctgaaaatggggacaaggaattttctcaggactgctttgagaagtgtacttcagccaggagttgggcagggggctggcttagttgtattggcattgtatacctctccaagactaacggctggcaatgcaggagctgtcatcagtgttggccctggaaatgccctgcgagctctttgtggtgcttaggatgagagggagctatctctgggcccaggatccagccctccacagaagaggggttgcagtgaggctgtctgtagcactaacaacttccagaggagcctgaggtcttggattgcatctctgaggttgggagtaggaagaggaaaatggtttttgtgtgcctttacatctgctactacctcactgccatgtgttgctgtatctgtccttgtttccctgtatttgtcctaactctgtgtctctttccttctctctctttccattcttttctctgagtctctttctgtctctgtctgttttcctgttcctgtctctctgactcatttctcttcccaatcttctctttgtctctccccctcctgttcctgtctcggtgatttctcttttttctgctttctctctctaactccttgtttcttccaccccattctctctccctccc

SEQ ID NO: 617330 - DNA, 1191 bp, Homo sapiens
gactgtgccagacacgtcagacaccatggccagcttcctgaagggggcccatgtggcacatcaacgcacgggccgcaggcagcatgtggagcctgagtgcatccatggcagcaaggtggccaaggcttcagtgtgccaactacagctttccacaaggcagcagtggccgcttccagtgcacgtggtgcacccagtgcccccagtgggctctgttgtccccagcacagcagccaatgcctgtgtcctgagcattcaccacaggggtttggtcacacatgcaccaggcttacttggtgcctacacagccagcagcacaggcaggcagggagcaaccaggtctgtgcttggcaggcacaaaagctggctgtgtagccgagggacggccacaagacagcgcagcatgggaagccaggcagcgccgtgtggaggcggttgaagctagcgttgcagggcttgcaccggccaggggacagacagccggctcatacagggcacgccagggtagcgccgctggcgcgagccccacccaaggcagggcacgtatggagacgccaggacaggcaacaggaaacgctggggttttcagaggcaaacgcagacaactgcaggcagcgacgctcatgggccgatgcaacccccgcacggggccgaacattctcaaacgcaaggcacgggcagcagggggcaccaattggtcccgaacgcaaagacattcccaaatcagttcacaaggaaaccgactcgaggacacttgggagcagaaggctggacgggcaaggcccccccttatacccttggacagacaacagggcaaggcagtccagaccaccacagccgcgagcagaaagcgcaacattatacggggggacacggacggacggccccaagggtttgggcttggcacgcaagtcctcgcagaagggggaccacccagcgtgggcagcaggcaccttcctccaccccagtgacgctggtacgaggcctggccacgaggtagggcaaccacaggagagccaaacccctaccccagatgtatcactgggggatgacacagacacagcacacggaacgggcacggcaatgctgcgttcttgccatgtgccaccctatcgctcaaggccagggaggacccattagctacagacgccaggccccccacactggcgtgccacacagacacaggttcgcatg

SEQ ID NO: 617331 - DNA, 658 bp, Homo sapiens
  misc_feature (7)..(8): n is a, c, g, or t
  misc_feature (579)..(579): n is a, c, g, or t
agcgggnngtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacnagaaagtttggccgtctgcagacagaaaaggagactctgtttaatgacagcaggaacagattgcggaattacaacaggt

SEQ ID NO: 617332 - DNA, 110 bp, Homo sapiens
gatatagtaaagactggggctagagacttcattggtacataaattatcccaaggcagacaaaatgtaatggcggggctgggcacagtggctcatgcctgtaatcccagca

SEQ ID NO: 617333 - DNA, 612 bp, Homo sapiens
  misc_feature (304)..(304): n is a, c, g, or t
acatggttttggaggttcccttggggtctgccccgtatacgcacagtgagccgtgattgtgcctttgctccgcagcctcaaccttgtcttttattatgagcaacgacacccacagatcgcgtggcactgtggtctccatatcctagtaaggcagtccatctctgtacactttggctctaaaatcccacccacggccactttaggcactgagcaagagcaagaaagctcaggtaaggggatcccttgtgggtgagtgtgactgggagatgtcttggtgggctatttctgtatgctgatatttccntgtactggcctttctttctttgtgtgcctttacatctgctactacctcactgccatgtgttgctgtatctgtccttgtttccctgtatttgtcctaactctgtgtctctttccttctctctctttccattcttttctctgagtctctttctgtctctgtctgttttcctgttcctgtctctctgactcatttctcttcccaatcttctctttgtctctccccctcctgttcctgtctcggtgatttctcttttttctgctttctctctctaactccttgtttcttccaccccattctctctccctccc

SEQ ID NO: 617334 - DNA, 608 bp, Homo sapiens
  misc_feature (96)..(96): n is a, c, g, or t
  misc_feature (155)..(155): n is a, c, g, or t
  misc_feature (179)..(179): n is a, c, g, or t
  misc_feature (200)..(200): n is a, c, g, or t
  misc_feature (212)..(212): n is a, c, g, or t
  misc_feature (230)..(230): n is a, c, g, or t
  misc_feature (245)..(245): n is a, c, g, or t
  misc_feature (268)..(268): n is a, c, g, or t
  misc_feature (281)..(281): n is a, c, g, or t
  misc_feature (286)..(286): n is a, c, g, or t
  misc_feature (293)..(293): n is a, c, g, or t
  misc_feature (304)..(304): n is a, c, g, or t
  misc_feature (313)..(313): n is a, c, g, or t
  misc_feature (361)..(361): n is a, c, g, or t
  misc_feature (363)..(363): n is a, c, g, or t
  misc_feature (394)..(394): n is a, c, g, or t
  misc_feature (400)..(400): n is a, c, g, or t
  misc_feature (410)..(410): n is a, c, g, or t
  misc_feature (412)..(412): n is a, c, g, or t
  misc_feature (420)..(420): n is a, c, g, or t
  misc_feature (442)..(442): n is a, c, g, or t
  misc_feature (470)..(470): n is a, c, g, or t
  misc_feature (478)..(478): n is a, c, g, or t
  misc_feature (484)..(484): n is a, c, g, or t
  misc_feature (489)..(489): n is a, c, g, or t
  misc_feature (512)..(512): n is a, c, g, or t
  misc_feature (518)..(518): n is a, c, g, or t
  misc_feature (528)..(528): n is a, c, g, or t
  misc_feature (531)..(531): n is a, c, g, or t
  misc_feature (553)..(553): n is a, c, g, or t
  misc_feature (563)..(563): n is a, c, g, or t
  misc_feature (570)..(570): n is a, c, g, or t
  misc_feature (582)..(582): n is a, c, g, or t
  misc_feature (596)..(596): n is a, c, g, or t
agggtttcccattgagcagggtgtcttgaccatggccgtgtccgctcgctatgagtaaggggccttcctgtttcagaccaaggagaactgagaaanaaagaaaaatccgttcgtgggtgccttgtggatgccaatctgagcgttctccacttggntattgtaaaaaaaggagagaaggntattcctgggctggctgatantacagggcctcnccgcctgggcccccaaanaggtagcagaatccnccaacttttccatctctctaaanaagatgatggccncccgnatgttgnaagaaagcccnttaataaanaagggaagaaacctagggcccaagccccccagattcagggtcttggtncnccccgggtcctgcagccccaacggcgggggnttgctnttaaaaagcngngggcccanaaaaataaagaaagggtgccgnatatggttaacttttggcccaaagaatnaagggggntaaggngaagngcccgggaccaattgggaaaagncgccgnctttcccctntgnggggttttacttttaagtttgnatcccggccnaaataanattttttggggnaccaataaataagntccggctctgga

SEQ ID NO: 617335 - DNA, 164 bp, Homo sapiens
tgtgtgaaaccgcatgtttgtggtcgaaactagaggaccccgagtaagagattttagaaacggaaggagaggatctcacgcacagtaggctatagtacactcatacccatgactgcacaaaaccacatctagactctatggaaactcctgggcacctatgtaca

SEQ ID NO: 617336 - DNA, 1155 bp, Homo sapiens
  misc_feature (1076)..(1076): n is a, c, g, or t
ctcaaaaaaaaaaaaaaaaaagaaagaatgaaaatattgcaggcaataaaataaaaattctctgtaggcctcgatattctcatctgaaaatggggacaaggaattttctcaggactgctttgagaagtgtacttcagccaggagttgggcagggggctggcttagttgtattggcattgtatacctctccaagactaacggctggcaatgcaggagctgtcatcagtgttggccctggaaatgccctgcgagctctttgtggtgcttaggatgagagggagctatctctgggcccaggatccagccctccacagaagaggggttgcagtgaggctgtctgtagcactaacaacttccagaggagcctgaggtcttggattgcatctctgaggttgggagtaggaagaggaaaatggtttttggtgtcctcatacttggtatgctcttggtattctctgactctgccacttaaaagatgtgtgaatttgaacttgtttaacatctctgtgcctcaatgtccttatttgtaaagtgggagggcacctatatcatagggtcattatgggaattaagtgaattgtaaagtacatggacaaatgctatgtaggtttcagcaaatactgctctgattctctgcttctctgccccttctcttcctctgttcagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacnagaaagtttggccgtctgcagacagaaaaggagactctgtttaatgacagcaggaacagattgcggaattacaacaggt

SEQ ID NO: 617337 - DNA, 161 bp, Homo sapiens
tgcttggtgccatggagaacacacgtgtaggtgcttctgggtagcactggtttgcattagataatgtttccctgccagagtttgtgtgggcggacgcatgtgcaccacagagtgcactcaagaggactttcagtcacaggatttcataattgtcatcgtca

SEQ ID NO: 617338 - DNA, 740 bp, Homo sapiens
  misc_feature (7)..(8): n is a, c, g, or t
  misc_feature (432)..(432): n is a, c, g, or t
agcgggnngtggggggaggaacatggcgcaagctctgtctgaggaggagtttcagcggatgcaggctcagctcctggaactccggacaaacaactaccagctttcagatgaactacgcaagaatggtgttggtgagccaggagggccttattagatgggggtggctttggggaatggtgtccgaggttttccctcagaggcctggcaggaaggcctttcagtttcttgccactggctgaggctgagtttccctgctttcccgacaccagaactcaccagtcttcgacagaaggtcgcctacttggataaggagttcagcaaagctcagaaggcactgagcaagagcaagaaagctcaggtaaggggatcccttgtgggtgagtgtgactgggagatgtcttggtgggctatttctgtatgctgatatttccntgtactggcctttctttctttgtgtgcctttacatctgctactacctcactgccatgtgttgctgtatctgtccttgtttccctgtatttgtcctaactctgtgtctctttccttctctctctttccattcttttctctgagtctctttctgtctctgtctgttttcctgttcctgtctctctgactcatttctcttcccaatcttctctttgtctctccccctcctgttcctgtctcggtgatttctcttttttctgctttctctctctaactccttgtttcttccaccccattctctctccctccc

SEQ ID NO: 617339 - DNA, 225 bp, Homo sapiens
attgagctcacctctgtgatttggctccctcgctggtagagggggggatagggtggctgacatcaggggtgggggtgggacaggaagtgagatgtatctagcacaggcacacaaagagtctcataaagggccggggccattatgctcacagcaggtctagcagcagtatggtcatggcggaagggcaatgggggatattacacggagtgcggatcaaaggctccc

SEQ ID NO: 617340 - DNA, 361 bp, Homo sapiens
tcaagggggatcaaccaattcatcatcaataatttaacagtggcatactaccatagcatgagttaacaaaggggaatgacgggcagagcagtgtcttgatgctattgcgatgggtgctcttgctaaaggagaaattttattaggaagagaagagaggagtgaatacagaccatgtggaattgccatgatgaagatggatggagggaagagaaaagcatcaaagaacagcgttcatgatattagtgatgatgatgataacttattgagcactttctacaaaaatcatagctgacactattgaacacttagtgtcagatattatgtaataaactttacatactaatgaggttaaacatcaaaa

SEQ ID NO: 617341 - DNA, 215 bp, Homo sapiens
ttttttttttcccttttggaatagggttttccccccccccccccccccaaaaaaccctttccctttttccggggaattaggggccggggcggccaaccccccctcccccgggtttttgggtttgggggggaatttttggcccgtcccccggtttatttttttccgggggccccccttggaatttaaccccccccggtttccttgggccccttgga

SEQ ID NO: 617342 - DNA, 884 bp, Homo sapiens
  misc_feature (706)..(706): n is a, c, g, or t
  misc_feature (866)..(866): n is a, c, g, or t
ggggagaaaacgcgccccacaagggggggaaaaaccacgggaacccgaacaaggcgctaacaaagtcccacaatgcgagtatcgagcgcaccttataaggaccacgtgcaccccaataactacggcatgggagccatacaggagagagggaatcctgacgaccacaagattgaggagtattcaagttcgatctatacagcgggaaaccacagagaagaggacacgacgcaaaggcccaggacggacacggggcagaagggggtatcgaccgtgccccatatagtgccgtgaaccgcatacgtgcgcgtcgtgaggcaagacaagaaatgggaataactggaagaggattgaaggatgtgcacgcggacgaatctggggagttcaggacactacggcgctttcacagatctcccaataccccatggaccaggtcttattttttgtggagaacttggagagttgtagcacactgtgttatttatattatcctcaaggtagtgaatgcaaggaaaacttagcttccagaaatgatgggtggtttctgggcctacaagactgagacatttagtggcgaccggtgggagacttctaattaatatcatgtatcttgagctggggagatttgaaaatttgtgagtcttcagatgtctggacaatatgtgggatgtgtgcacgtttgtgtctatttgaaaaactcgatgaagtnctcgtcagttcagtgccctctgtccccaggttacctgggaagtacgggtggtaggcagaagtgagcaggaccactggttctgtgccgcagcacgccaaacttaagaattctacagactagctctatacgtagtgaggacccagatttagagtaactgacnacgtgtctccgcatttgt

SEQ ID NO: 617343 - DNA, 112 bp, Homo sapiens
agtgacactaagtatttcgagctctgtaatgtcgcggtcgagatgtacgcgtatcgatggcgcagttggcaggcggcgcaatatgcatcctaggcctattaatattcgggag

SEQ ID NO: 617344 - DNA, 473 bp, Homo sapiens
cgactactactaaattcgcggacgtcgacccagcttagggagatcacaattggaggcagagaggcatgcaggcggggtctaggagacctgcttctccaggcctcttgcctttgagtctttgtgggatggaaagcctcacgaggggactgggaggagaatacccaggtcttaagggacccaaagtcaggatgttgtttgatcttctcaaacatctagttccctgcttgatgggaggatctaatgaaatacctgaaacatatattggcatttatcaatgggtcaaatcttcatttatctcttggcttaaacctgggctcctgagggtgcggcagagagcccaggccagggctctgttcttgccacacctggttgatcctcagatgtggagggaggtaggcaatgctacagtcttcattcaaacagctttcccgtttgccctgagagctcagaatcttccctttaagcccagaccc

SEQ ID NO: 617345 - DNA, 197 bp, Homo sapiens
agatcccccagccattttaggtgtaaaggcttttgcttttggttatttttacaaataatttatggcaatctggaaattgtcattactgctgcctggctttctggatggttcagagggcccctgaaatattcagaaaagaggtaaacaagatcacttgacatgtttagtcacatgagattgccaaaatgatgtccaat

SEQ ID NO: 617346 - DNA, 834 bp, Homo sapiens
acactaggataagaggactggggtggttacgctcatccagtcaagaccatccatgcagccacccagggaacccaggtcattgagggtacccccatcactgacatccccacgtggggccccagctccacgctgatgccaggccacatactcgactccctcagaccgccctctcagcacactgagacagcagtggtggtcaacatgcctgcccaggccactgtatgccagccctcagcccctggccgatgtccacactgcccggtgtggtggcaggtgtgcccgccacaggacccacctgcgtgtgggcaacagtgcacatggcaagtggccccatgcatgccatccacctgcctgccagcccagcctgtccatgacacatctccccagtggtgcccctgccaccaatgggccccccacaacctgactcgtgcccacgggctgcagatgctgctggaccattggcgtggggaagtatgagttacaccgaccctggggacaccaccagagaaatgtaagaaggaattagaaccagcaacgcagagcgaaagcagtttacagacctgaaaattgtgttagaaggcagagagtttgaagtccaccaaaatgttctagcttcctgcagccttgtattatcaaggacccttgattcaacaggtccgtgcaaagacagcgtgcacagctggcagggaagaagatgagagcatcggtccctgtagaaacctcaaggcagacgtcctgggagttgcatgctggaagtttgactacacaggggtcacctggtcatcgaattcggacaacgccaaacactgttggtggcggcaacagttcagatcc

SEQ ID NO: 617347 - DNA, 187 bp, Homo sapiens
gggaatgagatagcgttgttgatgagatatttggaggtggggatagtatagggggaaatagaaggatcaggtacgtgcggtcgggtaggcctagcgattgtgggggcgatgaatgaagcgaacagattttcgttcatgtgggttctctggccttttcgcaaggctatctcttccccgacgctatctt

SEQ ID NO: 617348 - DNA, 894 bp, Homo sapiens
ggtccagtaataagagtcaggtgtgggttatgctttcagagtcagacatggttaggtttatttaaaaactattagcaggttttcactgacaatgctttttaaaaataaaaaatgtaaatccatttttaaggcagatggtcattatgcatatacagttgaactatagttgggtccatataggaaccaatcaccaaaaatctggtaacagaattaggaaatcctttgagaagagggccttaatgaccttttatgtgaaaaaaatttgagagaattctgacattttttctgtctctctcacagggttgggtttcagataggagtaggtatgacgaccaagaagagagaaaattgtgggctgacctgtataggtggtaatagtggtgtccctaaagggaggaaatgatttcaaggtacccacagtgaacatgttcagctgaactgaagagtttatatgtatggttcaaacagagttgaaaacgggagattcctgaagtgttctttgctggtttaacaattattcgtatgcgtgttattaacaatacaggtgtgtcttttgctaacatagatgacggggggatttaaaatggttgggtaatcgacccccttttctaccatttacttggaggtacgcaaatgtgccccatataaattaccggatggacacttgatggcgcccaacgtcgccaactttacctttaacgttccctgcaccgttcattacgacatttgccccattacatgcgcgcccttttctgcatctcccactgtcaccggcccggataccgattcagcgggatcacgcgagtaaaaccccatgtgcagtttttctttccgccatcggtcccgctatagggtaggcccacagctgtctcacgcgaattatagggcccccga

SEQ ID NO: 617349 - DNA, 337 bp, Homo sapiens
agtagtgagtgtcaacattgcttgaaaactcctgagtccgagaatgaactcccatgcacccattttaattgtctaatccatgatgcaagggtacttcagagggaaaggctcgacacttttttgaagtctgaaactgaacgaaggacgtcatacatacgatgtgttggcccataggtccgacgatttaaggtagtttcattggatgggaggacggttggtgtgcatgaatcaagcggcggagcacactgctgactaatgtgtaatattggttacagtgttagaaacatttctgagtgggagacaggctattccatacaaagagggattggtagggtcc

SEQ ID NO: 617350 - DNA, 355 bp, Homo sapiens
ctcagcggggaaatatcgtgtgaagttaggccccatcggaggcagggccaaaagcgggaagaggatacagtcactctggaagtattagtgggtccagcagttccatcatgtgaagtaccctctgcggctctgagtggaacggtggtagagctacgatgtcaagacaaagaagggaatccagctccggaatacacatggttgaaggatggcgtccgatggctagaaaatcccagacttggctcccaaagcagcaacagctcatacacaatgaatacaaaaactggaactctgcaattgaatactgtttccaaactggagactggagaatgttcctgggaaccccgcttagagtcgc

SEQ ID NO: 617351 - DNA, 284 bp, Homo sapiens
  misc_feature (24)..(24): n is a, c, g, or t
  misc_feature (271)..(271): n is a, c, g, or t
gatccccttatgtttgctgagagntcatggaggatggggtcataataactgatttcttcagcactgaactatgggcttttttttttccctttttggagacagagtcttgctctgtcacccaggcgggagtatagtagcacgatctcagctcactgcaacctccacctcccaggttcaagtgattctcccgccttagcctccccagcggtgtgggaccacagacacccgccaccccgcctgcctaattttggtattttaagtagagacaggncctcaccatattg

SEQ ID NO: 617352 - DNA, 935 bp, Homo sapiens
tttaggttttaagttaaatggtaatgtgcattgggtgtttttgtttatgtttaggtttatttgtgtattagtttgctgtgtagattgtagttgtgggtagttttttggtagcctggttattcttggtatttgtgtgtatcttgtatcaatgtgttgggcattattgcaggttgaatttgttaattcggaatgcttcttccaagtagtctctatgatgattaagtttctgaaatttatctgagaccgattcaggtacttggtttggggaatttgatagttattgatgtgcatctgttaaatctgatgtacagactattactcagtcatgtccctcagtgaaccgttttttgattactagtatctaacattttgcctcctcttttttggttttgctggttataaaggtttggattggagagggctcactggattcccaattccttggagtctggatcattggattcaaatcataatgtggataggatagggaggtatgaattactcaggattcatggagctgggatcagattaaccaggaaacataggagtggattcctgccccaactcaaacggcattgcgtgtggatttttttattccacgttaatttggactatttccaaagattttttttttcctattatttgagcgattggagcccttaagatgcacgatggaattgtgttttgcgtttttatggtaaaacggagcaaagcgaggacctggagataaaacgctaggaagcaatactaccttggaaggattcaagcacgagtagaatggtaaacatttaaaggggaaagggaggggttatgtattaaaatagtaaatcagtaagtcaacttctaagtttaaagaaaacaaaaattggagttgaagtataggtaggttccaaattaggtaatcaccgggtcggtgaaaacagtataatctgcga

SEQ ID NO: 617353 - DNA, 224 bp, Homo sapiens
ttccccatatcagtcctggagcacatagctagtactcgcatctgtgattatcctcatctctcgtgcagtgtggtgcgatgagatgatcacgagataatttctacacggggttgtaccaatctaagattcgggtgtacgtgggcgtgataccgcctttaatccctggacgattcctgtataggcttccaggcagctcgcgctatcgctcattcagtataatccac

SEQ ID NO: 617354 - DNA, 280 bp, Homo sapiens
gctgagcccgtccgtccgccgccaccacccacttcgggacacagaacatccagtcatggataaaatgagctggttcagagggcaaactgcgagcagctgagcgatatgatgacatggcagcctgcatgaaggctgtaacttagcaaggagctgaattatccaatgaggagaggaatctctctcagttgcttataaaaatgttgtaggggcccgtagtccatcttggagggtcgtctcaagtattgacaaagacgaagctgcttagaaaaacagcagatgg

SEQ ID NO: 617355 - DNA, 938 bp, Homo sapiens
tggcattcaagagtgctgggattggccgggtgaggtggctcatgcctggcttcccaggtgctgggattacaggtgtgagccaccacacccagccttattttaattttttttttttttttttggaaacggaatctcactccagccggggcaacaaagcttgattgatcctgcctcaaaagaaataaaaataaaaataaattttttctaaaagatgagaagccagcgggggtggctcactttggtaaccccagcacttggggaggctgaggtgggcagatggcttatagcttaggagttcgagaccagccggggcaatatggtgaaaacccatctctacaaaaatttcaaaagttagccagacatgtgggcgtgggcctgtggtcctagctactgtggaaggctgaggcaggaatatggttggacccggggagattaaggttgcagtgagctgagattgtgccactgcactccagccggggtgacagagtgaaacccgttgtctccaaaaaacaaaaacaaaacaaaataaaacaaaacaaaaacagtttccattaagaaccaataagggaacagggcgaacaccaaacctcaatagtctcaaatctacttcaaaaggtcacatttagaaaacttcttttaatactctataataatggaactcccaatattaacatatctgggcatccttatatgctttactggtggtgacttaaacatcggaacataaaaatcttctcttctcctctggaaagttggggaaaccccctgaaggatggggctaactaagctaacaactttttttatttttggggagaaaaggcactctccttcttgttgcgcccaggttggatgtcaaggggtaactaacccttgggcccccaggaacattccagcctcggggttcacgagatctccacatggcccagccccctaaaagg

SEQ ID NO: 617356 - DNA, 736 bp, Homo sapiens
  misc_feature (642)..(642): n is a, c, g, or t
gcgcttccttccgctcggctgttttcctgcgctggagccggagggccgttgtcggccatggcgcccaggcgtgttggcatggtcttggagccccatttccacagggactggcagcggctgcgtggccacgtgggttcaacacagtgcggccctgtaagagtccgtcagacggtaaggcctggacaaagccataggtcgcgccgcattcggccctgggccacgggtcggtgttccactgcggtccagtcgtgcgtctgtcccacggttcgtgtatcacactgaagagtgctgcgctcggagcagcgggttcagcgctggaggagctcagggtggccggcattcacaagaaggtggcccgggaccatcggcagtttctgtggatccgaggaggcggaacaagtccacggagtccctgcaggccaacgtgcagcggctgaaggagtaccgctccaaactcatcctcttccccaggaagccctcggtccccaagaagggagacagttctgctgaagaactgatagactggccacccagtctgaccggaccggtcatgcccgtccggaacgtctataagaaggagaaagctcgagtcatcactgaggaagagaagaatttcaaagccttcggtagtctccgtatggnccgtgccaacgcccggctcttcggcatacgggcaaaaagagccaaggaagccgcagaacaggatgttgaccaagaaaaaattaaaagcctcctg

SEQ ID NO: 617357 - DNA, 109 bp, Homo sapiens
ggagggcctgttgcaggggcagggcgggcccgttcctttggcagctcctggagagctgtggacatgcagtcccccgaagttcgtgctgcaataaaggccatcttctctt

SEQ ID NO: 617358 - DNA, 181 bp, Homo sapiens
  misc_feature (50)..(50): n is a, c, g, or t
  misc_feature (103)..(103): n is a, c, g, or t
  misc_feature (132)..(132): n is a, c, g, or t
  misc_feature (155)..(155): n is a, c, g, or t
  misc_feature (169)..(169): n is a, c, g, or t
agatcacatgtcagaggtgacacaggtagattgaccaggtctagaggttnttctttcaggtctcttcctgtccattctgtgactaagctgtgagaggtgacanaggaagttatattgatatcatcttatagnttctctaaaagttctggatgtgncttcaaaaaatagngcttggttaggc

SEQ ID NO: 617359 - DNA, 932 bp, Homo sapiens
cgcaaggatgtgcctgacacccggggcccaaggcgttggccccagggactcttcctgtttcataaagggaaaggataatttgcacttgacgcattccaactttaggtatgaggatagagaaggatctgctcccgccatttggcccacaggagcagaaggcagacctgggatgccccagtttctcttcagggatggatagtgacctgtcttcgatcttgcacaggtaagagagtagttagctaacctatgggaattatactgtgggccttgtgagctgcttctaagaggctaacctggaatactaagctcagaggtcaaggtcaatataagcacttcagcggcttgctccgccaagtgggcctgatttagcagggtcggtcctgctgcggagcgtgccaggtccagcaccttcctgctagggcacatcgggggtctagggtcgactagcccctaactcttataagcaatcaaagaaccattagaaagggctcattaagccttttggacacaggaccccagagcagtgaaaaagctgacttgcgcctaaggtcgtaagcaagctaacttcgtgcatgggcaaatgtagcccagcgttcactcgcaacggcagtcggcacactatttacttgcctagcttgccatcgtgctagtctgagccatgccataccagacagggtcctctcaacctgtgatgctcacactcaagaggcattggcagctcagagaccagtagagcttcactttcctagaacccttccactgcccaatgtggagacgcgttagtggggctttctatggagccatcctagaccgtatgtggggacactagacctcaggtggtctcttggcgttagtgatgctaggtcgaagagaatattagctggtttctatcttttctataaaggcatttgctcacatacctgcttggataa

SEQ ID NO: 617360 - DNA, 108 bp, Homo sapiens
ctcaaatggcaccaaggaggatgtggacgtgctgaagacaaggatggaggagatgaaggctgagagcgaagcgggaaaagaaaacaaatgaaacccaaggcatgcaga

SEQ ID NO: 617361 - DNA, 358 bp, Homo sapiens
gtcgacctggaatctccagttttccttcagggaactccccaatggagtgaggacctcccacatggttcaacctggtaagagctgccactggtttctaacaatttttgagagtgctgtgtgggaggagacaaagcatgcaacaagtcaggacctctgggttccttgctctgccttcaggaccactggctgctcggctgacaggtaaacctggagccagccagctgaattgacattctcacagtgcatgaaggtgctctaaagtctgctgtttcttctcagttttcttggtaatgactagaactccattggatctttgatccaggggcttctgagtctgtgaagaagagtacgtcgacgc

SEQ ID NO: 617362 - DNA, 301 bp, Homo sapiens
tccacacaacatatagatcatttattttccttttagtcccgggttcagtacatagatggcttttctttaccctttgggttgacaattttctccaggttgctgctgatgatatgataaagctcagcataaaaggccctcaggtccatcaccatggccctgagctccccataagctgccttatcttgctcatgcaccaaggcccggtaatccattacatgagtctccttggaggccttggccacaacatccccacgttctgagaagtacttggaaatggttgtctggaaagcttccactttgg

SEQ ID NO: 617363 - DNA, 402 bp, Homo sapiens
ctcgatagtattgaaccaaggggtatcttatcatattctttatatctaaccaaattccataaactagggaagatctaatccacatacaactattgagggttcaaccattttcaaaaaatttagagcctgtcgattgtcatcaaccctcaacctttcaataaaaaacatgttggttactgacacattgttcctctatccatgagtcctcctcaatctgcatcttgtcaatctagaaagttctaagcatatagttggatagacttatcaaccactcagtcaataatataatcgatcaatcgactaataatctccagaagatcgagagatttgatgaacaaaaaaatacatagttttaaacatgattaacccttagtaagtgtgggatcacatggccactcaata

SEQ ID NO: 617364 - DNA, 335 bp, Homo sapiens
  misc_feature (177)..(177): n is a, c, g, or t
  misc_feature (219)..(219): n is a, c, g, or t
  misc_feature (233)..(233): n is a, c, g, or t
  misc_feature (243)..(243): n is a, c, g, or t
  misc_feature (262)..(262): n is a, c, g, or t
  misc_feature (269)..(269): n is a, c, g, or t
  misc_feature (290)..(290): n is a, c, g, or t
  misc_feature (294)..(294): n is a, c, g, or t
  misc_feature (310)..(310): n is a, c, g, or t
  misc_feature (323)..(323): n is a, c, g, or t
atgacacgcctcaccaaagctatgataaccttaattacaccctgagcattttgggaggttgaggtgtgcggattacttgaggtcaggagtttgagaccagcctggccaacaaggtaaaacaccatttctagttaaaatacaaaaattagccaggtgtggtggcacatgcctgtaagncagctacttgggaggctgagacaggagaatcgcttgaacccnggaggcagagattncagtgagctnagatcgcaccactgtactncagcctnggcaacaaagcgagagtctgncttnaaaaaaaccacccttntttcaggagtgangttgggttatcc

SEQ ID NO: 617365 - DNA, 814 bp, Homo sapiens
aaatcaaaaacaataagcgccggtaatggggggatctggcaaatggaggaggccccagctcctctatggtacacgggtcttattgggcagtgaccttgctccgggaaacaataattattccttcagccctgggggaattggatgtgttggatgaccccgggtggcatttcagtgtgggctctcattaatctcacccgtggcaggtttcatgtgcctcaccagccctccttcattgtggtagagagacaggtggggactctcccggccgaggatgtgtccacctgtggccctttgaggacggacacctgtgaactttctcccttctccaaactctcgctcttccgtgggaacttgtggcggaaattgcaaggtggcgggcacaaaattctcacaacctcgagggctgtggtgccaaaaaagcggggtttatacaccagagcttccaggcaaaatattctcaaccccagaggccttgtgttggtgaatatgagggcgccacttctccgcgcgcctcacagtggggggaagaggcctctcgaagtgtctcataaaatgtggagccatgtgggtataaaaggaagtggggtgccccagaggcagggggggctcctcaggtgaagatttacccctcgggagaccatctcattctccccacagtaaaacgcggggatttctccacacagattggtacaaaatacggggccccaacgagccaaatttgtttttggccccagggagaacattcggtccccagggtcaccatagaaagagggcctccaaagagagggctcctcaggaggggggtgggggcccc

SEQ ID NO: 617366 - DNA, 606 bp, Homo sapiens
  misc_feature (327)..(327): n is a, c, g, or t
agcggggaacactcactttaaaataataaaatatcgaataggtaaagttcacatattttaaagttatgctccataggggcctaaattctattttggcctgattttttagtttccttcacttttttttgggagacagggtgtggctctctggcccaggcgggagtacagcggcatgatcacagctcacggcagcctcaacctccggggctcaagagatccacccaactcagcatctggtgtagcggggactacaggtgggcgccaccatgccgggataattaaaaaacggcttggtatagatgggtctcactatgtggcccaggcggntctagaactccggggctcaagccatcctcccacctcggcctcccgaagtgctagaattataggtgtaagccatcaggtatttttcacttttaaaaacggaaatttacggaggtacagtttacacacaagaggcacccattttacagggacagttttaaacagttcaacacacacatacactggggtaaggaccagtcacaatcaatataaagaatatccgtcaccccagaaagtttcttcatacatttgtgcgattagtaacaccccctttaggcttgg

SEQ ID NO: 617367 - DNA, 707 bp, Homo sapiens
tgagccccccccccccccccccccctcaagaagccgtcgcacccaacgtccttttctttattactttatatttctcttcatttaagataccctctcagggagcaggggttccgtttggtttccttctccaaggtagacggcgcggaggcaatactaaatgtaaggtatcggtttagggtgtaggggcgcgggtagggtaggaggtcgggtcggtcttcagctaccggaagcgaagtaggcgggtagcccgggtcggccttagttccttagcgtaacgtttgaggatgagagcggctttagaaagaaatcggtagttttatcggttaatcgtagtttcagttcacgttttattacttcctcttaggggttagctggttctagtagggattagaaaaagttatagtttagggagtaggcacggttccttcaagttataactctaaaagctctcgcttcctacgaccttccaaagggaggtagggacctcttttgattttttagaaggcctcttatgggtcttacctctttacgcgttaaatctgcgtctctggggaacgtagagtttatcaggcagatttcgtagtcttagcgttgcggcccggattgctataattcggagtgtgggtctagcggttcggctcctcgggttttgttgcattccttttaatttcgggtccattctttcaaatagatctcggagcctaaga

SEQ ID NO: 617368 - DNA, 273 bp, Homo sapiens
gtccgtcaaaggcatcagagttagggtcgcgtgtctgggagacttttctgtctagctaaaggattgtaaatgcaccaatcagcactctgtgtctagctcaaggtttgtaaaggcaccagtcactgctctgtgtctagctaatctggtggggacttggagaacttttgtgcctagctggaggattgtaaatgcaccaatcggcactctgtgtctaactcaaggtttgtaaatgcaccaatcagcactctgtgtctaactcaggatgcttcttga

SEQ ID NO: 617369 - DNA, 475 bp, Homo sapiens
agcttcttcaccatattaaaaaatcgccggaggggacaaccgagccgttctggaccacaactcctagattgggccgcctcctgaggcgtcatttaacccgggagtctactcaacccacggcccgtccaaacttcgagactccgaatctcacacattgaccggccctcgtcctccggagccatccccaccgccctcacttctatcatacgcccctcatacaacaccagcatttcactgttcggcttccaacacacccactaaccttctcctcgaccttccaccctcttaccatcccttttaaaacgaacaaaactcccctctgcaacctcccctataccacacctatccttctctccccactcccttgtcacctctaaccacaaccccatcgcatcatacatccacacactcctcggctactctccctcctctccacacctctacttccccttcgccactaccactctgattctag

SEQ ID NO: 617370 - DNA, 1064 bp, Homo sapiens
tagccgggagaagggcctctccattctttattcaggtcccaataagtgtgtaaaggggcaaggggtgaggggggcgaggggcctcttagggtggagggaccgctggctaagctggaagggcgagcagttcagccaggtggcgtccaagatggcccaccggtgggcacaggggggttcacccctgtgcgaggggtggaggagagggcaccaacgccgggggggcaggagagggcacagagagggctgtggacgcactgtggagggcggtggaggagagggcggggtgtggtggcaacaagaaagcaagcctccgtgcaggccgggggataggggtgggtggaccgcctgccacagggggatcttctagtgggacattaaataacatcggggctctggcagagcactctcacaaggggggaggccgccaggggacagcgccagtgtggcaggtggggcgcagggtgtccggagaggcgcagattgtgtgtgtggaacaagtgtccacagagatggggcgtgggacccaaagagaagcagggctggtgccccaagatgggacagaggcgccatcttggtgcagaggatctctttggggggagcggccaggggcgcaaagcaacaacgagcaacacatgcgggagataaactccaattcttggagggccacacgcatgttatcttcacaagcaaaagaaactgtgcctggccggcaagggggtcatccccagaatagcgtgtgcccccgcatgggggcggtcccacggaccctatagaggggttcttgggaagtcaccggaaggggggcaaccctttcatcaaaacaaagagaggggggggctccaaggggccccgagaatcaagagcagggaaatcacggggctaacccgggcggccccacattattttccccgagggaccacaactctgtagaaaccctagaaaggaatcacgccgccgaaagatgggacagcgggggagatctccgcaccggagaggagtcccacccgtaaaaaggtgcgctaggtggggaggaacgccacacaaccccgggggggggctaagaa

SEQ ID NO: 617371 - DNA, 136 bp, Homo sapiens
tgtctacctccacaaaatagtgacatcaccatctaacactacacccccccacatcatacacgctacaccccacatacaccatactcactactctacaccatgcttcactacataccacacaccacacacactagat

SEQ ID NO: 617372 - DNA, 219 bp, Homo sapiens
gggggaattttttttttcccccccccccccgggggacagttttaaataaaaataaccccgggggttttttcccccaacccggggggggttttccctggtcccccaggcgggggcggggtgtggggggttcccttccccttttttaaagggggcccccaccccccccttttttttttttttttggccccccccccccaaaaaaaaattttgggcccccca

SEQ ID NO: 617373 - DNA, 670 bp, Homo sapiens
cccgcgcctgggcctcgccgagccctgacatgctgaggaaagcagaggagtacttgcgcctgtccctgggtgaatgtgtgtctggcctctcctgcacgcaccactggagaccagcagtgcagtcatgtgcctggaccttgcagcttcctgtgatgaagtgccccttggacagggcttatttaattaaactttcttggtttgaacaatggagacatctcatgagctgtcttaaatctttttgagtgtttacttgggcctgaattcaaatatttgggcctaagagacctagctgtacagtttagcttgtactagaagcagttgaacatggcttcaaatgatactaaaaatgctatgagtccagtcttccccagacacagcaagtggatcttgacttatccatggccacttatcacttctgctgcacttgctttcagcatgcaagattctaaagctgaaagtggataaaaacaaaatggtagccacatcctggtgtaacaaccaatgctatatttggatcgacttgtgtaaacacctacagcagattggacatgcaggtcgacagagaacctggagatgttgctactccaccacggacagagaaacgacagatagcgtgttgaagccccagcaacggacaatggagacggtagaggagatgccgccataaacc

SEQ ID NO: 617374 - DNA, 691 bp, Homo sapiens
gcgggcctgggctgcatgggctggcctcttctggcgctccgcgctgcggtggtgctgcgctgcgtgccctgtgggccccgtggcccgagcctgctagtgctgccactggctcgtggagtggccctcctgtgaccctggtgagctggaccctgtgtggctgtgtgaatgccctgactgtgctgtagacaactgtgctgtgcatctgtctgttgtgactgttgatccatgctgcttttgatgagtgctgtgtggcttcactgcttggtcgggtgattgaatgattgcttgcatgtgcaccagatgagctgtccttgcctgagcactaccatgtgacctgctggagtgaagcccttctaccctgccctcaatcctgctacattgagctctgtggcctgtggttggccatggtcttgggaaggggtacaattgtcagtcctgcgcctcgatgtggccattgattggaccacacctgactctggctgatggcttgccccaggaaccataagggggtgacttcagcgttccacatcatgcatggaattgtcatccacgccagcgactccgttggagggggccagctgggagatccatgctgtggttccagagcatgtgagctgttgagctgggcagacgggggccagcacagcagcatcacccaaccttgaggctcaagctgccttaccaccccatc

SEQ ID NO: 617375 - DNA, 1174 bp, Homo sapiens
gtgctgggtagatccgaggaaggctgaatgtgaccccgaggcgtgtaaccctgaaattcaggacgccacactgttgagaaactgtcaggcaccagacagtgacggcaacaacgaacgagcgcttgagtgcgagcagtctgataagtagcagaacctggaaccaaacctccctccatcgacggaagctacgaacgaacaaagtggtcgacccactggaacaccacgcagctgggacaagggccagcatgggcctgcacgagtcactcagagtaacacctcacactttaagacgcatgactccagagggtacaggttccatgtgaccatttatccagggtttacaaacaggcaaaacaaaaccagaggtggactctgactggagccatatgccctgaaagtctaaaggaagcatcaggttttcaagagtgggctgctctgggagtggagggaacggaggcacgaagggaccccggggatctcatctgcagctggagagatgccagctggaacaggccaactggcttggctgttgcggggagccaggctatgctctggagtctttgccggtgtaactcatttcagcagcggccggggaggaggcatcactgctgccatccccattgcacagaggggcgcctcgaagcatggggaggcatcatgctgggtaggcattgtcccgagacttcaggtccaccaagactcagcacgattgactccttggaaaagtggggtctatgaagatggtaattatgaccagatgaggtcacatgctgggataaggtggtccccattccaagacacgggtgtcctccgtagaaagccggttgaaagacccagaaaaggtccatgaggccgaggcctgcgacccacagggatgaagacagaggatcgcagatgggacagggagcaggaaccccggcgatgtggtagtgcgaaacaatgtaaaaatagccgaaaatattcaaccaatgtccaaaaaaagagcgcactgtgtaaccggatacgtaagagatataacaggaaaacattatgagtatagttatgaatacaaatgtggaagagcacacacatgtggtagaaaaaacaataacaccactaactatgacacacgtcgactcaactaacatatgtgataagtctagctcatcgctgcgtgttggttaggtgcatggat

SEQ ID NO: 617376 - DNA, 837 bp, Homo sapiens
  misc_feature (837)..(837): n is a, c, g, or t
agaagagctaactatcctaaatatatatgcacccaatacaggagcatccagattcataaagcaagtccttagagacctagaaagagacttagactcccacacaataataatgggagactttaacaaccccctgtcaattttagacagatcaacgagacagaaggttaacaaggatatccaggacttgaactcagctctgcaccaagcagacctaatagacatctacagaactctccacccaaatcaacagaatctacattcttctcagcaccacatcgcacttactccaaaatgaccacttagttggaagtaaagcactcctcagcaaatgtaaaagaacagaaattacaacaaactgtctcacagaccacagcgcaatcaaattagaactcatgactaagaaactcactgaaaaccgacaactacatggaaaccgaacaacctgctcctgaatgactactgggtaaataacgaaattaaggctgaaacaaagatgttctttgaaaccaagagaacaagacacaatgtaccagaatctctgggacacttttaaagcagcatgtgagggaaatttatagcactacatgccgaagagaagcagggaagtctaaaatcgaacctaaatcaccattagagactagagaagagacaaaaccttaaagtagcgaagaaagaataattagatctgaggatgggagaatgggaggaaaaaactggaaaatttggcccgagggtgtcgaagaatacacatgtgaccgggcgataaaaaggggggacattgtgaaggagggttccggcccaaaaggggaagattagaaaaaagaatgtgccaaaagn

SEQ ID NO: 617377 - DNA, 357 bp, Homo sapiens
atctattctatttccccaacaccaccttttttcttagttcgaacacacctcaggactaggccagtgcaccgaaacgcatccgctaccatggcggaggtcgctttgggatcatggagaggggggattgccattattttgtgaacttggtggaagggcccccacctccacctgagccaccaaagacgggagttgcccatgccaaagagtatattcagcaggttcgcaggcggaccatcgttcacactctatgatgaggagattcacactccacagggggtgtatttcgccatttattttgtaaaaataaacacacattgaagggcaccaaaaaaagacacctggcctccgtgggctaat

SEQ ID NO: 617378 - DNA, 95 bp, Homo sapiens
gttcacatgcactgtgtgtatgagaatagatggtctgttgttcagacaaaagtaaaacatttttttcaaattgttacattgaaaggttttctggg

SEQ ID NO: 617379 - DNA, 492 bp, Homo sapiens
  misc_feature (26)..(26): n is a, c, g, or t
cttcaagttgggaagccctggtgccnattgcccccaccttcaccagcttgggcagcagcaagactatttattaaaaactttaagatgggccaggtcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatcttttaaaaaaaacaagacgggccggcacggtggctcacgcctgtaatcccagcactgagaggccgatcacttgaggtcaggagttcaagaccagcctggccaacatggtgaaaccccatctctact

SEQ ID NO: 617380 - DNA, 462 bp, Homo sapiens
gaggtgacctagagttaccgcgcgttgttgttacactcaggcaaacacctgtgtcacaataacagcctaatacatacacttattagggccaggcactgttctgagtgctgtacatgtataaagcctcctaacaactcatgtaatcctcctaatagccctgtaaggtggatactattattatctccaacttacagataagggcactgaggcacagagaggttaagaatgcaccccatggctgggtgcagtggctcacacctgtaatcccagcactttgggaggccgaagtgggcagataacttgagcccaggagttggagaccagcctagacaacatggcaaaattttgtctctacaaaagacccaaaacttagccaggcttggtggtgtgcgccttagcctccccagtgactgggactaccggtgcatgccaccatacttggataacttaaaaattcttttg

SEQ ID NO: 617381 - DNA, 560 bp, Homo sapiens
ctatcattttggaagaggaattaatgcaaaacacatttgtatttttttttatttttgcatattctcgattatctatacatatttttaaactggatcataaaaggtataaaaagtaattgatccatacaacatttttaaatatttacccctctattttcagaatatttactaaaatatcagttatcaaagagtagggaaaagttaactacaagtttgtttttcctctttttatgtatcttttgagctttgtaattaggcagtacatctctatgttttcagggaaacctatttcattcgccattttgatgatttaggcatacgccaatgctaacgccgtttcttgtaatttctattttttcaaatggagtactttaccttcctcccgcagctgaaactttcaacccgccggaagaaaagaccaaataatattataattaatatttaaaacccttgaaagatcatctcttaaaataacctcaaatagtgtaaatccaagcacttgaaaactttgccgttttagaactcgttaaatcctttaagaaggacataacagccagagt

SEQ ID NO: 617382 - DNA, 117 bp, Homo sapiens
  misc_feature (62)..(62): n is a, c, g, or t
  misc_feature (97)..(97): n is a, c, g, or t
  misc_feature (112)..(112): n is a, c, g, or t
agtaggaccccagagctgttggattgaagaagagagacaaaaagaacaaaactaagaagctnaagcagcagcagcagcagcacctgccgcagcagcnacagttgcaactccncagcc

SEQ ID NO: 617383 - DNA, 698 bp, Homo sapiens
  misc_feature (8)..(8): n is a, c, g, or t
  misc_feature (71)..(71): n is a, c, g, or t
  misc_feature (98)..(98): n is a, c, g, or t
  misc_feature (119)..(119): n is a, c, g, or t
  misc_feature (140)..(142): n is a, c, g, or t
  misc_feature (156)..(156): n is a, c, g, or t
  misc_feature (158)..(158): n is a, c, g, or t
  misc_feature (165)..(168): n is a, c, g, or t
  misc_feature (181)..(181): n is a, c, g, or t
  misc_feature (185)..(185): n is a, c, g, or t
  misc_feature (189)..(189): n is a, c, g, or t
  misc_feature (198)..(199): n is a, c, g, or t
  misc_feature (205)..(205): n is a, c, g, or t
  misc_feature (208)..(208): n is a, c, g, or t
  misc_feature (251)..(251): n is a, c, g, or t
  misc_feature (274)..(274): n is a, c, g, or t
  misc_feature (300)..(300): n is a, c, g, or t
  misc_feature (331)..(331): n is a, c, g, or t
  misc_feature (334)..(335): n is a, c, g, or t
  misc_feature (337)..(337): n is a, c, g, or t
  misc_feature (339)..(339): n is a, c, g, or t
  misc_feature (349)..(349): n is a, c, g, or t
  misc_feature (382)..(385): n is a, c, g, or t
  misc_feature (395)..(397): n is a, c, g, or t
  misc_feature (445)..(445): n is a, c, g, or t
  misc_feature (520)..(520): n is a, c, g, or t
  misc_feature (588)..(588): n is a, c, g, or t
  misc_feature (612)..(612): n is a, c, g, or t
  misc_feature (696)..(696): n is a, c, g, or t
tttgtttntgtaaaaagtcccggttcttccataacttataaacatgatttataccgaggagatgggaaagnggacggggcaggtgtggactgaccggngatggggaagctcctctcgangccccctcggggcgaacccannncctttggaggatgnanacgccannnnactcctccctgangttntctngccgcctcnncccctngcnctcagaatcctgcgtgcccctcaattccggaatccctcccggnaccccaggcccactgggcatgcngcccctgctactcagaatcccgaagngccattcagttccagaatcccctcctcagcngcnngngngggggggtcnatcctttccaatgtccccccccgacccccaagnnnnaagggaaggnnngggggctcaggtctcccctctgtggcagggggaggtggaggtggaggnggaatcggaagggcgtggaaggcgggggccaggagggctcagccgatggtgaggccaaaaccacactgaaacttnttcttgcggtgattcaagaaagccccaagggccagtgtcaggggcaggggtgggagcttcttctccancgtggcacccacgatccagttgcnatccacagagcctttgaagaggaggttggccttgggcaggtccagctggtacccgaagaagacgctggtgtcctgcatccttgngc

SEQ ID NO: 617384 - DNA, 1602 bp, Homo sapiens
  misc_feature (280)..(280): n is a, c, g, or t
  misc_feature (782)..(782): n is a, c, g, or t
  misc_feature (786)..(786): n is a, c, g, or t
  misc_feature (791)..(791): n is a, c, g, or t
  misc_feature (795)..(797): n is a, c, g, or t
  misc_feature (805)..(805): n is a, c, g, or t
  misc_feature (825)..(826): n is a, c, g, or t
  misc_feature (830)..(831): n is a, c, g, or t
  misc_feature (833)..(833): n is a, c, g, or t
  misc_feature (851)..(851): n is a, c, g, or t
  misc_feature (869)..(870): n is a, c, g, or t
  misc_feature (876)..(876): n is a, c, g, or t
  misc_feature (883)..(883): n is a, c, g, or t
  misc_feature (904)..(904): n is a, c, g, or t
  misc_feature (1240)..(1240): n is a, c, g, or t
cggacgcgtgggcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactgggtacaagacaaaaggagatcctgctganaggggcccgactggatcctgggcgagatcaagacatcgggtttgaggggccgtggaggcgctgggcttccccactgtggcctcaagtggagcttcatgaataagccctcagatggcaggcccatagtatctggtggtgaacgcagacgaggtgggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgatttgtgacgtgtttgtggtgcgcggggctggggcctacatcttgtggagcaggagacagcgctcatcgagtccatttgaggtgcaagcagggcaagccccgcctgaagccccccttccccgcagacgtgggangtgntttgngctnnncccacaantgtggccaacgtggagacanntgtnnangtgtcccccacaatctgncgccgtggaggtacctgnntttgcntggcttntggcagagaacgcaactcagngcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggttgatcgtcatggacccgtcgacggacatcgtgaaacgcatccgcccgctcattgagttctataagcacgagaagctgtggcagtgtacnccatgccgtgagggtgtggacttggatgaacaagggtgatggcacgtaccgagaggggggatgcccggacggcgagactcgaatcactgtgggaagaatcaccaaggccagaatcagaaaggccatacagactagggctccgggtggacggagccgctcggcctgtgcaggggcaggatccggcacttcggccggagccaagaccgagagccacaggtaggccacaagattaggcccggcagatggcctatagcacacacctgacagagcgcaagggcacacccctggacaggggggaacacaacaacaaagagaggcaccccccagaaaaacaaacacacacaacgacagcacaaacggag

SEQ ID NO: 617385 - DNA, 1772 bp, Homo sapiens
  misc_feature (450)..(450): n is a, c, g, or t
  misc_feature (952)..(952): n is a, c, g, or t
  misc_feature (956)..(956): n is a, c, g, or t
  misc_feature (961)..(961): n is a, c, g, or t
  misc_feature (965)..(967): n is a, c, g, or t
  misc_feature (975)..(975): n is a, c, g, or t
  misc_feature (995)..(996): n is a, c, g, or t
  misc_feature (1000)..(1001): n is a, c, g, or t
  misc_feature (1003)..(1003): n is a, c, g, or t
  misc_feature (1021)..(1021): n is a, c, g, or t
  misc_feature (1039)..(1040): n is a, c, g, or t
  misc_feature (1046)..(1046): n is a, c, g, or t
  misc_feature (1053)..(1053): n is a, c, g, or t
  misc_feature (1074)..(1074): n is a, c, g, or t
  misc_feature (1410)..(1410): n is a, c, g, or t
ggtgcctgtaatcccagctatccagaggctgaggcacaagaattatttgaacctgggaggtggagttgcagtgagctgagattacgccactgcactccagcctaggcaaaagagcaagagtctgtctcaaaaaaaaaaaaaaggcttactaaggggcaggggtatctatgatggctatagatggttcccttagccctagcccagcccctcctaaataggggagacccaagattctgtagcttctgggcccaatccctcatgggccccagagcactctggggcctccttgaccctttggtctcccttagacagcacccaagaaaacctcatttggctcgctgaaggatgaagaccggattttcaccaacctgtacggccgccatgactggaggctgaaaggttccctgagtcgaggtgactgggtacaagacaaaaggagatcctgctganaggggcccgactggatcctgggcgagatcaagacatcgggtttgaggggccgtggaggcgctgggcttccccactgtggcctcaagtggagcttcatgaataagccctcagatggcaggcccatagtatctggtggtgaacgcagacgaggtgggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgatttgtgacgtgtttgtggtgcgcggggctggggcctacatcttgtggagcaggagacagcgctcatcgagtccatttgaggtgcaagcagggcaagccccgcctgaagccccccttccccgcagacgtgggangtgntttgngctnnncccacaantgtggccaacgtggagacanntgtnnangtgtcccccacaatctgncgccgtggaggtacctgnntttgcntggcttntggcagagaacgcaactcagngcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggttgatcgtcatggacccgtcgacggacatcgtgaaacgcatccgcccgctcattgagttctataagcacgagaagctgtggcagtgtacnccatgccgtgagggtgtggacttggatgaacaagggtgatggcacgtaccgagaggggggatgcccggacggcgagactcgaatcactgtgggaagaatcaccaaggccagaatcagaaaggccatacagactagggctccgggtggacggagccgctcggcctgtgcaggggcaggatccggcacttcggccggagccaagaccgagagccacaggtaggccacaagattaggcccggcagatggcctatagcacacacctgacagagcgcaagggcacacccctggacaggggggaacacaacaacaaagagaggcaccccccagaaaaacaaacacacacaacgacagcacaaacggag

SEQ ID NO: 617386 - DNA, 257 bp, Homo sapiens
acgatgagtgataggtgatatagcgactgctagtgatcttgccggattgattttggagtcattgagcgtcggctgaagtcgtgctcaggtgaaggcgatttggggctgagacaatggggttttctaaagtatacactcatgtcatctgcaaagtagggaccattttgaccttcctcttttcctacacgtgacagtacccgtttacgtttctatctcttgacctgacttgacctggccagacaccttccaaccactat

SEQ ID NO: 617387 - DNA, 109 bp, Homo sapiens
agttcttcttagtctctgtctttatttgtcaatctcggaatatttgagtctctctctgagtctcatttgttaaaatgctcttttagaaggggaaacggtcaccaatata

SEQ ID NO: 617388 - DNA, 1192 bp, Homo sapiens
  misc_feature (222)..(222): n is a, c, g, or t
  misc_feature (559)..(559): n is a, c, g, or t
  misc_feature (727)..(727): n is a, c, g, or t
ggcgtgagatgggtgtctgcagcttgtgtgtgcttgtgaactgaatgaacgatatcccgggttgtcacgtcttgcaccggagagagttcgtgtgccgtcctgtgtcccgtgtaggaccgatgcaggcgcatgtcatgtggattacctagtgattcggtgagcacgtgtgccacacgctgctcggggcggccaacagtgcgtgttaagtggagctcgtcctgnccatactctactatagtgatctgtctgtgcccggcaagggacaggtatatgagtacagatccgaaaaatgcggtgctctgtccctcgcatagtaggaatcgggcgggtcagcggagtacaaaacctcgagactgagaagtagcttggactttggttcaaatcaagtctttgtgacctcgcttggagtgctcgtaattccgtgtgcttcggtcgtgccataggtcgtactgattagcacggcgagtattaccccatcgaagtttcgtcgcgttacccacgcggttttaatggttgcaagaggcagtgaagtagttcatgtgcgcgctatcctcgttgnacttgcgagagggagcgaagctgagagagattactgagaggcggggcaacgaagctagtgacaggggtggcaggactaggtactcaactaggatgcgaacgtgagtgccctccggtttgaaggcgggaccgtgatcggttggctacgctaggtagcttatctaagggncagcccttcgcgtaatgagggccctacgctttggcaagggcatgcaacgagatagaccatgagtcggcagtcgagttgtggttgattcacattgagactcagtcgcaagacccgttgtggagtttcggtctcaagttcttcaagaaggacgcgcgcttcagactcttggcgtccacgcgaaagattatggtgtgtgcacacagcaacaattcgatccgcggggtagtgccttttagataactttgttccagaggaacggccacggccaggtgtgggtctaaagggccccccatagtcgtggccatcactaatttttagacgggctgcccacgagatgtgcaccagttcaccgcatttacgtagttacaactcgagagtgtttcgcgaatacaaaattgtggcgcttaggataacagtacctttatacaggtcgcaatcatataatagttccacgtaatggcccaa

SEQ ID NO: 617389 - DNA, 171 bp, Homo sapiens
atttgtggttgttgagtatagtcaacgatttacgaacataggtaaaatggctgagtaagcattagactgtaaatctaaagacagaggttaagccctcttttagccagttccgtggtgaatatcatgttgaattgcaaattcaaagaagcagatgttgcctttcggagaaga

SEQ ID NO: 617390 - DNA, 369 bp, Homo sapiens
tatccatacaaacccctgtctcatgacagcttgcccccactctggcactgtttaagccttccttcttccaccttaattcagtctttcacattcctcctccttcattccagaagcacataatcccatcctttctgaaatcaagctcttccattcatgcccattggcttccttccctgtatgttaaagctgatgcttgagaagagatagctagtgttcaatttgagctcaaaggcatctgcaagtaattgaggagatattgaatacttttgtttatacaaaatacaggaaggtgtccttctgaggatcaaatattcttctaaaactgtaactacattctctgactgatctaaaatggacagtgcacatcca

SEQ ID NO: 617391 - DNA, 944 bp, Homo sapiens
cgatccatacttgctgaatgaatacacataaggggtaaaaagatgtctacgcatcttagacgaaagaagagaccagccaaggagatgaagttgggctgagagcagggatgagaagacggtgattcggccaaaaggtaaaggggcctcccatccgagaaccaaacttccaggagagcaggggctgcagaggccaggctgggacctcagggtatcacgcaagacagtcagacactcaccttcttggaggcctggtaccaatttgtaaacaatatcttgcatggttctgtcatgactggcaaaagaacagaaaggtggagttagctggaaatgttaattctataattcttgtacactttccatttaacaatatcaaagttcagaatcaccagtctggagctttgttggaattttacttctagtttacacatgaccaaaatgtgtcaccaaaagccatgtatgagctgaattaacgcgtcatttaacttgggctctggctgcttcaaacatttcacaataatgacagagaaggctcttctgggaaccccgtgcttcctgtctgccggacaccccagattccccacgtcccgtgccgctcaggggacaccgtccctgcagacaccccaggttccccgcgatccgtgcgctcaggggacagccgtcccttgcgacaccacaggtaccctgcgtccagtgcgctcaggcgacacccgtccctgcggacaccccaggttccctggtgtcccgtgcgcttcacgggggacacccgtccctgcagacactccgagggttgccctggaacatcgtgcgcttcacgggaccgcgttcccctgccggaggcgccgcggttcgcggggtacctggcggccagcgggacccggtctcggcggcgcgcgcgctcgccgcgctcgcgggcctcgcggaccggcgtggcctgtcccgggtgt

SEQ ID NO: 617392 - DNA, 2077 bp, Homo sapiens
  misc_feature (120)..(120): n is a, c, g, or t
  misc_feature (1023)..(1023): n is a, c, g, or t
  misc_feature (2077)..(2077): n is a, c, g, or t
ctgttctggcaaacactatgccatgttcctcgatcgctgtgctggcctcgccatgtaccgcagtgcaacataagttcttgaactaggcatcttgccttatttacacgcagcgcctcttgntattggttcaacgtcatatgtgcattataacgtaaacatcgactcgctttcttgttcccatatattcatgctatttacatataccccggtctgtacctctgccgcatgtgtcctcatgcaaaaggcggtgataacttgtgtcacttatgcgctcgagacgtgagatcggcgcgcatataggcaagcttcttgaaattgactgtctctcactaagtcgttggtccatactcgccagagaaagagatctcaaagttagtcgcccatacatttaatagcaatcctttcacacagcttagcaagatccccctagattccatccatgattgtcaattgtcagacaacggtggcctactatttatgcgctccgttgaacatagttcataactcatatggaacacgctcacgaagggtattggccattggcttagttacggccttccaggttggttgggttggggctaaaaccaaaaccattagccttgcattcgcaatatctaatctatttaagctataggggcggaaaaaccaccttacaaactttataagcacaaacctcggtaattcttcccaacgccaagttgcgccccccaaatataagttgccttacccgattctcccccttatataatctaaggttctacgcactcttggttttcgcaaaaaagagtcaaggcaggcaaaggaattggttggttttccccaatagtgattgcgatagcggaaaccattaatttaggttacaaaacaattctctctatccacaaaacagaggttggcatcttctctggggtcacaacatcttagggacaacgtgtctggtggtactcctttcctggtaggttttgtgatccctttgtcggagcgacaacggttcccccttttatagggtcacaccttaaactnttaagaggacattgttgccgaagataaaatctcaaatacgtatggagacaaaaccaaattgtttataacttacaccggttcatagcctattatagggcaatgtgactacaccgcattattctttttttctcccctccgagacgcgagaggattggccccattctaaagaataaccttttctaaacatctgcggccatatatctttccagcaataggtgactctcccactgaaaactcaagtcaccttaacgcagtgtaaagcgtagcgagctaaatgaggaagtcactcaggaccacttcggcactcttttcatgtccaataccaagcttttttggaccttttggaaatctggcctcaggagtcgaacatcagacaacctttttgaggagagtgccacaccattattacgatgggcaagttaacaacagtttaaaggggacaacacacagaccgaggcgctctgtgatacacgttctatatcaaccacggtggacaccattttcgcgtaaccatggtttctccgctgtgtgccgagcgctacattaagcacaccctcttggtttcctacgctgtcactcgatcgcttcgcagctttgggttacacacagcgaggagtgccgctctttactaacataacctaggtatctgttcacaattagtacatgggcataaggccctatatagagtacacccacagcagcaggaattataaatactcgcgaagccgttcacagtcattgtgtcaatacaaacaggttttcacccctcaatatgagagagcaacctatcacaagatatcccaccacaaagccggtgacgccagcggagacgtcttattacgtatctgttacaacccagcagtgctgtgttcccctctcatccattgatagcatcgaagtacataacatacacacctatcgaacgagaggatgtcgcactgcgcgcatggatcgcataatatacatgagagcacggcatgtcaacagcagggcatgtgaagcaaaacgttcacaaccaggcagatagcaagtcacaagtagtatagcgggccan

SEQ ID NO: 617393 - DNA, 1175 bp, Homo sapiens
  misc_feature (275)..(275): n is a, c, g, or t
  misc_feature (338)..(338): n is a, c, g, or t
  misc_feature (480)..(480): n is a, c, g, or t
  misc_feature (628)..(628): n is a, c, g, or t
  misc_feature (631)..(631): n is a, c, g, or t
catggtggctcacacctattatcccagcactttgggaggccgaggtgggtggatcatgaagtcaggagttcaagaccagcctgaccaatatggtgaaaccccgtctctactaaaaatacaaaaatcagctgggcatggtggcacgcgtctgtagtcccagctattcgggaggctgaggcaggagaatcgccagaacatgggaggcggaggttgcagtgagccgagatcacgccactgcactccagcctcggcgatgcagtaagattacatcatanaaaagaaaaaaaaaacccgtatcatcacaaattcaagccatgtccactatgaccgaaccttanaatgaggtcacattttaaatagagtataaccaaaaaacttttggaggctgaggtgggaagattgcttgagcccaggagttaagagaccagacttgcccacaacgtaggcaggacttatattccaccaaaatttaaaattaanatacgcgccaagaaaccttggttggactttttaatacaacacggtttttggcacatgttgcccaacagtggttttaaaagcgcgggtttaaaggtatttccccaatttaagcctcaaaattttgggaattagagggggaagcccttgnacncagcttagacacatggttttaaggatcacaattttgctaggggatggccacttttttgggaagcaaacctttttgaaaaacgagttcctttactgaaaaatggagttcatggaaagttttggcccaccgatgggatgggaccataatggaaccggggccacaaaacttgggaaaaggggacactggcataaaaaggcgccggttgctcttatgggaacaattccttgttgtggcccatccacacataagcgcgcgagggcacaaagcgggtgacaaacttctctgaggtattggagtataaaggctacctcttccggggaaattaattaaccaggtcttggctccctacacagcgggatatctttttatatccggcctcttggaggagggaaaaaaaacgggtgggtcaacgctatgtgtttcagagaagggttctttaaaacaagttttcgggtgtttttcgatatttacgtgggaatcttctggattattgcggggcaccgcgggcgccttatagcagcccctcttggggggggcccacttc

SEQ ID NO: 617394 - DNA, 169 bp, Homo sapiens
gatcaaaaagatcagtatgttcagatacaacaaagctagctttctaacttactaacttataatgtatatgcatatgcacatgtctagtgtctatcccctgcccaatggtatattattctttcatgcttgggttttctacgcattttcaagtttgcaggaaaagtttcaa

SEQ ID NO: 617395 - DNA, 251 bp, Homo sapiens
cgtgccatcttgtgatccgcccacctcggcctcccaaagtgctgtgattacgggcgtatgccacggcccggccacaataattttttaaaatgtgaagaagtgaaggttaatcttgggacagatcaggtcccctctcgctccccctgcagacttccagcgttgccagtaaggttaagcctctacaatacctagctttcaaaacataaacaaaagaaagtaatatctcatatcaggggtatgcggggaagaga

SEQ ID NO: 617396 - DNA, 614 bp, Homo sapiens
gtggagcttaagggaaagaggcaggacatagacctccaaagagaaggggatataaggagggcagaacatgtggataccgcagaacaagaaggccaatcacttaacgcaagtgggcgggtcatgtgacagcctctcccgctcaggaggagaggcttaaagtagatatgcaagccatgtggataccacaaagagaagcgcctcaaggtagggacgcaggcatgtggcccatcaccaagaggcggggctttcagcggggaacggtcggccatgtgctatcgacaagaccgagcgatacaacataaaacagggacgggcgacttgccagctcgaggaggcgggaccttacgaggaaggggcaggctccggggggacgctcctaagtataaacagccacaatcctagggctaaccgcgcagtactgatcattctatttcccccctctatgtgatccccacttccaaatatcccatcaacaaaccgacgtaatcaccaacccaacaatgactaatcaaactaagcctcaaaacaaattgataccatacacaacaactaagggcggaacctgatctccttatactagtatccttaatcattgttattgacaaaataactcc

SEQ ID NO: 617397 - DNA, 756 bp, Homo sapiens
taaggtttgagggggaatgctggaaatggtaaggggtatggagacatatcatataagtaaggctagggtgagtggtaggaagtttttcataggaggtgtatgagtgggtcgtagcggaatcgggggtatgctgtccgaattcataaaaacagggagtgttagaagtagggtctgggtgacaaaatatgttgtgtagagttcaggggagagtgcgtcatatgtggtccctaggaagatttgtaggggtgagggtgtcatcataatactgtggtgtatccggctatgaaaaatagtggcgaaggggcctgcggcgtatccgatgttgaagcctgagactagttcggaccccccttcggcaatggtcgaagtgggggtctcggtggggtctctgctagtgtggagataaatcatattatgtgccaagggtcatgatggcaggagtactcagaggtgtcctgtgttgtggttgatacggtgtggagaggttaaaggagccacttattagtaatgtcgatcagtacactgattggctagggtggccttcatatgagatgtgtctggggctactgcccgcagtgggcgccgatcagggcgaagttgggagttggatgctccccctgaatcagaggattgagtacccggtacggctaacggtgcgtacaatacatgggaggcctggttcacggtgccaggggttgcgatcggcgggggtcaacaaaacgcgatggaccagccggcggtatcaagccagcattg

SEQ ID NO: 617398 - DNA, 381 bp, Homo sapiens
tctacaggaccccgatttccactggtgatagaggaacaaatatgtgtgtagagcgttggaacttgtagcttctcccactcctccctaacttttggaggggtgagaggggctggagtattgatgctgatcaccagtgatcagtgataatcaatcatgctctacgtcatgaagcctccactagtaaatccctgcgttcgctgagcttctagtgttagttcacacatcaaagtgtacggagggtggcacacctcggagagcaagctcctcaccccgtaccttgtcttttgcatcgcttccatttggctgttcctgaggtgtatcccttattatatactgattatcgttagttaagtgcctccccgagctgagccatgctagcta

SEQ ID NO: 617399 - DNA, 150 bp, Homo sapiens
actgatcacatgtgctgccggacactacagcatctcaactcgcagcagtaagaagcagccactccaaacatcacgtagtgcagcacagactagtctacctgcacatgtcttcacgcacaccatatttgcagtccgtctagagcatagcat

SEQ ID NO: 617400 - DNA, 926 bp, Homo sapiens
  misc_feature (375)..(375): n is a, c, g, or t
gagggaggctcggcgctcagctggtggggaggcggggtctgcaggaacaccagagagggcggactcgtgaccatggtgtccgtgggctagtggcttggtgggcacctgttggtaggaggctaggatacgaaggttgtggatcggttcatctcgctggcactcgaccaaagtgtggagtgcgacatgagatgaatgatgtttgttgcgagtcgacggaggggcgttttgcccacggtggtttatcatagagcgtgtctttcttcactcacctggctatggtggcactttagattggacttgttcagccgctagtgatcaactggggcgcaacatctacagcgggtgagctgggcaggtgttggatgaatgtctctnggtctggcgggcttgacatgtccctacggggaacgatagacatgggtttacagggatgagacaaagggggtaagtagcaggtagggccccagggacatggggatggagaggagctgagggtatatggtgcaggaatgtgctctttgataccctatgtctgtgtgtgacgattcatacctgggaacgtgggaagctgcctgggaggcgcaagctgtagttcgtaccttgtctgtctccccaggattatcctgatgccacttatcaccatactactagtctatgggctgcatgtgcagttgagccaacattctaccgtggttgcccctttcattacaggttggccggtggtccaaatgtgtcgctggtaagtcggggaactcctagcctgtcctggaggggcagatcgagctctaagcctgcctcacgtccatcggttgccaccctttgcagtgatggcagcttgaccctggaacggtgcagacaaccttcctcaaaagtgggcataccagtatccacggggttggggttgccggtccagagcttaagaggac

SEQ ID NO: 617401 - DNA, 348 bp, Homo sapiens
tctctccacactggtctggcccggttgaaagtctaactacatcttagtagtccttcatataatctatgatataccaggtggtattactagggtttaatagctctgggatattttgcccttctaaaatatatttccaggctgggcacagtggctcaagcctataatcccagcactttgggaggcttcagcaggaggattgcgtgaggccagtggttcgagactggcttgggcaatgtagctagacccagtttctacgagaaatacaaaaattagctggatgtcttggtacatgcctgtagtcctagctacttgggaggctgaggtgggaagatcagggtaccgagctcg

SEQ ID NO: 617402 - DNA, 864 bp, Homo sapiens
ttgtctttctcctacaatccaaataccaacaaacccggtggtcagcactgcgaagatacagttacttggagatctcatctggaagatggtagcactgctatcagccttttttcccaaatgacctcctggatcacagctacccatggcctgaaatgttgcccttggagatgctgcataggaaagaaataaacttttttcgatctttgagccacatatcatatcaccatatctccctcaacgccacttagccccctcgcagatatctacattcacctcttacaaactgtctcaattactaccacctcaaccgattcatttgctatcttattctatctatcaacaatgccattacgaattcccaggcagcccgcctatcctaaacgagaatcaccatctcccccccgaactcccctcggaaactctagtctctcccaacaccttcccctggcacatacacaattcaaatcttacttacctaccattcccatctagacacctccactccatctacctagtcaactctctgatcatttaaccatcagagtaccacatgacccagatcttccagcctctcttctctttcctcaccctaccgctatacatataaatcctctccccacctatatcttgcttgatatacactattttcaccattccttggtgttaggcccatgtacagataaccctatcacaacttctctaccactttactaacccgacgcccatctctatctcttctatcctctcctagttgcactcccaccttttgtagaccggccgccttcaccaccccggctcactaaaccaactatacacacatacccactcacactcgtgctaccaaccatgcacacccttatctac

SEQ ID NO: 617403 - DNA, 1002 bp, Homo sapiens
ggtttgccgtcagaacacaggtgtcgtggagaaactacccctaaaagccaaaatgggaaaggaacagactcatatcaacattgtcgtcatatggacacgtagattcgggcaagtccaccactactggccatctgcatctataacatgcggtggcatcgacaacaagcaaccattgaagacatttgacgaaggtaggctgactgagcatgggtaacagggctccttcaaagtatgcctggcgttcttgagactgaaaacctgcacaagctgaactgatgaaccagtgatgtatcaaccaatctgaagtatttctcccatagttgagacaatcttgaagactcagacacatgctacatcattgacgacttcactcaatctggacttcgcaccacaagggaacaacacaaacagaccttcgagtccacaacaacgcattgactattaccagagtgaacactactcaatggacatcgaaccctagatagcacttagtcccttagacacatagtcaagactcagaccgaggataagttaagaggaatcgcaacatccacgaacaacaccaaaggagagatatctcacacaaagacaacaggacgcaagaaaaagcccgaacacacgactaatggcaacaatatccatgaacacacaaacagcacgacacactcgacacatccacgcaaccacccagacagaaaaacaaattggatcacacgaacgctaaaaacaaagacaaacatagaagaactaaagaacgatagacaacaaaaccagagagtacgatagagcaaacacaaaagccagcctgataagcagggaacaaaataagcgaaacgcgggaaatgggtaaaagacaggccataccaggcaacaaagaaggcaaaaatgagagaacgaaaacagagcactcagaaaaccaaaacaaacagatgacaaaaatgcagtggagacaaccaaagacaaaatacgataggaacagaagaaaaacaaagcaacaaacaa

SEQ ID NO: 617404 - DNA, 177 bp, Homo sapiens
ctcccctcgtcgtccatactttgtctgatgacagttacaagcatctatgtgccaagcagtgtgtgtgaatattacacaacttccgccttcacaaaaaacttatgttctggccaggggtgctggctcacgcctgtaatcccagcactttgggaggccaaggcaggtggatatcttgag

SEQ ID NO: 617405 - DNA, 485 bp, Homo sapiens
gtagatgccaaagagtacacattgtgtggttccatacattggacactttagacaaataaaatctaagctgtagttacagaagtgcgatccggattgggagggaggacgatggattggctgcaacttgaccggccgtataaagggggatgatgcaaactatacctcagtttgctgatggttaccagatgtttaggtacttatcaaactattaactgtacataccagatgtcttttagtactacgacccacaacccacaccaacaaacagccatcacaacatatcactagagactgattgctatcgtttgctaacgtgttctactcgtgtgctagtgttgtatcactctctcgcacatgtgattactttatgaccttcaccgtagtatatctactccactcctttttgtgaccatgtctcttccatctcattcatctcactgtctacactccaccatattcactacttatttattatacccttttcg

SEQ ID NO: 617406 - DNA, 322 bp, Homo sapiens
cgtgtttagtgtaacaaaatgaagtaaagataaaaaaagtgaaaaatggaaaattagagaagagcttatagaataagaatagaaataaagaaatatttttgtacagctatgcagtgtgtttgtttaaatattattacgagagaaaaaagtttacaaaattaaaaagtgtataaagtaagaaagttacagtaagctaaggttaatttattattgaagaaagaatttttttatacatttaatgtaggctaagtgtacaatgtttgtacatctgaagttgtgtacagtaatgccctaggcttcacactcactcaccattcaccta

SEQ ID NO: 617407 - DNA, 205 bp, Homo sapiens
gatagctcggcatcaggtacatatacaaagtgtagtgggaaatatattgggtgtcacttaacagtgtgtagagtttaattggttatgaaaacatatcaaagaaatatatatagtcggaaggaggtaagctgacttttggcacttacgtgcaggctcaaaattctcattataggaccatttagaaatcgacttatttatacaaaag

SEQ ID NO: 617408 - DNA, 107 bp, Homo sapiens
atttgtgccctcacaccccacattgtgagctggtgctcctctgtactgcgataagcagcctcctagaagactgcaggctattggttaaggctgaagttgcagaaact

SEQ ID NO: 617409 - DNA, 538 bp, Homo sapiens
ggtggagacgggggtctcaccatgtgcccaagcggtctcaaactccgggcctcaagcagtcctcctatcccaaagggctgaaattacaggcatgagccaccaggccgggccaccactagttttggtaaggggagcaggttccatatgagagggaggaagggatttcaggatggtcttggtaatttcttaggtccccaagaaatggatgggacatgaggaaaccactctaggtgtgaccactctaaagcattagcagtcagtcatttcactctagggagaaatcagagcggtatatggagaataggtaaagtccccaatatggatatgtattttaatatgggacggctggtattgtttggttagatgcaaatagtagggtattccgaacagacactaaaaatagcggtcatctcaaagaatccagggctggtgtcacagtatgagaaagtagatgcgggggaacagggttaaaggaaggaagcattccagccagccagggatctcttgggaccttgcattctccatcagattggatcac

SEQ ID NO: 617410 - DNA, 115 bp, Homo sapiens
aaagagacagtcttgcctcattctgtcacgcagaatggaatgactttctaaaattgcagaaagcagaagcatattccttgctgtttataatattatagtcgtatcaaagggagag

SEQ ID NO: 617411 - DNA, 1922 bp, Homo sapiens
ggtgggatggccacgcacttcctcaccccgaacccacaactgcctcagggctagcacgaccagcctcttgcgggctgaagcgacggctgactccccaagatcctgcaaaggggctgcaagcctagattccaaccctgcccggcgctgagcgcactgagctaggggcatgtacttctgcgctgccagcgcgcgcgccccacaaacgcttccacatccgcgtgcctctaaacacgaccaaacccagaccctcatcagcacaaagacatgcaccatcccaacctactgcgctactctcacactaaaccccatcctgcctgtgctcctgctcctctgccacgcacaactactctctccccctctcgcacacccctgcgctgcctccagacaagccccactcatcgacctccactcacctcctaacgacaacacctcacttgaacacgcacacacgcgaacacctacttccaaccccgcgcaaaccccgagcaggcattgcacacgcggtggccgcccgacatgcgagcggacaacgacgacacgccgcatgcgcaacgcgcgcgcccaccagcacacccaccttcaccctgccgcccgtacagcgcacacctagaatcaaggcccccaacctccgcaccccatactaccgagcccagcactgcagcccagaccacgtgcacgacgcacacacgacccactagacgcgcggaccccatgacgaccaggcagagaacgcccctgaccccagtaaccattccacagcaccagtacataccaatatcgcagcaacacatccacccagtactccaaacaccagtgacaggcgccgccaacacaccgaaacaaggcacaaacatcaccatgcggcactacgatccccattgcagcacgccccacaccggacacgcgccacaccgagaccacccacccgcttcgaatgacgaacgaccacaaatacaaaaaggaactaacacccaatatgcgacacaaggcggacctatgagccacacaacgacaacatagcggacgtagacaaacaggaaacttagcgagacacgaacaaaatgaccagcgagcgacataaccaaccaacaaatataaaagaaaccacacaactgacattacgagggcaacgacgccactaacacattgacactagagacaacccacgaaccactcggccatagcacagaatcacacagagcgcacaagacacgaatcagccaagccaactaccaaccgcagcactacaccggccgcacacatcagccttgcgtcgcccctaaccaaccatactgcacgcccgagcaaacacacaacgcacccagatcacgcccgcactcacactactgtcgagaagccccatccgcgccacaccaccccacatggagaaacacgcagaccatcaaagacaagccacaacaccgcaccccgactgatacagaccaacacacaccacaaccaggacacagacaccaaacgcacacccaagcacgcgtgcacagcgagaacacgcactacactcgcacacggaggcaacagccccggcacagactcagcaccgccacacacacaagagcgagcccaactgacggaacctcagcacatcacacaacctaacacacactacaacaacacaccaccaccaaatacaatcacacaagaaaaccaaaccaaacacacaccaccacccaacccacaccatcacaacaccagacacaaacacccacacccagacacaaccacctatacaacataacaaacatagaaaccacaaccaacaacaccacccccccctttacactcgccacacaccccactcatccatccacccacaacacacaacacaaccacacaaccccacacacacaacacccacacacaaccacaacaactattaccaactcaccacaacacaacctact

SEQ ID NO: 617412 - DNA, 91 bp, Homo sapiens
  misc_feature (1)..(1): n is a, c, g, or t
ntgcgtggtgatgtgtgtgtgtgtgtgtgtgtgtgtgtgtgtgtgagtgtgctgtgtgtgatgcgtatgtgtgtcgcgcgtgtgtgcgcgt

SEQ ID NO: 617413 - DNA, 130 bp, Homo sapiens
cggcattttgtcttcctcagcagggctggccggctgctggggtgtgcacagtggctggtgtgtggcctcctcgtgaatcctcctcctcctcctcttcttcagcctcttcttcctcctcctcctcctcctc

SEQ ID NO: 617414 - DNA, 1013 bp, Homo sapiens
  misc_feature (35)..(35): n is a, c, g, or t
  misc_feature (105)..(105): n is a, c, g, or t
  misc_feature (118)..(118): n is a, c, g, or t
  misc_feature (138)..(138): n is a, c, g, or t
  misc_feature (169)..(170): n is a, c, g, or t
  misc_feature (175)..(175): n is a, c, g, or t
  misc_feature (184)..(184): n is a, c, g, or t
  misc_feature (195)..(195): n is a, c, g, or t
  misc_feature (198)..(199): n is a, c, g, or t
  misc_feature (220)..(220): n is a, c, g, or t
  misc_feature (222)..(222): n is a, c, g, or t
  misc_feature (225)..(225): n is a, c, g, or t
  misc_feature (244)..(244): n is a, c, g, or t
  misc_feature (307)..(307): n is a, c, g, or t
  misc_feature (317)..(317): n is a, c, g, or t
  misc_feature (321)..(321): n is a, c, g, or t
  misc_feature (347)..(347): n is a, c, g, or t
  misc_feature (353)..(353): n is a, c, g, or t
  misc_feature (373)..(373): n is a, c, g, or t
  misc_feature (378)..(378): n is a, c, g, or t
  misc_feature (382)..(382): n is a, c, g, or t
  misc_feature (411)..(411): n is a, c, g, or t
  misc_feature (417)..(417): n is a, c, g, or t
  misc_feature (424)..(424): n is a, c, g, or t
  misc_feature (431)..(431): n is a, c, g, or t
  misc_feature (435)..(435): n is a, c, g, or t
agtgctgaccctcatacaatgccatacgcatcatnacagagcattgaaggaggacttggatttaagcatcgtctctgggtatattctggaagaagaggtgttcantgttggatatatnataaataagttagaaaactntcttctgcagtacgttctgggatagttgagnnttganccttgtaangggtggtcaanacnnaaaaaagaaagttcacctaantnaanaaattcacccttttatcanaaaatctataaacataataaaaaaatactttgaagaatatgccttggttaatcaagatattcncgaaaataangaangctgggataagattttagcccttgtncctganacaattcatgatgaacttcnacaangctnccaaaagtctcacaattcacttcagcgcngggggnactggangaaagtngccngcagatatcagaataacctcaaaaatgacaaatatggaccctggctggagtgggagattatgctccaggactgttttccacggctggatatcaatgtcagcaaaggaatcaatcatctactgaagagcccttttagtgttcagcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaattttccttgagaaataaaaaaaaaaa

SEQ ID NO: 617415 - DNA, 718 bp, Homo sapiens
  misc_feature (71)..(71): n is a, c, g, or t
  misc_feature (75)..(75): n is a, c, g, or t
  misc_feature (196)..(196): n is a, c, g, or t
ttttaaacaattgcccgggacttattggttcttgcagcaagaaaacattttggaggaaatatatccagatnaccnccccttcccctttggcaagggatatttttaaagtctctttcaggaagagcaaacaggcctttacatcttttcatccaataattccaataaaacatccccctaaaattttttctttcaaagnggggggtcttttaaatttgaattagaactggagaaagtcatagataatagtacatgtccccttagggagtaggaagaaatacaatttctttaaaccatttatccggatttttatgttttattagccttttcaaaaaagcggattatttaaagaataatcatatatatgcatacggaaaaatgggccccagtgacttatttgtaggtgttagttgccccgccacccagtttgttagggcatttgagcccccattttaattttcccctaattaaaaagggcaggattttcaggggccaaaaaatttaactatttaaagaaagatttccccccttatgttttaaaatcccaggcatccgcgggaaaaaaattttaaaaaaagtttggaatttaaaaaaaaacctggggttctaatttggaaaacccaaatctgggcaaaggaaaaaaaaaatcccaaagttgtttaaataaacgggggggtgtttttcccggaaaaaaaaaccaaaaaaaagtttggtttttcca

SEQ ID NO: 617416 - DNA, 510 bp, Homo sapiens
  misc_feature (28)..(29): n is a, c, g, or t
  misc_feature (33)..(33): n is a, c, g, or t
  misc_feature (44)..(46): n is a, c, g, or t
  misc_feature (49)..(49): n is a, c, g, or t
  misc_feature (54)..(55): n is a, c, g, or t
  misc_feature (62)..(62): n is a, c, g, or t
  misc_feature (65)..(65): n is a, c, g, or t
  misc_feature (76)..(76): n is a, c, g, or t
  misc_feature (81)..(81): n is a, c, g, or t
  misc_feature (159)..(159): n is a, c, g, or t
  misc_feature (507)..(507): n is a, c, g, or t
tctacgtttacagtatccagcaggttanncttnagataaagaannnaanaagcnnaaagganagnaaaagaagaanaaaangccaaaaaaaaaaaccaaaagggaacagcagcaagcgaaaacgcaagaaaaacgcgaaaaacaagaacgggaacaacnacaagggcgccaggggaaaagaaagaagaaaaacaaaaagagaagaacacaacaggcgaaaaaaaacaacagcgcccagcaacgcagggaaaagaggcgccaaccaaaaaaggggagcaaaaaaggccaaaaagaggggagcgcacgggcagcgaaccacagacgggaaaacaagcgcaaaaagcccgcaggaaaaaagtcgtagcgaaacagtgcaagaaacacagaagggaaccaaaaccggtgtgtagtaagcaaagcaggcaaccaagccgaggccaaacaaggaaagaagcaggaaaaagcaccggagcaacaagagaaggcgaaggggaggaaagccagtancaa

SEQ ID NO: 617417 - DNA, 796 bp, Homo sapiens
gtctcggatgaggaacacgcgggcagggcgtgttgtttgtggaaaggatctcgtgttcatagaaagctgcacccgcagcatgagagtcctctgcatcctttgggaggcgctgaccaccctgagctcgcttctgtgtctcctggaacgcaggtgtcctcccaaggtcagagttgggaaagacacgcagccagtggatctcagatcagaggatgctgcagggacagacctcacccagggcagccttctttggcccggcacagctcccgggccttccccgacccctgtgacctcgcacctatgagggctgccggcccgtccttctgtggtccatgcccccggcctgtccgcctgcaccttcctcgtgatgggacctcggttctgtgtcttcagcaggcagttttccatcttcgcctgagtcaccatctaaacacctggagacttcacgtgacgttctggattttcagagtcactgcttatacctcaggctgtgctggcccaacttggagaagctgtgcccccaggcccaggaggcagggcatcgccagcccacagccacagtcaaaaccctccgaaggaggtcagaggacccacgccaccccagtgaggggcaaggacctcttcccttcttccttccaccccaggaggtcagcctgggggcccaggctctctcttgagccacactggcgggcaaggcatgggttgcccttagcgtgaaccaggttttttgccaaaaaaaaacagcccatgggttgtaaaaaagctctcgttggagaactctcgaggcaggaaaaccttt

SEQ ID NO: 617418 - DNA, 120 bp, Homo sapiens
tggaagcagaagcagagtatttaccaagactgagttgtgtcctttataataaatgggtaatggcagaagcaggaagcagcagaacaggaagggcagaagcaggaagcggcagaagcagga

SEQ ID NO: 617419 - DNA, 1667 bp, Homo sapiens
ggctcgggtgtcaatcggccgaggcgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 617420 - DNA, 710 bp, Homo sapiens
  misc_feature (251)..(251): n is a, c, g, or t
  misc_feature (258)..(258): n is a, c, g, or t
gtggacagcttcacatggctatgagctttccggacttcttcttcttgtctctgtctagttctgctgggccgcattgttcggtacctgatgcgctcgcgtgagatcatcctggtcagtgcaaccaaggataacctagattgatgtggacctgtctctggagggtccggcctggtagatatcccggtaaacaaggtgtcatcaagctgaagtacaacggtgatttcttcattgccaatgagggtcgacggccnatctacntcgatggacggccggtgctctgtggctccaaatggcgcctcagctacaactctgtggtggagatcgccagcctgcgattctgtcttccttatcaaccaggaccttctattgccctcatcagggctgaggctgccaagatcacaccacagtgatggagtggtggcaggactcagtgggccctctccggcctgtttcccctgccactccagcccccttgagctgggaactcaggctcaatggaaaaacctgggcagatgggaggctcagcatgcgggccaattgatttgagcctttagagggaggatagggcatggcatttgtgaagaccagacagaggacatgagaacatcaggccattcacatagatccagagcccctccccatattccatcatcatcataaaacaaccataccccccaattgccaccttcactcctgtgtactacattacg

SEQ ID NO: 617421 - DNA, 131 bp, Homo sapiens
atgctcttgccagtgtcttcgcctctgagtctccggtgtcctgtgctcctgagtcagggtgcagtgtcagtctggtccaagttgtgtgctgagcttgagtggcagctacgtccggtgctgggccccctgcc

SEQ ID NO: 617422 - DNA, 5210 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgccgcccgctggaacctacacctcgccattcggcagagggtcctgggacatgctgcatatgcaccggtctaccgggatagcacttcccgatatcctggaccgcccccccgtccccgtgtttggcgttacccccgtagcagaca

SEQ ID NO: 617423 - DNA, 394 bp, Homo sapiens
  misc_feature (251)..(251): n is a, c, g, or t
  misc_feature (258)..(258): n is a, c, g, or t
gtggacagcttcacatggctatgagctttccggacttcttcttcttgtctctgtctagttctgctgggccgcattgttcggtacctgatgcgctcgcgtgagatcatcctggtcagtgcaaccaaggataacctagattgatgtggacctgtctctggagggtccggcctggtagatatcccggtaaacaaggtgtcatcaagctgaagtacaacggtgatttcttcattgccaatgagggtcgacggccnatctacntcgatggacggccggtgctctgtggctccaaatggcgcctcagctacaactctgtggtggagatcgccagcctcagacctgatgagggcaatgaggtcctggttgataaggaagacgactcggggatcctctatgt

SEQ ID NO: 617424 - DNA, 1786 bp, Homo sapiens
cctgggccccaggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 617425 - DNA, 626 bp, Homo sapiens
tcaccttctggaaatccgcaaagttgcaggggccgtactggagtgtctcttctctagagagaattggtgggacccccctcagtgcagtggccccaactagtggagggagagaggacttaagtcagatggactcaacacaaatgggtttgcagaagaataatgaaaagttgtgggtaggaaaatgaatcattagcactcttcaatgaaatggagtgagcccaggagagctcacacaacaaaggcactctgggaacctggtagtaaaggcaggctggccaaatgccatttgattctgaacctcggaggtgcccactcaccctctgccaggagctaagtaacgcatgagagctgacttgggactcctggctcggccccaacagggagccccctttccaccatccttcggcaagctcaccacctcatccttgtgccaaggcagctatcccttcttttgtgagcattctggggacttagaatacactcttgttctgccaccttgtggactaggaccaagtccctgaccccgtcagaaaatgatgatttttaccgtggcacaccctaaccagtccctaattttcactgtgggaagtgaatggtttaaaataaacaaaaggtttacattaaaa

SEQ ID NO: 617426 - DNA, 5044 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggaggtgggccacacccaggaagggaaagcgggcagccccgttttggggacgtgaacgttttaataatttttgctgaattcctttacaactaaataacacagatattgttataaataaaattgta

SEQ ID NO: 617427 - DNA, 5609 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggaggtgggccacacccaggaagggaaagcgggcagccccgttttggggacgtgaacgttttaataatttttgctgaattcctttacaactaaataacacagatattgttataaataaaattgtaaaaaaaaaaagaaaaaaaggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggggggagggagaaaaccgacccgagggggagaaacggaaacgccacccaacaaacaagagacaagaacacaaagagaagggacacaaaaaaagacacacgcacagaaaaaaacaaccaaaaaaaaaaaaccagacaaacacaaacaaaaacaaaagaaaaaaaaaaaaaacaaaagaaaaagtaagaagagagaaagaaagagaaagagaaatataaaaataaaatagataagaaaaaaggaaagaataaataaaaaaataggaaagtagaaagaagagcaaaaaaacaccacagacacggaagcagaacccgacaaagcaataacgaaacagatgagaagaaatcgacgagacaaaaaaaccaaaagaccgtaagaaacgaaaggaaagaaacgacaggca

SEQ ID NO: 617428 - DNA, 172 bp, Homo sapiens
tcttagggagacacaattctgatccgttctgagtccattttgtgttgctctgacagaagacctgaggctgggtctttataaaggaagaggttgatttggctcagattctgatggctggaaggttcaagactgggcaggtgcactcacctgaggacctcacctcatccctgaa

SEQ ID NO: 617429 - DNA, 4641 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 617430 - DNA, 321 bp, Homo sapiens
ggctgcaaatgcatctgacgattttactagtcttaatctcctacgttactaagaactatttatttatttatttatttttgagacagaggctcactctgttagcccaggctggagtgcagtggcagtatctcagctcagctcagctcactgcaacctccacctcccaggtttaagcagttctcgctgcctcagcctcctgcgtagttgggattacaggcacacgccaccacacctggctaatttttgtatttgtagtagagatggggtttccccatatttgtcaggctggtcttgaactcctgacctcaggtgatcctcctg

SEQ ID NO: 617431 - DNA, 4250 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaacccaatgaaaggggcccggtgtgaggagcacgtcttcagccaggaagcagccaggaatatagctcatctctaatttcataataaacaaacactttattttgta

SEQ ID NO: 617432 - DNA, 1130 bp, Homo sapiens
ccgccgccgccgacgccggcgacgacgccaggggaagggttcgtggtccagggatcgggctcggcgggcgcggggtgcgggacggaccagggacacggcgtgctgcagcgggagcacactgagcgcccagcccgccatgtccaggaagaagacccccaagagcaaaggggccagcacccccgctgcctccacgctgcccaccgccaacggggcccagaccggcagcgcatccgggacatgcgcttatccaggccccagacgcgccgacccaacgggcccattgcagcacctggcacggccctcgcattggacgagactggtgtcagcacttctacgacagtcgaccttcaaggtcaatgctggtggagagactcgaggtgatggggaagacctgatctgctggattgacgcatccaaggatggatgacatatcctggacggggacacttcatcatccaccgataggcattgacttccggaacaaagttctggacagtggatggtgtgaaggtgcagcctgcagactgtgggacacagcatggtcaggagcggttccgcagtgttacccatgccatactaacgggatgctcatgctctgctgctgttctacgatggtcaccaacgaggcctcctttgaacaacatccaggcctggctgacacgagaataccaagagtaagccccagcagacgtgcacgctcatgatgctgggggacccaggtggaatcctgacaatgaacgatgtggaagaagacggaggcacgcgcaaacaaggccacaagagaaggcaggccacacatgacacccgcacacaacgcggacacaacgggacacgacacacaagcccacagacagagcaagacaaacacacgaagggaacacacaacaacagtacggtgagcacagtacagggcgatgagaggccacgaacgcgataacgcggaacaccgactagtggacacgacaacaaagagcagaaaggctcaaaccaaaaaggccgaaaacacgaagatatggccacgagcaggaatacacaaaaaaaagagagaggaagcagaacactaaggcgcgaagaagagccagcagaggaaacacagtcacagcgccttgctgtaaaaccaacccagggaa

SEQ ID NO: 617433 - DNA, 1653 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcatcgcggggcgctgaaatgcgatggagaccatcgactgcccacatcgtcatacggtaccgaca

SEQ ID NO: 617434 - DNA, 230 bp, Homo sapiens
catcaagacggagaagctggaggagcccgccgaagacagcccccctgtggaagaagtcaggactgtgatcaggtttgtgaacaataaaaccgacaagcacgtcaacaggccggtggtgtccctgccttccacgtcagaggctgcgtcggcgttcgccttccttggcctcgtccgtctcgggcaagatcttctctttaatgttgccaaacgcttgcctacagcacatgccg

SEQ ID NO: 617435 - DNA, 430 bp, Homo sapiens
caatataagtggaccagttcctcataaactgtcaaatgttcttaaatgtgtaatgatctatagatgctcatgaagaaagatctgctacaagtacgtgataaattcctatccctgggtgcatgtgcattcagaaatagctgtgagctttacagctctcatctaacttcttttatggaattcatgaagcaagtggtatgtgacaaggactccacttataaatataactgtttttatgttccactgaatccctgaaaatggtgaggagggtggggggaagtgaaggaaagacaagcagggctaattccaaaaagcaaggctagaaaatagccctgtgaggtcaagacaatttaatttatttacatgctgtctgttatcttcaagcagcacaaaatatgcatataaaagtgatggaattaatgtgaaataaaac

SEQ ID NO: 617436 - DNA, 2198 bp, Homo sapiens
gcagagagctagtacttcacttttcactggatacattttcagcactcatgagcttgtcacagccctcgtgagcccctgaatctgcacagccagacagggctgacgctgtacttgctacaaccttatttccttgccattgttgcctgctcctgcggcacactggcaccaccacctaccagccacggctacctccctgcggcgcgccgactacttgtccgcaaagtgccccgtacacacactgctactcccctggccttgccacacttgcacggcaacccttgcggcactgcctactctaacctccccgctcactctctcagcctacaccttgctcacccatttcatagcgtaatttccccaaaaagcgcaccccaactctaaactggcccccttcttgcactttcaaggccactactacccccagctacttccccgcactgcaaccactttcccccacacacgcaccttggcgcacgggcccaaaaccctccgaggaccccttgacagctctctcacacatcttcccagccaacacagaacttctaactggctcccaacttgcccctgcgccgccgcccatcttggcacgcgccttgtggcacggccccttcttgcgcgcgcccctctctacggccggccccttactggccgcggcccctctcccacgcgcccttactcgtcctggtcaccccctccggttccccaacgctgtgcccatgcttcccgttcccgccgttctgtctcggccctgtttcttcccccttggcgctaccgtctctccccgcgttcccatatccccccctcttctttccgttcaccccgattccccatgtgtctccttctgtccccaaccggctcccacacgctatgctcaccttccctctctctcccgcctgcttcacagacccttcccattcattcccaacggccaacacccacgctgttcctccaacccctataacgttgtcctctctcccacgctggcacaaatcccgcacggcctccttcaacccccccatttcccttgggatctcccacccatccaaacccaaaaatgcgccccaacaacatagtgaaaacccaaaacactcactttccacactctgcggcgcccccccatcaccccccatatctcaattggcggcccaccccccccactcccggccgcgagccttataaacacccgcacccgttctctgtgccccgcacacaccaatgcctcccccattgtgccggtcggcgccccctttctccgtggcgcccgcacaccacacaaagcctcgggcttataaccccccccgaaacggaggacttccacaacccaaacagcgggagggcaggacacaccctttcccgcaccacacccacgcacccagcagcccgctcctcaacccgcgccacaccacgcccgagcaccaactacacttccccccccgaggtggcacccccccgcagcccagcgcaggccccccaacccaccctcacacgcaccaccagacacaacgcgccactctctgatcactacagcaccccccccgcgccaccacccccccccgccctcaagcgacacacgcgctctctacccacactaccaccccccctcacaccaacacacgcgcgtcccaaaccaaccgcacacgaccccacactttcagcgccacccaccaaacacgcccctcggtccgacaacaccacccaccccaccaccacagtcgaccactccacacacatcatccggccgacctctcgacgccggcccccccccaacgacccacgtcaccccatccgccaacgcgggcaagccccccatcactgtgcgggcgcccaccccccacagccacgccgctcgacaccccacgctcaacgcaacaacagtcttcccacacacaccacacccgtgtggcgccacacgcaaccacacaccactacacacaccacaccacccccagccgccacacacccgccaacccaccaccactgccgactgcacctcgccgcccaccccccaccctgccccaccaccaccacccagcagcaaccacacgcctacctcgctcaccacaaacacacaacccacaccccgccatcgacacaaacccgcccacagccggcaccgccacacaacactgccacgaccagcacccacgcaccagacgccaacactacaagccacacacacagcccgcacctccctcccg

SEQ ID NO: 617437 - DNA, 284 bp, Homo sapiens
cccctttcggggaaccccctttgggggtcccataaagattttccggggatttggggtccattgatgggtataatggcccacgtttaaaaagagggggattgggttttaaatttgggccttttttcccccaaatggtgggttaagggggttggtaatttttaggtcctaattcctttgggttttttccagaaaatttttgtttttaaatttttttgcccttttaaatttggggggcaaattaaaaattttggaaacccccctttttaataaaaatccttttaata

SEQ ID NO: 617438 - DNA, 950 bp, Homo sapiens
ggtgctgtcctgggaggttggtgttggaggcccatgaagagcgccctgggactgctgagggtgggccacagtccagagctcaggacacttggctttggggggaaggaaactgaggcccagagaggggcaaccactggccaagggtcacccagcaagtttgggctaagagcctggctccagcgcccagcatgtgtgtgccagagcatgggccgactgccaaagtaaccatcatccatatgggccgtgtggtgatgctggcccggaaggcagaaagaggcagcatgggcactgccaggacagtccacatcctgctggtctgcatgcgtggtccaccccgcactctgcccagagctgtctacagccgtgtgagctgaatcgtgattgcttcccacctcctttctctgtcctctcctgtaggttctgctgcgagccccaggaggtggtggctgcccagtccctagcgtggagctcatgtgttcctaacagtcaccacgctcacgaatgctcgtgctaggacttaccccatgcactgagtggcagtgcgcaatgatgatttgtgggtgttcctgaatgctagttggcagcaacagtgcttatctgtgtaaatacatgactggcatcaggatagcaagggaacagcaactaaaccaaaaacggcggagtattccggggcgacaacctgctgagcaggggccatgtgaatggtgtagtctgacaactattgtggaaggtgatgccttagtgtccgatagaggatatttatgggaaccgggtacggttaatacgggaaggaccgtatgatgggctgtaggatggcgagctagactcgaatacaagtgatgtgagaatgtcgactagagacagaagggatataagggtgggagcagacaaagaggaagtagggattagagcagcaacggaagaagtcaaaatcaataattaagcgtaca

SEQ ID NO: 617439 - DNA, 732 bp, Homo sapiens
ggggcgttgatgaaggaacagggagcatgctatttagagcaagtgcagcatggatatcaccttttaaaccaattagttcagccagtggctcaggtattttctcgcatttagagcactatagcatcacccatgtctacactcaggaaagcgtcatcatgaaaatccagacttcatcaacagacattcaacagcaagtcagattagcgattttcacaacaggcattctgccattgttccagccaggcattcagtccatcaacaactccatgtttaaacagcagtctgcacaacatgtcggttaacatcatcacacacagcacagcatagtatattcaccaaacacacattatgggaattcagacagtgcacgatccatatgtagaaacattgcacaatataatcaggaggaacaatcatgcaattgtcgacaaaatacaatacccgtggtcatgacatagagggcttaacacacagaagtgcacaatatggggacacaacacagtcatgcgcgaaacaaccaaacaacattggttcgactgccacgataagaggaaaacacctttttgtgccaaaacagaagagggacacaccacgctatcacgaattgtgtctcaagacataacaccacaacatgtgtataccgattacataacccccctggatggcaccgagataacattaataactttccacattcacagttaagataaaagacctaataacctacataaa

SEQ ID NO: 617440 - DNA, 236 bp, Homo sapiens
gacttacaaatgtgttatgagatggtccattcatctagactcagagtgtttagtgctgttctcctgagaacatcttctgtagccttgctttttcctcctgtaggctggcagaggacagtggagccagcacacacaaaactaacgtttgtgcatgggtaaagaccgtggtgattttataagcatcctggggcatatcacattccatgaaagtaggaaatagggtgctcctgcaacca

SEQ ID NO: 617441 - DNA, 123 bp, Homo sapiens
gctgcggctgcgaaagtaccgcctgcgagtaactgcaaagatgctgtccgtgcgcgttgctgcggccgtagtccggcccctttcctcggcgggccggtactggttctccagaaaatgctttgg

SEQ ID NO: 617442 - DNA, 145 bp, Homo sapiens
  misc_feature (5)..(5): n is a, c, g, or t
agtancaggcccccgacacaggccagcagctagacctactgggccgtaaactaataggctagggaggcgacagcccacatacgagctactagtagtaggggcataagggctaccctactaggacctaggcggggcagacagacgg

SEQ ID NO: 617443 - DNA, 501 bp, Homo sapiens
taaattgtttcttttcatttattttttttttagagacagagtctcactcattgtcgccggtgtgagtgcagtggcactatgtcagctcaccacaacttctgcctcccaggttcaagtggttctcctgcctcagcctcctgagtagctggaactacaggcacacgccaccacgcccagctgattttaatattttaagtagagatggggtttcgccatgttggctaggctcctctcgagctcctgacctcaggtgatctacctgccttggcctcccaaagtgctgggattatgagcatgagccaccatgcctagccccaaattttttcttttgataaaggatacccaatcatattctatcaggggctcactctactccagtattacctcatcttaactaactattatatctgcaacaactgtatttccaattagagtcacattttgaggcactggggttaggatttcaaaacataaattggggtcatgagaccatcaatggtc

SEQ ID NO: 617444 - DNA, 205 bp, Homo sapiens
tgcagagggtaattgaaatgaaatgctaattgctttcatacaattatgatattttgagttcaagtcacgtatgtacttcattggtggtggggtgggaaagaggaacaggaaggggtagggtgaaaagaggagctgaaattgctaaccaaatttgctccaaggagaaaaggaaagaaagaagccacatgtcagttgtttggaagtt

SEQ ID NO: 617445 - DNA, 151 bp, Homo sapiens
tggggggggggaccatgttttgaatgcattacattaccaaaaaaatgaatattgaaatgcaaaagtcaaaatataaaaacacggacatttgctctttacctagactagatatggctagtcctggtcaatcttaggaaggctgacgctgtgg

SEQ ID NO: 617446 - DNA, 356 bp, Homo sapiens
  misc_feature (258)..(258): n is a, c, g, or t
  misc_feature (336)..(336): n is a, c, g, or t
tagagtacccccgccaacgctgggatccactgggccacccatacaccagaagacatatgaggaaattgttaagcgaagtcagcacttacattaagaacaatatggctacaaccccgcacacagctagcatttgtagccaactctctgggttggaactggtgactcacatgctgcgagccaatgtgctaacatgtccttgcgttcaaggtgatggacaatgtcacccgctaaggatggcacatgccagtaggaaccacngctgcttgagcgctctggactgcattctaccaccaagctcgtccaactgatcaagcccttgtcgcctgccgtctccangtgatatcccacgtttagcg

SEQ ID NO: 617447 - DNA, 449 bp, Homo sapiens
tggcccgaggaggtttaagtggtttccctcgggctgaaaaagggcccccctttttagagtagttttcataagttttaaaactggtagctcggtcgtttcgccccctagggggcaaacaggcaccagcaggggttcaaatccttgattttgagaatttccccccaagtatgtggcagtaaatacaccaagcccctttaggtattaatgtttccattgttttaaccctgttccaaaacaaaattccccccctttttttatgggaaggtattttccataaaattccagtatttaaaaagcagtttactgttttggactttttgttgtatcccaaccaggtaaaagtccctttaaattgaggaaacggcaaattgtgttttaaagctttttgtatttttccagtttttgcccttgtaaatttgtaaatatgccctaaaaaagcttttttttta

SEQ ID NO: 617448 - DNA, 333 bp, Homo sapiens
tagagctggatgctggtgattgcagataaggaacaatatgtatatccagcatctgctcaccatttccacatccttaacttaatcacacctgcaaacctcctattttccatataaggaacattacaggtcccaaggataagaatcaatttggggggcctcatacagcctaccacagacatggactatgatctcatccttcctcctgccagatatatcaactccactttttctccagattggtaggaagcttgtgagcagaaaacacttcacctacaaaagtctctgagctgtgtccagagtagcagattatttaagagtaaataatttatatat

SEQ ID NO: 617449 - DNA, 871 bp, Homo sapiens
gctgctggcatcactatactactaacagaccgcaacctcaacaccaccttcttcgaccccgcggaggaggagaccccattctataccaacacctattctgatttgcggtcaccctgaagtttatattcttatcctaccaggcttcggaataatctcccatatggtaacttactactccggaacaacaagaaccattggataccataggtctggtctgcgctatgatatcaatgggcttcctagggttatcgtgtgagcaccaccaattatatttacccagcaggcatagccgtagacacacgagcatatttacacctccgtaccataatcatcgctatccccacggcgtcaaacgtattcacgctgactcgccacactccagggaagcacatatgaaatgatctgctgcagttgctctgagccctaggatccatctttcttcacaccgtaggtggccctgactggcattgtattagcaaatcatcactagacatcgtactacacgacacgtactacattgtagcccacttccactatgtccttatcaatcgggagctgtcttgcccatcataggaggctcattcaactggatttcccctattctaggtacaccctagaccaaaagcatacgcaaaaatcactgtcactattaatatgcatcgggtaaatctacctttcttcccacaaacttctcggctatcggaaaggccggcgttacttggatacccgatgttacccgtgaaccttctaccactggggccatcatcttaccgcggaactaacattccgattggtagctcgtcagcacagtctagttaaaacccaacgggtattggcccccccattgaccttaattacagggcccggtccg

SEQ ID NO: 617450 - DNA, 265 bp, Homo sapiens
aggcggaccttcctctcctcccacctcccaagtagctgagactacaggtgcgtgccacatgcccgctaattttgtattttttagtagagacagggttcaccatgtggccaggatggtctcgatttctgacctcgtgatccgcccacctaggctcccaaagtgctgggattacaggtgtgagccaccgcacccggccaactctttcttttttttaaacatgattttctttctttttctttctttttttgaggtgggaggagaggaa

SEQ ID NO: 617451 - DNA, 188 bp, Homo sapiens
gtaaagcgtataccaatgtggtggtgcgggtcccacagtgacgagtgagtgagtgtcccatggcggtgagtgggtcccacatgggcatggtgtgagtgaggtcccatggtcagtgagtgggtcccacagggcatgatgtgaggtcccattggcagtgggaggctcccatacgcgcgtgagtgaggtcc

SEQ ID NO: 617452 - DNA, 126 bp, Homo sapiens
aacaactccatcttcgcctaagagccgcaggacccacgctgtctggctggtccaccttccgcaccacctccatgccctctagaacttttgtaacaaactcctaccaacactgaccaataaaaaaaa

SEQ ID NO: 617453 - DNA, 321 bp, Homo sapiens
ggagtaaacataggctgggatggtggctcacacctgtaatctcagcactttgggaggccaaggtggaaggactggtatatgccaggaggtcgagaccagccggggcaacatagcaagaccctgtctcttaaaaaaaatagcaggttgccaatgcacacagccctacagtcccagctgcttccggggctgaggcctgaggttcacttgagcccaggagttccgggttgcagtgagctatgattgtgccactgcactccagcccaggcaacagagtgagaccctgtctttaaaaaaaatgaaacacacacacaacgggatgga

SEQ ID NO: 617454 - DNA, 777 bp, Homo sapiens
  misc_feature (270)..(270): n is a, c, g, or t
  misc_feature (777)..(777): n is a, c, g, or t
gaaaccagcgtacaggtgacaggcagctcacgccaggtcctgtgaggggtgtggcatatacagaggacctgggcactactttatgtaccttcgttacactaattgctgtgaggcaggctgttggtgagctctgctcgggacggtgaagtaagctagggcgcaggtctggggtacggtgttgtgtcagaagctagagacgaggctgggtgggcatgagctagagtcaggctgggattcagtctcagacgagtccttaattagacatcgagngctactcgcaacgttctagctgtgtgttcgtgggtgtggccattaggacaaatgaggctgggaaacagcggtaggagaaccactggtagagaagcatactcagatggggtgctcattcattactgtatcagcaggtagatcacgttactctgtaggtgcccaacccgcatttaagtggcctatccaagtgggcagatgataagccctgcctttgcctaattcaaggtaacagtgaagatcactaaggtaataggagtctccgtaagggactctctcaggcccaagagccaggcgttgcttcaagataaggagctaggcattgtgcactgtgcactacaggagacctagagttgaacgagtttcacaggcctggcgtctgctctccaattcaggccttgccctcagaacgaggcagctctcagcatcgcagtccatctgagtcctggccgagagcatttgatgctgcacatctggttcatgaaagctgggcagtaaggggggcagctn

SEQ ID NO: 617455 - DNA, 1053 bp, Homo sapiens
gggagcaggctgcacggcaccaagcagcggcaggcctggcagcacaatcaacttttccagtcacatggtccagtatgtggattatcttgtgaaagcaacagggagtgaagacacatttttgtgcaatggccacaaccaggcagacaggcctgtccctgcagcgtctccagcagcgtcgcccaggttgccagaggagtgggtgacaaacagggcacaggacaagctggcatcaggtgatcaattcacagtaggagcactgcagcttgacaggagtcacaggcacactggccccaacatgcagcagcaacataggagctgcatggccatcgctgtcatttgcaccgttcttcctcaagccatggaccaaagatatcctgattaactttcctaaaggaagtggcctgctgacgcccctgccctgccatatacattactatcacattcctgccttgacaggggtaaacgatttcgtgctgaggagtagtcggactgggactctggataagatcccccaccttccaagggctgaacaatttcagtgctacagcatctcttagacacttcggggccaagcggtcgatccacacatcgacaggcacacagactggcatacctatcaggaggtggctgagccaccgcatgcacgtggcactggccgaatgcgacacaactggacgcagcggcgcagacacatactaattaccctgggaaacacacgcacccaaccagacatgttgagaggcccacacaggacaccaacaacgggaacacaccatgacgccatgcaacgtaatcacgaagcgcactcgcagaaggactttaaacaaaaaataggccagaccaacacacaggggatagggagaagtatgacagcgaaaccaaagacgcagccaagcaacaaccaggagcccagtggaacctccccaagggggcacacgcggggctcaccaagtagtacaagagcaccaggggagatagccggactcgctagcaacaccacacagcaacacaccgagggcatcaccatcaaccagcgacataacgaagaagaaa

SEQ ID NO: 617456 - DNA, 203 bp, Homo sapiens
tagcttattgcataggatctttcacgtgtaaccatgcaaagaccaggtgcctctctctattggttgatcacaccaattcttcctaggttagcaccgtccagtcaccatacacaggttaccagtgtcgaacttaatgaaatcagtaatcttgccagtctctaaatcgaatctgaatagtatcattcaccttgatgaggggatcg

SEQ ID NO: 617457 - DNA, 367 bp, Homo sapiens
gtctacaggatcttcttacgccgaactctgagcagaacacattaaatcaactgagaaagactacgtttacaataagagaacaacaatggatgtgaacacaccaatgagcagggtaaatggtccattagagagtcactttcactatcattcctacaaatggctagggaatgacagacatgggtggaggagagggggggcaacctggaggggggagatgggaggaatggagggggtctgtttggggagggagtgatggaaggtgtgtgtggtgtggaggggtgcagtgtgtgtgtgtgtgtgtgtgtgtgtgtgtagtgtgtgtgtgtgtgtagtgtgtgtgtgtgtgtgtgtgtgtgtgtgtgtgtgt

SEQ ID NO: 617458 - DNA, 746 bp, Homo sapiens
  misc_feature (446)..(446): n is a, c, g, or t
  misc_feature (539)..(539): n is a, c, g, or t
  misc_feature (621)..(621): n is a, c, g, or t
gctgtcggaattcggctttagggctcacgtctgacctcccaacactttgggaggccgaggcttggggatcgtttgagaccagcctggacaacattgtgagaccctgttccttgaattgccctgggagatttcctcagcttgtactggaggtgtgtggccccatgaagcccatagtcaccgttcaccctgagagacgctggctttggggctgacacacctgctgcggggcagccccaggagatggccaccctgtttctcctggagctggagctgcgcgtcttctcagaaactgtggtggctgtcctgttttgtttgcatcttataaacctttacctgattacattttcctcttcaatttagctgctagcttaaagtcagattggtggctcaccagtaatgagagtttagagtagaggtaaactttatgacatagtcttagactcttnactttctcctcagccaacatgattcacatttactttattttgctgtactgtgaagtgctttgggggttcctgatttcttctggaataaggcangtttgtagtaagcacaggtttctggtccatctcatagccctaggcaatgggcggtgcttgccgtgctccctttctgggtacntgtggtaactttgaattgcaaggctgcgatttgaggctgattagtccaacgggttctggtgggtccgtggggtttgttcttaatgtgacaattccctgggccctgtgttttcccctttggctggg

SEQ ID NO: 617459 - DNA, 565 bp, Homo sapiens
  misc_feature (446)..(446): n is a, c, g, or t
gctgtcggaattcggctttagggctcacgtctgacctcccaacactttgggaggccgaggcttggggatcgtttgagaccagcctggacaacattgtgagaccctgttccttgaattgccctgggagatttcctcagcttgtactggaggtgtgtggccccatgaagcccatagtcaccgttcaccctgagagacgctggctttggggctgacacacctgctgcggggcagccccaggagatggccaccctgtttctcctggagctggagctgcgcgtcttctcagaaactgtggtggctgtcctgttttgtttgcatcttataaacctttacctgattacattttcctcttcaatttagctgctagcttaaagtcagattggtggctcaccagtaatgagagtttagagtagaggtaaactttatgacatagtcttagactcttnactttctcctcagccaacatgattcacatttactttattgtggcggtacggggagcgtccttgacaggttggagaaggggcaaggaggtggggggggcgggaggtagagagccgggcaa

SEQ ID NO: 617460 - DNA, 120 bp, Homo sapiens
cctgggtggtactcaatccaactctgactgtcggtgagcgccgggctatgggcccgatgctccgagcgccgatccattttcaaggactagattgattcggcacagtgagttgttatcaca

SEQ ID NO: 617461 - DNA, 243 bp, Homo sapiens
cgcttctgcgtcttaacgaggtggtaccagatgcagggagttatactgagctttttcgtctcattttcctgaatagactattacttcttccctctacatccctcctgtgttcaaaagcacgaattgtcgaacccctgactaatgtgacttggacccggatatgtcaccgacttcatccagtgccaagcatatgaaccttctgtgagtcatcttcccttccgtcccccttggcacgcattaact

SEQ ID NO: 617462 - DNA, 191 bp, Homo sapiens
aaggtccggcccaggtttttcctttttttttaaagccctcaggtttggtttccaatttttgggccctagttttgggtttgaccccccgatggggcccaaaagtttctttttttggtttggccaaaatcctggttttccgccctgggggttttttggtttttgttaataattaaagccctggtccgggggga

SEQ ID NO: 617463 - DNA, 251 bp, Homo sapiens
  misc_feature (176)..(177): n is a, c, g, or t
  misc_feature (215)..(215): n is a, c, g, or t
  misc_feature (227)..(227): n is a, c, g, or t
ctgggccggcaacagctacctgactactctgaggtaggacacactggggcatgacccctttgacagaagaggaacatgagactagctgtgactaaaggattcacccagatctcctagcccaactctgccccagagcccaaagtgctcaagaggtgacactccatttgacgaagganngactgccccgccttttaactgtgaaaacgcaggcctgngaggcccagggntggacgtggtcctcagccagacca

SEQ ID NO: 617464 - DNA, 180 bp, Homo sapiens
  misc_feature (100)..(100): n is a, c, g, or t
tccgatccgcgaagacgttgcgccgcatagcgaaaacttgtctctactaaaaatacaaaaattagtcaggcatgggtggcgcacgtcgtgtaataccagncttctcagagaggctgaggcacgacggatcactatgcacccagagagagaggaggttgcacgtgagctgatgatcatgcc

SEQ ID NO: 617465 - DNA, 321 bp, Homo sapiens
acctcagcctgggtgacagagtaggactttatatttgtactgccataacattttaattcaaatagaatataactgaatttgtaagggtaatccctaatatttagctttaatttgtttgtagaaatataaaatggtagagctgaaaaggtttttgtagtctaataacctcctgtttctattgaagcagaaattgggccaggcgcagtggctttgtaccttgtaatcccagcaatttcggaggccgagttgggtgcattgttctaggccaggagttcgagactagcctagccaaacgcagtgaaacccgtctattaaaaatac

SEQ ID NO: 617466 - DNA, 365 bp, Homo sapiens
actttattttacacaagtggtggccccagaaccacagggacatgacctggagagtaggcacagtgcctgaggctgcaagagccaaatacagggattcatgccttctccttggtccccatgaccaaattaaaaaaaaaaaaacaacaaatcacacagcacacatcgccacacccatcccctccttcctttcagcaacagccaattcagctttctagccaaagacagtggctacaactgaatttacagagaaccatgcagccaagaaaccagagccacggaggggagaggcttgcgttgacttcccacatgtgctgtcccataagcagctgagtgaccccaccaagccaccgtgtggtttggacact

SEQ ID NO: 617467 - DNA, 375 bp, Homo sapiens
aatccattttattccattgggaggccgagccaggctgatcttgaactcctgacctcaagtgatctgcccacctcagcctcccaaagtgctgggattacaggcgtgagccttctagctcggcctgtcctgcgctcttacaggattatactgtgttatcggcttgtcagggcgttttccgggattcctaccctttgcagcgcataatgagattattatctatggctagttccgattttcctgcttctctctaacttttttatatctattcttaatattcttatcttctattttctaatctttcctcacatttcttcttatatctttatctattatatcttacttacctgtgtttctgttgttatctcttcacattcg

SEQ ID NO: 617468 - DNA, 141 bp, Homo sapiens
  misc_feature (76)..(76): n is a, c, g, or t
tgctggtattataggtgtgagccaccacacccagcttgacaaagattattggccctccctgccctatatcttctgngagtcgaagatgttcctctccctagatggcaagattggcattcctccttcacctcttttccagtc

SEQ ID NO: 617469 - DNA, 246 bp, Homo sapiens
tgtggttctgtgctggcttgcaggaattttaagacaatccatcaccatcaaggtttgcctttctccactttcgtgtatcttacagttatactcaccggaggtcattggcagcaaggctctggaagaatgaaactggtgcccggtaatggcattggcattcaatctaggttggccttcaggctttaaatgcggccggtatgaaggtcaagtctttttcttcagtccctaccagcaaagaaccacacg

SEQ ID NO: 617470 - DNA, 199 bp, Homo sapiens
tcatactactaaggacacacctacctgccttatccccatcctactctattacggtgagcgtctagagtcgccctgcgtgctttcatatttgttcatgatcgtcatttctcaagttcatgggtgtcaaatgcctggtggtatatcttaaaatagttgatatctgacacaatggtaaatatcaactaacactggctttttt

SEQ ID NO: 617471 - DNA, 748 bp, Homo sapiens
  misc_feature (65)..(65): n is a, c, g, or t
  misc_feature (100)..(100): n is a, c, g, or t
  misc_feature (115)..(115): n is a, c, g, or t
aagtaggcggtggtcttactagagtctatcgtcctgccatctaggagaccagagtatatcagcanagcatatcacgtgaatctgttgtcatggaccacanatgccaccggtatgntagagagacagtccatccatttcccactcagtcagttacacagtagcactacatcagagcgtcagcatatagaggtttaatatagtatagcccgctgtgtcaagctcccatataggcgctgtcctagctctctttcacagtggcatcatgtgtacgcgcagagtcagtcaaggttgcatcactcagagcatcatgccatgcaaatataggatacaccagtcatgtgctatatctgagtataccatatgcatactgtctttccacaagctcatgtgtgtcaacgtatcagcgttaatcagtcttggtttagagtattcgacaggattacacagtgagactcatggacaggatcatgtgggagagaatccatgcattgggtggcttttggcatgcgatgtcttgcaccgactgtagtgcgtggtgttctaagggctcaccagtacatagatcatgccatataggtcgtgtagttgtgctagaagatcagaatcttttatgcaccatccatcagtcgtataaggtgctagcatatgcgccatcaggatggtagtaggatcatagagtataggaccactcatctctggtctggtcgaacacctcccaatatattatgtctgggggcccgtagtcacg

SEQ ID NO: 617472 - DNA, 175 bp, Homo sapiens
tcgatctagagcatcccccttataattcattgaatctaggtctgtcccaatatgtattggatggcggatagtaagtatgtacattactgtgggccctcagaatgatatttggactcacgggaggacatagcctatgaagggctgttgctatagttcgcccgtgtacactgcaagg

SEQ ID NO: 617473 - DNA, 265 bp, Homo sapiens
aggacactgcatcatcatattctgccatctccttcggaactccatacgtcctgctgtctcgctcacgccgtacctctgcagactccaagtccttgcttgtcacgattagggaggaaccctcatggcctcgacagacatgttgtggatctctaggcacgaaggagatgcgctggtggaaggctagctggagctctcgggtggaatcgatgtcagtcatctccttggataggacatagcccttctcgtagattagatgctggacaga

SEQ ID NO: 617474 - DNA, 804 bp, Homo sapiens
gtccttggtcagagctacatgtgcaaatattagtatctcctctttggtagcatgtcttctgatttctttatggtatcctttaatgaacagtcttaatttcaatgtagttgagtttatgaatctttatcttttatgggatattaggtttcatcctatttttaaaatatttatgactcccaaatcataaagccattcttctgtattcttctgtaaaaacatgtgtaacttggcttttatatctaggtctataatctacctgacattgatagttatgtatgggtgaggtatagaaagctcaatcccactttttccataaggacactcaatttgcccagcagcattatgtgaaaagaccgttctttctccatgtgttctgcagtctcgtcttgtgttatacataaatctgtgttttcaaatgtggtctgtctatctctgctctaattccacactgtcttaaataatgtagctttatgataaatcttcacatctggtacaattttccttttgatcctatttgttcattttcttcacaagtcgtgagggtattttcaagtcaaatttggctttctcacgtaaagtcggcgtagtggtggtgctgttctgagagggggggcctcactctgttggccaggggtgggaggtggcaggggggtactcctgggcctggcggcctcgggcttccacggtcagagaaactctggttccaaggtgagcgaggaaagtgctgaacctgggcgggggttgagagcgagaattggccatgccccagcgggcaagagggactcttcccacaacaaacgcaac

SEQ ID NO: 617475 - DNA, 149 bp, Homo sapiens
agaatacaagaccagcctgggcaacatagtgaaacctaatctttgtttgtttgtttgtttctattcttttccttgagacagggtcatgcactgtcacccaggctggagcgcaacggtgcaatcatggctcactgcagccttaacctccc

SEQ ID NO: 617476 - DNA, 425 bp, Homo sapiens
atacggcacgctttatgaagtaccttatagtatcagaaaaataaaaatcttataattgtctaggacagcataagtatattgactctcagtggcttgggccagtcgtacgttgagggccctaaatcataaacaatctaggggttaatattccccaccaatggactatataggtccctatgagtgccctacatctacatgacaaaagagcgcaggaacatgagccaataccagactatatcgataatttgtcatccttaggtgggggtccttacaaacagtacacgcggcgaatctatgtacgatgcctgggcgaaatgagttgcagtgtacccggggagaacctacaacatacatgcatgggggacattcgtgcatatctgacacagacggcagggtagaggatcaggaggcactacggaccatag

SEQ ID NO: 617477 - DNA, 442 bp, Homo sapiens
tgcctgttagtagctgctgcactcaggccctggtcaacatagtgagacatcatccaaccaaaaaaaaaaaaaaaagaaagaaaaacagcttggataagtaaagacaagacatagaaagcaaagcaataacttttttttgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctgtggtgggaggatcacttgaggccagcagtttgaggttgtatagtatactatggttgattttgcctgttagtagctgctgcactccagcctggtcaacatagtgagacatcatccaacaaaaa

SEQ ID NO: 617478 - DNA, 127 bp, Homo sapiens
tacacatgtcggctcctacacataggctccctcagcttcacacttactccggcagtcccctgcgatggcaacactcgtaggtgtcttgaaatcccaaacttgtctggactcccccgtactccctgcg

SEQ ID NO: 617479 - DNA, 462 bp, Homo sapiens
  misc_feature (12)..(12): n is a, c, g, or t
ctagtctcgagngctatcatttattctatattggtagcttattctgccagcgcccaagctgggggagatttttattaaaaataactttggttttaagaattccaccctcaatttttaaatactttccgttaagaacatttttccaagggcaagtacagaaaatcttaagtttggaaacccaatccattaaggctccttttctatttattatatcccctcaaacaggtcaagatttttcagattacaaaaataaagtcatgtgttatcgctcagaaggcaacgcttttactatgagactctaaacacattacctattttaagaaacacccgctgtggaaaattggatccattttttgtcaaagtgtgctttaaagaacttaattcttttcgacaccgccaaccctcgggggggggcccgcaccccaattttgccctaatggggaggcgattcacaattcaccg

SEQ ID NO: 617480 - DNA, 180 bp, Homo sapiens
aagtagagatggggtttcaccatattggccaggctggtcttgaactcctgacctcaagtgatccacccacctcagccttacaaagtgctagggttacaggtgtgagccactgcgcctggccccttccctcttctttaacaccaccttccatcccttatgtcgtcttctcgcaaacgtata

SEQ ID NO: 617481 - DNA, 453 bp, Homo sapiens
aaaaagaataggagaggaaagagataagagaagagagaaaggggaaaggaaaaggtaagagagggagagaaaaagaagaaagcggacaaagaagaaaggaagggaaacaaaaggagagcaagaaaggaaggaagggaaagaaagagagagagagagaaagagaggaagagagatagtaaagaggaaacgaaggaatgaagaaaagcaaagaaggacgaagaggggcaagggcaatctgaagagagaaagaagaacagaggaggagaaaagtcaggaagaataaggaagaggagagcagacagagtggtgaaacaggagaggacaagagagaagggaacaacatgacacaggtggcatgaagagaaggaagggatcagagtaggaaactctctctctctctctctctctctctctctctctctctctctatctctctctctctctctccgcgtg

SEQ ID NO: 617482 - DNA, 378 bp, Homo sapiens
tatccgaaaagctgcatgactaaaggaagcaacttctaataacagtggtgagctgagctgtatttttgttttttttttggtttttctctcaataaagaatttcatttcgtagtgtggaagcataacaagtgcctcggggtccccagtctgggtgctgtgaatggggttagtggtatctctaacattatgtcgggggctagatttcaaaacccaggtaatgaaaaagtcagtttacaagcctaatttggtggtctttttttttaatatatattaaaggtaaaaatgtggcttcaactatttattcacaggaggattcttcatataaaattaaccctataaaattcaacggcaagggtgctttataagggaaacatttta

SEQ ID NO: 617483 - DNA, 393 bp, Homo sapiens
  misc_feature (31)..(31): n is a, c, g, or t
  misc_feature (144)..(144): n is a, c, g, or t
gcagaagatccaccagatgctatggttgggntccaagcagaatggatgcagatgagttcacttgggactgttgatgctccaagtacgaacactcactctttgttatgcccttgaatcaggacaggagcatggggaaagctgtcncatgaaagaaacccacagtgggacttgaatgtcactgagtagaacagatgtcagtgagttcagatgaaacttgcataatgcatcacaatggagtaacagtagcatacttgaagggcaaatcaattttaattttagaaggtatcaaaataactactgttggaagagggaattagaattggacagcctactacgtgccaggcttttaatctaatactattatattttacattttacagaagtaaactgagg

SEQ ID NO: 617484 - DNA, 337 bp, Homo sapiens
gaggtatgctgcaccagggtagcgagttagaagcaagatatatttaaatatatattcatacacacatgtgcaagtatgctgcactgataaagaatgtaggctctggccaggtgtggtgactcatgtctgtaatcccagcactttgggaagccgaggcgggcggatcacgaggtcaggaaatagagaccatcctgggcaacacggtgaagacccatctctacttaaaaatacaaaaattagccgggcgttggtgtgcttggaccttgttaattccccagcttaaacttttggggagggcttaaagggccaggagaaatacgctttgaaaccctggggg

SEQ ID NO: 617485 - DNA, 349 bp, Homo sapiens
caggctctctaccggggctaacacacttagcgcagggttggttattagtacttgcctacatcattctgtatagcatatagtcttctcgatcattgggatccgggggtactggggggtcacatctgataggtcgtcacgattttaacttggtaatagggctgagtgacatggtaagaccccctgagaagggtcggcatggcgtaaataactggatggctagagatgatgggactagtgtcatttggcatccacagtttctgggcaggagcttaaaagagccacctctccatggggtgtgggttagtcacccccagaatacttaattaaaaaatccagtaaacccagccct

SEQ ID NO: 617486 - DNA, 214 bp, Homo sapiens
ccgggaaatcaataaactgagtcatattggaaacccctagagaagatcggagaaaatgggttcagaacgagcatttaatttaagtcagcaaagtcagaatttaaaatggggcaataccttgtctaacattttcttaaccctcaatttgaccctggacaacggtagtctagtctcctggaaaacatggtgcaaccagacatgagatgttggaagg

SEQ ID NO: 617487 - DNA, 447 bp, Homo sapiens
  misc_feature (7)..(7): n is a, c, g, or t
  misc_feature (134)..(134): n is a, c, g, or t
  misc_feature (207)..(207): n is a, c, g, or t
  misc_feature (387)..(387): n is a, c, g, or t
  misc_feature (391)..(391): n is a, c, g, or t
  misc_feature (398)..(398): n is a, c, g, or t
  misc_feature (436)..(437): n is a, c, g, or t
aaagganatgctcatcaggatttcagacagataagtctgataatcaaagtagtagaactcctagccacttggctaaaagtttcaaaaggcattcccagtccccagggaatggggaattgaaaggagcaggaaanacgttcatttggccgggcgcagttgctcatatctgtaatcctagctttttgggaggctgaggtgggcagatcnccagaggtcaggaattcgagaccagcctggcccacatggcgaaaccttgtctctactaaaaatacacaaattagccgggtgtggtggcacacgcctgtaatatcagctactcgggaggctgaggcaggagaattccttgaacccgggagacagaggttgcagtgagccaagatctcgccnccanactccancctgggcaacagagcgaagtgagactctgtctcaaaanncaaaaaaaaa

SEQ ID NO: 617488 - DNA, 333 bp, Homo sapiens
tgcatttcttttaatggcttctctagtttcaatgcatattgcataacaaacacaggaagtcctatatctttcagctcaaggaggctttctcttgtgtcctatattgctgaaagtttttattaccttcttttgtgtgtgtgtgtgtgtgtgttttgtgctttttggggtttttttttgaaacagagtttcgctcttgttgcctaggctggagtgcaatggcatgatcttggctcaccacaatctccgcctagtgggttcaagtgattctcttgcctcagcctcccgagtagctgggattacagacatgcaccaccaggcctggctaattttgtc

SEQ ID NO: 617489 - DNA, 467 bp, Homo sapiens
gtaatggccggaggcgtcaatggccttgatttattacagtgaaaggatacaaaacaaaatcagcaaaggaaaaaagacacatggggtgaagtcaggcgaaactaagtgcaagcttccaagaatcctccgccagtggaatcacagaggatgagcttaattctcccagcaaccagttgtaacagcacttgtgaaacactgtcaaccagaaaagcttgttagagactgagtgcctggggtttttactgggagctggtcacaaaggtagtctctgcctggcacataccaaaattccagactcccagaaggaaagcaggtgttcaggagaaactatattgttttacagtttacgatatagtaagctactttgatcagttctgggaatggtggaagccccctgaactccaagttcccagatgccaatcaagggccaaccttgtaaagcaggtctctaaggttaagtagtcagg

SEQ ID NO: 617490 - DNA, 144 bp, Homo sapiens
gcagacttggcattaaggcttttggatagctttgtgccaattggtcgtggtcagcgtgaccttattattggtgacccacagaacttggaaaaccttaattgctttttgacacaatcattaaccagaaacggtttcaattatggg

SEQ ID NO: 617491 - DNA, 175 bp, Homo sapiens
tgtaaatgtaagcctattagaagctacacagaaggacctaatttccggaacaattacaactatgtcatcgggctaaagttaaagagattaagactaagtgccatgatgtgaccgcagtagtggaggtgaaggagatctaagtcctctctggtaacatccacggacactgtcacct

SEQ ID NO: 617492 - DNA, 256 bp, Homo sapiens
acactcacagccagtccagcgacttagagagctcgagcgctatgtgcttgccggcctacgtaagaaaccccggaagccctacaccattaagaagcctgtaggcgagacaaaggaggaactggcttgggagaaagaagcgggacttagaaaagcgggtacaagatgtcagcggcacagctcaatgctactaaaaagccccccgaagaaagcgaatgagaaaaccagagtcatcctctgcacaacttgttcgcagatt

SEQ ID NO: 617493 - DNA, 892 bp, Homo sapiens
  misc_feature (8)..(8): n is a, c, g, or t
  misc_feature (77)..(77): n is a, c, g, or t
  misc_feature (139)..(140): n is a, c, g, or t
  misc_feature (142)..(142): n is a, c, g, or t
  misc_feature (145)..(146): n is a, c, g, or t
  misc_feature (151)..(151): n is a, c, g, or t
  misc_feature (153)..(153): n is a, c, g, or t
  misc_feature (161)..(161): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (229)..(229): n is a, c, g, or t
  misc_feature (232)..(234): n is a, c, g, or t
  misc_feature (245)..(246): n is a, c, g, or t
  misc_feature (248)..(248): n is a, c, g, or t
  misc_feature (268)..(268): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (287)..(287): n is a, c, g, or t
  misc_feature (292)..(292): n is a, c, g, or t
  misc_feature (295)..(295): n is a, c, g, or t
  misc_feature (297)..(297): n is a, c, g, or t
  misc_feature (302)..(302): n is a, c, g, or t
  misc_feature (308)..(308): n is a, c, g, or t
  misc_feature (380)..(380): n is a, c, g, or t
  misc_feature (472)..(472): n is a, c, g, or t
  misc_feature (480)..(480): n is a, c, g, or t
  misc_feature (512)..(512): n is a, c, g, or t
  misc_feature (533)..(533): n is a, c, g, or t
  misc_feature (552)..(552): n is a, c, g, or t
  misc_feature (577)..(577): n is a, c, g, or t
  misc_feature (582)..(582): n is a, c, g, or t
  misc_feature (584)..(584): n is a, c, g, or t
  misc_feature (596)..(596): n is a, c, g, or t
  misc_feature (599)..(599): n is a, c, g, or t
  misc_feature (604)..(604): n is a, c, g, or t
  misc_feature (607)..(607): n is a, c, g, or t
  misc_feature (609)..(609): n is a, c, g, or t
  misc_feature (611)..(611): n is a, c, g, or t
  misc_feature (617)..(617): n is a, c, g, or t
  misc_feature (619)..(619): n is a, c, g, or t
  misc_feature (645)..(645): n is a, c, g, or t
  misc_feature (647)..(647): n is a, c, g, or t
  misc_feature (656)..(656): n is a, c, g, or t
  misc_feature (658)..(658): n is a, c, g, or t
  misc_feature (663)..(663): n is a, c, g, or t
  misc_feature (690)..(690): n is a, c, g, or t
  misc_feature (708)..(708): n is a, c, g, or t
  misc_feature (760)..(760): n is a, c, g, or t
gcgggttnccgcccctttccccctggcctccacccggggggggtgcccgtcctccgcccgcccccgccccggtctcntctggcccctccctgctgtccctctgtggccggctcgttcccgccctccccgtgcgctctgnncngcnnggccngngccccggncgccccggcgcccgtgctcccccgtcctgcccggggccccgctcgccgcccccggttngcngcncccntgnnnctcgggtcccnncngcgtcttggcggggtggggngggcggcnggntgnccggngctgnccngnggcgnggcgcncggggggaggcgcggccgtgtcccgttttcgttggccgactgtggggggggattgcctgcgtccctctgtgnccgggtggcccagccagcccgtcgtccccacccagaaccgtgttttgggccgaagccgggagaggcagggggggggggggggggcagggggnccccccgngctctccgcgcccacccgctcctccgcacacngcggctcgcacaggcctcccncctctgcctgttgattganggagggagaagcccgtccccccctntcccntntcccctcccctntcntgcangcnangngccctntnggccctccctgtccccctcctttgtntngtctccccntntggtntggaacctgtttgcaagtgaagcaatntctccgtgttttgtatanacaaccgctcttgtagcctttggtttttgttaatgtagagaaacacagattntttatacactttgtaagatttacgccaaaccccagctttcgatttttttttttccctgtggcccctggggtgttgccccgtccccgtccccccgcccgttattgaaatgtataatttgacttcctgtacaga

SEQ ID NO: 617494 - DNA, 115 bp, Homo sapiens
gtactctcaggattatgtgctcaccaccctggcaggtggtactctctcctcctaattcggtttactatttattgttcggggtgttttttaatgtgtgttgggtggagagcgggga

SEQ ID NO: 617495 - DNA, 202 bp, Homo sapiens
cgctatttccttcgcgggaaggcgtggtgctgatgggcaagaacatcatgatgcgcaaggccatccgagggcaccgtggaaaacaatcccggctctgaagaaactgctgtcctcatatccgggggaatgtgggctttgtgttcaccagggaggacctcactgagatcagggacatgttgctggtcaataaggtgccagctgc

SEQ ID NO: 617496 - DNA, 88 bp, Homo sapiens
gctggtaaatagcagttaaattgcaactgatcaagaggtattcaggatggtgagtttggactgcatggctcccttctgtcgtcttctc

SEQ ID NO: 617497 - DNA, 395 bp, Homo sapiens
agctctgatgtatgtaagcatctgtgatcaccgttaggctgagtgtcaatccctccatcattacatagggtctggagtcattagcaccatgtgttagatgctcggctacagaatgatcgctccataaggcgtgcccactaatagtacacacttccgtgggccacatccaccctacagagtaatcccaccataacagggcagctgtcatcatgtaaggactgctcacgtgcagatgggcccaagaaagtggtcttgttcttcaaagcagcatgacatgaggatcctgtgtcatccaacagatacagcttagacagatgaatagcggcttccctgggcgcaggcagtcctacaattcataatagcaaacaggccctcgtgccgaattcttgcagccc

SEQ ID NO: 617498 - DNA, 142 bp, Homo sapiens
cccacccggctcaccttctttttctcactgcgactgttccttgacactctcttaactggcttctaaaaaatatgctggtgtcgccacttgaggagttatcagtctagggcattttctatggacttcccagttgctccgacgt

SEQ ID NO: 617499 - DNA, 560 bp, Homo sapiens
gtacagtatacgaatcgagccggtaccgacatctgtatgccgtgggtctctctctacgagctgagccggccgggatgttatgcccggctgtggcggggtacctactaattgtctgttccatgcggtcccctctttgtccctttttctacagtcttgggcataaaaacacagacacaaacagcttctctgtttgtattactaaggtttatttggtgcttctccaccatcctgaaacgatgcgatggtttataagcacatgtttgggggaacgcgtaggctgtccacctctgcctctcccttgtcggccttaggccgactgtgttcttgggattttgaataagtttcgcctaaggatttactcatttgctccaccatacgctatcgcacagtggcatactcatacaggccctagattttgacatgcagaccaaatggggtctggtgaaatgctccgagtttcttgtgggtacatgggttgtgctccgcgggctctggtacagttcttagtcgatcgggcctgcacttgactagagctgttcctatctccgggctagcatcta

SEQ ID NO: 617500 - DNA, 580 bp, Homo sapiens
gctaagcggcggatgcccgataaagcgcacctgtggaaactgcgtcagggccgctgggcgcggtggcacccggagctttttggaccgggcatgcagcaccgcttcggaggtagaggtacaactgaacagggcacgtggatcgaggcagatgcgctcgacaccgcgatcgcgcaacaggcggttgagcatgcgctcagcatcacccttggcgaagaactgttcatgacgcacctccacggccagcggccgatcaatgccatcgagaaatccagccagctccgccaggcgtggcggcgtaaagctcttcgagagctgcagccacagcggtgaaacgcgctcacccaaagggctcatcaagccgacaaaactttctgccgccggcaactgttcacgcaaatcgccagcatggctgatatcgccggggaatttggcggggaagcgaaaatcatcaggcatgatttcggcccagcgctgcacagtggcggccgaggggcgagcataaaaagtggtattgccctcaacggcgttgaagacctgggaatagagcccgaggtaatcgctggaacgtgccttaacggga

SEQ ID NO: 617501 - DNA, 1244 bp, Homo sapiens
aggggaacgcagagaaaggcacaggcgagaaatccaggtcgtccgagatgaaaagtcggaaaatgtttccagagcgcgccacaaacaggcgcgcgcgcgcgctatgcagggcgcatagtctctctgtctctctctcgcacacacacaaacacactcttacatgctcacacgtcattccacgacatggagcccacgcacgcggattcctagatcgtgcagggatcgacatgcctgggcacccaaagtgaacgcagagtagagcgggagccaacggagacacaaaaactaaaaatataaaaaaatgcgacaaaacaaaaacagacacacaacaccagagtacagacaaagcaaaaacagagaaaacacgacaacaaggcagccgagacgagaaaaagcgcgaacagagcgagccccaaacgccgcagcgagcgacgaaggaaagaaagccaaagaaaagaagagaaacgaaaaacagagaaaacaagaaagacgacagcaggaagcaaacacaaacacagaaaacaaagcagacgaccacaaccaaagaccacaatccaaaaacacgcaccacacacgaaaaacaagaacaacagaacaacgaccgaaacaaacgcgcaggagagccgcgaagaaagaaaacacaagacaggcaggacagacagcagagagcaacagaacagaaacgaagcacacaaaaggaagcaaagaagagagacgaagcgaccaccaagagcagaacagaaagagagcgaagcgaacgagagagaacagaggagcaagaagcacagaagcaagaggacgcgaacagaccaagaacaagccaagcggagcacgagcgagaaagacgaaagagaacggaaacagcgacaagcgagagcaaacagaaaagcgcaacggacgagacggagaggcaacaacagaccaggcgcaccaggcagagcaggacgaacaggagacaacgggaggcgccccagaacaaaggaaagaaagaacaaaagaaagaagaaaacagaagacagcaaggaggagaagagacaaggagaaagaaaagagaaaaaaaaagaaaagacagcgagaacgagagacacagcaggacagagaaagacgaaacgagacaagggcgagacaccagaaagacgaacgagaaagcggaggaagcgaaacaacaaggagaaaaggagagaaacaaaagaaaagaaagaaacagaaagggagacaaaaaagaggagaaaagacaaacaaaa

SEQ ID NO: 617502 - DNA, 455 bp, Homo sapiens
catccccggtatgtgtggtgttctggaaagcgttgttcgaaaatgatgacctatgctaaacatcgatctcgaaggtgaagttttgcaggcagccgatgaacgctgagacgtagcatttcttacagcgcgtcgaagtaggttggagagcgcatctcgactccgtccaaattgatgaataatcgtattttcggcgttattgagtttgtttccaattaaaacaatttatggctcttcttgtgaatataggttaacctcaattaaaaaaaaacacaaaaaaatccttagacatcctaggccgaactacgcttggttagatctctttacgaagagtacgtaggcagccctcatcgggttcaaccatactcagaactacgtctgacttgattccctggtgggatacgtaggaagcctcatcggctcagtcgctacattcacatgcataacaccacacaatt

SEQ ID NO: 617503 - DNA, 148 bp, Homo sapiens
gatgcgagttacagagaggtacccctttatcacaaggagtgacctgctgacagagaggggcaggatcacaagcatgaacatcacacactatagcagcagccatgattcagaaaaattatggctgcagccacggttctttcagggtaca

SEQ ID NO: 617504 - DNA, 1192 bp, Homo sapiens
  misc_feature (524)..(524): n is a, c, g, or t
  misc_feature (560)..(561): n is a, c, g, or t
cgcggtggctcacgcctgtaatcccagcactttgggaggccgaggcaggaaaattgcttgaaccaggaggcagaggttgtagtgagccaagatcttgctactgcactccagcctgggtgacagagggagactccatttccaaaaaaaaaaagaaattaattatctcatttcgatgtagtaaaaaaaaaattttctttaacattcttcataaaatgtgattaaggctattaaatataaagcttggatgagggtgcagataattttacaaaacagctgtattttggcaaatattttattattataaatgaaaatacagagttttaaaacggcacttaatctgttctctctctcagagtctgccaaataaatcagatttcttggaaaatattcaaacttgatacaatggaggcaaaattaactcttgtcaggtaagtcatttgccataaacgaaaggacccataactgcattaagcagagagggactgactgtcaatgaagcttctctatttgcaattaatcagcanaagccgacaattttcaaaagtctctatgcaaaattnnagtcaagttcaaagtctgatcaatttaaaaagcattagtttatttttaataaatggactgccctagattgaagatatagtctgttcaccatatttatcataattaccgagaattgaaaatcctgttgcctttgtaacacttgcaatttgggaaatcttacctaaattaaaggaaagggaaggtaatttgactcttgacttccaggagaaggtaaggccccatttaaaattttcccacgaagggggaaaaaactttttcaagttggagggtcccaagaggtttacgtggcctaaccccacttattttccggatttgaaaccgtgaattggccggcccggggggttaccctcggaatccaacattttggagcgccggccaggggacccctgggctcgggattgggacacactggcacaatgggaaaggctttttctcaaaaccaaattttccgcgccatgggggcactctataacacctccttggggtttgcgggaaatattttaccccgaggcaagtttttgggcccatatatcctttactcaaccggtggtaagggaaatctcttctaaacatataaccgctcttgtgaccgtcctatagggtgggtatcgcggcggcttactaccgtcgt

SEQ ID NO: 617505 - DNA, 189 bp, Homo sapiens
cgcgtccccgaagacgactccccccgtccgcctgaactcctttggcgtctattcaaaaaaagagaaactttctatctctaattatgttgatgaattttttatatcagttatccaatgattctataacgaatcgcaattcaaaattgcattaaaattatcgaattctaaaattctctcttatactcctga

SEQ ID NO: 617506 - DNA, 177 bp, Homo sapiens
atcacttaagccaggagatcaaggctgcagtagacatcgctgcactccagcctgggcaacagagcaagatcctgcctctaaaatatatatatatatgttggtaaaagggcaaaacctgatacacatattaatgacatgggtggattcccaaaggcattatgctgaaggtcttgaaac

SEQ ID NO: 617507 - DNA, 167 bp, Homo sapiens
attgaagatctcgggacaagatctgaccgccaccattgaaaacaacctgggtcatcctgtgagattgacaatgccatgggctggctgtgtgacgacttcagtgctcaatgtatagagatatgagcgtggcccttgcgcctagagctgtgtgaggcctgtacatcaac

SEQ ID NO: 617508 - DNA, 312 bp, Homo sapiens
ctccattcatggcagaagagatgggggacgggcaacgcaaagatgacccggggaatgatctgggaccatcatccttaggttcgccatccaggacatctccggggaagagacctcggccagggaagggctccttctcgggtgccagagaaagacagccccgtataagaaggtcaaggtgcagaacttccacatcagcgggaaggatggtctggcctttcaaggccctgtgatccaccgggcacagaaccagaagcgtgatggacgtatgacaaggctgaggcaaggacgacccgtgtcaccaaccgtgaacaa

SEQ ID NO: 617509 - DNA, 488 bp, Homo sapiens
tcctaaaataacttttaaatggccctttggtgtctggggtaatctggggggtgaaaaacctcctcatttccaatcccagtttttctgggtacaccctggttttggggccggctgccgccaagggttaaaggtggttccagaactggcccccaattttgacgcgacctctagaggggcagggcacttcacacccagtgctaggctccttcgcacggattaacgaggggccactcgtttaaaagccctttcacaagagggaacgaggctcatccctgaagtggggggaaaacagcccaggaaacggccgtgaactcctcattaggcgcgagggcccacttctattaagggggcgtggggggccacaggggggaagggagcccgtgcgtcgacacacagaggcgctgtggaaggcgtccccgaatatccccccccgggtgtaaaagagcaccgcgcgataagggcctcgcccacatgaactatgaccacaa

SEQ ID NO: 617510 - DNA, 264 bp, Homo sapiens
gatttttgataagaacatctgaggccaggcgcattggctcattcctgtaatcctagcactttgggaggccgagatggtgtatcgcttgagctcaagagtttgagaccagcctgggcaacatggtgaaaccccatctctacaaaatataaaaaaattagacatagtggcttgtacctgtagtcccagctacttgggaggctgaggcagcccagctacttgagctcaggaggtgaaggttgcagtgtgagattgtgcccctgcact

SEQ ID NO: 617511 - DNA, 1338 bp, Homo sapiens
  misc_feature (266)..(266): n is a, c, g, or t
gaaatcaatagtacttccgaactcctctcgagttaactcgcaaagacctatcgctagcaacatgtagcactgcagcgcagactgcgtactaagacacgctctcgagcacatgccagggacgacgcggttttgccgaagagctctcacggaccagcactacgcgagaagcacgtggcctcgcctgcccgtatacgtcgctataccgctaatccgagggaaaagcggagtggcacgtattgtggcgcatctgatcatagaggctaatncatgcaaggaattttttgggggcgtagcattcgtccacgacgcaccagtgcagaggacatggaatacctctacacgtgttgtgagctccttcgctgagggtgaactgcgcatagacataggggtcatgaaggcagacgcatatacatgtggtgtgccacgtatgtagctgtgcttgagagacgactcgtaagggggatacacatgtactatgaaagcggtgggggttccttggcactgttttccgccatcgagcaaaaggcaaggtgctttcattccaatttaacccaaagtttcaattggacgcactttctcctgaaccaaacacgatacagcggttgaagaaggactcccgtggagcgaagttaccaagttattccacccctaagtaatctttaatcaaggcacgcccaccttccctcaatacttagtcgaaatttgggacggggaaggaaggggaaaggggattccgatttgcccaggggggcaaggcggctatgaggagttagccggaccgtactgtgcgaaggacgcgcaacagcatataatatggagttcggacgaatggaaacaccctggtctgaatttgaaagcgggggtttgcactcctttggagcttgaggacgagggtggccatatgtctggaccacaaacttgtgcctgtggagctccgtaagccgataattcgtattctcattgaagttaggtaatttgggatggaaaaaggtttgaaccccctttgccaatttcgggcgtaccaccttcgtgtactaacacaatgccggaaatgcccttcgaactttacggacttttggcatcacttttggctaaatcccagggtggcgaacattgccaaggcctagggtgcgactaacccggggggggcgcatggcagaaagagggtaacccttttgaagcttcgaactatccgcagacaggttaactgggcatggggaacccctaggcttcataagtctcgtttgagacctttcttcacgcgaagatcgacaccgcagagacgttggagagtggtacccccgaattaggacagccaggcttgaacagcacgccacg

SEQ ID NO: 617512 - DNA, 85 bp, Homo sapiens
ctcaatgctttccccaaacttcacttcgattaaaacgtctctgtggaaaccatctttcaaaacttcttgcctcaaaataatttca

SEQ ID NO: 617513 - DNA, 745 bp, Homo sapiens
  misc_feature (5)..(5): n is a, c, g, or t
  misc_feature (85)..(85): n is a, c, g, or t
  misc_feature (96)..(96): n is a, c, g, or t
  misc_feature (112)..(112): n is a, c, g, or t
  misc_feature (139)..(140): n is a, c, g, or t
  misc_feature (145)..(145): n is a, c, g, or t
  misc_feature (156)..(156): n is a, c, g, or t
  misc_feature (166)..(167): n is a, c, g, or t
  misc_feature (182)..(182): n is a, c, g, or t
  misc_feature (192)..(192): n is a, c, g, or t
  misc_feature (217)..(217): n is a, c, g, or t
  misc_feature (231)..(231): n is a, c, g, or t
  misc_feature (243)..(243): n is a, c, g, or t
  misc_feature (246)..(246): n is a, c, g, or t
  misc_feature (251)..(251): n is a, c, g, or t
  misc_feature (262)..(262): n is a, c, g, or t
  misc_feature (298)..(298): n is a, c, g, or t
  misc_feature (305)..(305): n is a, c, g, or t
  misc_feature (329)..(329): n is a, c, g, or t
  misc_feature (331)..(331): n is a, c, g, or t
  misc_feature (394)..(394): n is a, c, g, or t
  misc_feature (399)..(399): n is a, c, g, or t
  misc_feature (403)..(403): n is a, c, g, or t
  misc_feature (416)..(416): n is a, c, g, or t
  misc_feature (428)..(428): n is a, c, g, or t
  misc_feature (430)..(437): n is a, c, g, or t
  misc_feature (440)..(440): n is a, c, g, or t
  misc_feature (457)..(457): n is a, c, g, or t
  misc_feature (477)..(477): n is a, c, g, or t
  misc_feature (611)..(611): n is a, c, g, or t
  misc_feature (634)..(634): n is a, c, g, or t
  misc_feature (741)..(741): n is a, c, g, or t
ggggntataggcaaggctgtagttgggggtgtgttttgccccactctgtacaatatagaagattctcatatagatactttgtatntaagccacgtntcctcatttgtgtccncttattggctggctgggcaggggaaannggggnaaaaagaagcnggggtgtttnncccggccccggggcncccccctggnccccttcctctggctgtcccctggnggggtcgctttggntccttggtgggngcntggcncggctccagtngccgggccaccttcccggttttctctttcccccgcncccgggncggcgggcctttcaacgtcgtgcncnccccgcctcccggtgcgttgttgttggtgtgctgcttttcactggcgccctccgggctgggcntggcnggcncctcaggtccgtnttctcctccggngnnnnnnnnctncccgccaaaaccatcangtcctccggtgtcaaacgcnccccctccaggccctcctggctcccctgcttcctgctgttgcctccgctcgagggcaatgcgcagggccaagtacttggagaggtggtccactgtggcattcccagttgtcttcacatacctcgtctggcagtnttctcccttctccacgagccccnggtggggccggaacacgagctcaatttctccacctggctctggggggctgggggcccaggagggcttggggggccagcgttccccctcccagagtccctccccggtnacca

SEQ ID NO: 617514 - DNA, 626 bp, Homo sapiens
taataacattattaaaaggagcactaaaggaaaactgtgtgcccagcatcatatcctaaggcatacggaatttggggaagcccccatgccatcccgtgaggcttccgtgtacagccacccaaatggtagggaggtcttgaagcccatgagggatttatagcatcttgaatagagagctgccaaccccccgggggcagagttgcacttttcccggctttttaggaagctctgccacagatgtgatctgatcataggccattagaactggaagaaacttcccaaaatatctaggtttgtcctcattttaccaatgaggaaactaaactctgtggaagggaaggggttgcctccaaagtcaccgcttagctgggccccagtggctcatgccgataatccccagccattcagaaagctgaggccggaggattacttgaggcccagactgggccaatatagccagacccccatctctaaaaaattaggcctggtggtgcatgcctgtattcccagctactcaggaggttgaggtgggaggatcacttgagccccgaagttcaaggctgccatgagccatgattacaccccggcactaccaccttggtggcaccgtgagaacctgactctta

SEQ ID NO: 617515 - DNA, 2037 bp, Homo sapiens
  misc_feature (284)..(284): n is a, c, g, or t
  misc_feature (1920)..(1920): n is a, c, g, or t
atgttgtccgtctctctgggtgtgttctctcttctggctgctcgctgctcctcttgtgtgtgtgttagtttgcttctactcgtgtgtcggttcactcctctgcttggtgtctgtttctcccgtctttccttgggtgcggtcccacgttgtgttctttcctctctcgcatctgttctgctgtaggtgtctctctcgtgatatcatgtgttgctcttgtggtttgcctccttaggttctttggggatgtgtctgtctccccccttacagagcgctgtttgatatgngcgttgtgtgtgttttcgtcacatctttgttgtcgtgcagagtcggttgtcgctttggagctcgtgtctcccatgttatgattggggggttgttccccaccttcactcttcggggttccttggttgtgactgatcgaggcgtggctttgttcggtcgggggtattgttgttctcctgctgttgtcatcaatgagtgttgctatccccccccattggtggtggatgtaaaagagggtttcctgttgagtgtactccctcattagtgggtgtgttccctactcatggttgttgtgatgttgtcgtccctcgtcgtgttcacgtctggtgtcccccctcttgttggtggggctcctccctctggtgtgtttgttgttcagagttatattgggagtcttccccctgcttcgttgtatgttgagtaattgctgtttgttgctcttttgtggggggggggtcttcttgatgtttgttccttcctcctgctgtgtgccccccccccctggtggtgcgggactatcttcagttggcttcacacctagcggaggtgggtttcccttgtgtttgttggactgagtagtggtgttttcgtggtggggacgggagattgtttttgttgaggcggccccccactgttggatgatggtggtggtcccaaccacctgttgggatgaggtcctctcctccacaggcttgttgtggaccctccaccaagtagtggtatgtagctgcagacgcgtggtggtggtgtttgtcgtggcgtggtgtgaagtcatccctaccctgcttgtggtattaggatgaattggtgtatatgatgagctacctctccccgctggtgatatgagtaaaaggagggtgttgttgtggtgatgtgagatataatacatttagggtgttcgtccacagcaagatccggttgttgttctactacagttggtgagtaaaagcccacacagcggtggtggtggtgatgagtagcttcccacgagggtgttgtctcccacgctcccccctcacatgaagaagtgtgtggtgatgtggcgctactcacgctctcgccccgcggttatgtgtgccgttcgtgtgcggggccctcgcgtgggtgaattccctcctcccactctcgcgcgtgggtgtctcctgcgcggctcactctcgcgcggtgtcgtgtgtgtgttgtgtgtggggtgtgtggggatgtgctctcgcagatgtctctacgacgacgttttgttgtgatgtcttcacgagcggtgctctttcggcgcgctctactactctctcctcgtggtagaacacccccgacggggtgtctccgcgcgctgtgtctccactcccacgcggtgctcttctcgcgcgctctctcgcgtgcttcttttggcgcgcgcgcgtttctcgcgctctctactgtctcccacgcatgtgtggcgtatgtgtgtacgcggcgtatcgcgatccccagcgcgcgtgtcgcgccgtaccaccgcgtccacgcggggtatgagtactcaccatacgtctcgcgcccacaaagtccacaccgcaaccgtggtgtggcccacaccacgaaagatataacctacacacacatccacgtatacgtgtaggcgcgcccccaccgcgagggcgccacccncgtgggtctgccacacacacacgacctgtgtgtgtgtgtggaagaagtgggagaggtgcacacacccaatgtagtgggccccaaagtgtgacggggcccaaccgtgctccccaagaa

SEQ ID NO: 617516 - DNA, 268 bp, Homo sapiens
  misc_feature (178)..(178): n is a, c, g, or t
cggcaacagcagcaattgttggcaaaaacgggcagggggagccttgcccagggtccgttgctcgcaccttgcttggtgaagcacagccagtcacggcggcccttcggtcttggcgggcaggagaagatcacccggaccaaggaggaggcccttggagcttgatcaacggctacatccnagaagatcaagtctgggagaggaggactttgagtctctggcctcacagttcagcagagccgccccgtgtccccccaggtgctggaggcag

SEQ ID NO: 617517 - DNA, 362 bp, Homo sapiens
cgcaaggaagtgaccccccgcaccgccctgctcactaggacagaacccccagtccggcccgcagactacctagctacagcttccacacccctggtggaccgacgggggagatcctagctcccaggagggatcacatctcacgcagctccttggcctcaaaccctaccagctcctacaaatgcacggataccaggcccatgtggggccagagcctcctgccgcccgtgtccacctctaatcaccacgggtgggctgcggataccccttccccaggaactgcggggaggagatacagaacggagccggtgcctccaggaccaggaacatcttcctcaacggcaaccgagagcggtccctgatcg

SEQ ID NO: 617518 - DNA, 117 bp, Homo sapiens
ccccccttccccccctttcccccccttttccttccttccttcctttccttggggccctgagccccctttggaaggtttagagaaacccaaatttaaaaaagaaaaaaagagggggga

SEQ ID NO: 617519 - DNA, 431 bp, Homo sapiens
  misc_feature (280)..(280): n is a, c, g, or t
  misc_feature (404)..(404): n is a, c, g, or t
ctacatattaaaaacggtttgccgtcagaaacctatattacttgcgcagaagccaacgaaatggcaaaaactgacagcgcacaggttgcagaaattgttgcggtaatgggtaatgccagcgttgccagccgtgatttaaaaattgagcaatctccggaactgagcgccaaagtggtagaaaaactgaatcaggtttgcgctaaagacccgcaaatgctgttgatcacggcaattgatgacaccatgcgtgctatcggcaaaaaataatatttcatatgtnccgcgtcgatgaatacgacgcggttttttagctaacggcgggatcagaacttatatttcaggcccaccatcactgcggtgtcattgtagcattatcacccagctgcacgcccacattcccaganggtggccgctggattcaggttccattt

SEQ ID NO: 617520 - DNA, 269 bp, Homo sapiens
ctgactctagcaggatctcacccgactagcccgacaggaccccattcatgcccaggtgtttcggaagtccacggcttgtggtgcccaggagaagggttgaagcgtggtggggcccactccccccacctggagtggcattgggcccacagctgcccatctctgggcctcaggtggaccagtggatctctaagggtctgctgtgccctttctatgcgtcctccacatcctatgatgtgcctgcttgttggctgctgtcgggctagtcgggg

SEQ ID NO: 617521 - DNA, 410 bp, Homo sapiens
tggcttggacccggcccagggctggcctctgtggcatggagtcactccagaggatcggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccg

SEQ ID NO: 617522 - DNA, 463 bp, Homo sapiens
  misc_feature (181)..(181): n is a, c, g, or t
  misc_feature (268)..(268): n is a, c, g, or t
  misc_feature (307)..(307): n is a, c, g, or t
  misc_feature (404)..(404): n is a, c, g, or t
  misc_feature (453)..(453): n is a, c, g, or t
aagcgcattcttcttccagggggcctattcttggactgcttttccttaatagagaaatctctctgagccaaaaatcgggcctcccccaaattccaatcttgtcggccccaactttttctgctccggagatttccaaagccaagtccccacttccttcctttcaagccaagttcgggcccgnacccggcgcccggcagggccagccctctcctccttcctgcgtggcgcagcacaggccctgagcgcgcgaccccaggccctggcgccnccgcgcatgctcgcggctggaagccccagtttgcgtggncttcgggttattccgctcaagagccgccgcgtcgccccatctcggcgcgaatctgaaagcgctttcgggggagaagatgttgggggcactggtatgnatgctggtagccggcttcctgctggcgtgccgccgaagcttggccgcgnagccccgaag

SEQ ID NO: 617523 - DNA, 263 bp, Homo sapiens
tgagccggcaccgctctcgtgagactcatccagataggaaatttctccttggcttttctgttctgggcccaggccacctgccgttgcagtggattttagccatatcattattttctgctgctcttagggtcaacagcaccctcagcactagacgcaaacatacaaccacacagctctcgcctgccccggaagattgctgggtaagttaaacagacgataaaatgcagacttcaaatatgtcagggtggaagcatttataattc

SEQ ID NO: 617524 - DNA, 348 bp, Homo sapiens
tgccagcagtggaattccacccttatttcacaggtataaacccccatttggcttccatatgggataccctctggttggcgggtaagatatagaatgtcccaaactggtaaactggtcagccatgtcaagttgtaaagcatcttgtaaatgacctgtaagatagccactgtggtgttccaagcatagagagtaaagtctcaggagaaatttaagaatggaaggcatacatgggtgataaaagtttcatctgttctgacgaattataaggtaaagaagtgtagatatcaatgaacgccagtgtggaaaacttacgcatcatatgtagagccatgataaggtggttctcag

SEQ ID NO: 617525 - DNA, 130 bp, Homo sapiens
  misc_feature (62)..(62): n is a, c, g, or t
ccggtgctgggagcgggatctcacttatctctgtgcagcttgtcctttcctttgtctgcgcnccttcggtctctgcatcgtccacactcctctttgctcctcagctctccctttccaacgactatctctt

SEQ ID NO: 617526 - DNA, 216 bp, Homo sapiens
gtgtatatattgtattgagattgctcggggaaataggttatgtgatcagagagtagaggtataggatgagtgggaagaagaaagaggagggaagttcgcctacaccgggtccatctgcggggtcagctgggggctgctgtatgtcttggctgcctgagacgaagaaaggtgacataggacttcatagccaaaccaggcacgtagacgattaggccc

SEQ ID NO: 617527 - DNA, 163 bp, Homo sapiens
gagccggtaccggcatgtgctgtaggcagcgagtaggtgaagtagggcaggcctcccgaagtgctgggattacaggtgtgagccaccgggcctggccattgcttgttattttctttttcttttctttcttttttttttgagatgcgctggcctacagcacatg

SEQ ID NO: 617528 - DNA, 724 bp, Homo sapiens
gccgacggacggagcgccccgcccccgaccggacagccgcccgccgcgccatgccctggggcagcagccacaacgcactgaagctgcgcttcccggccgaggacgagttccccagactgagcgcccacaacaacacatggccaaggtgctgaccccacgagactgtacgcggagctgcgcgccaagagcacgccgagctggctcgggctgtgacgacgtcatccagacaggcgtggacaacccgggccaccgtacatcatgaccgtgggctgcgtggcgggcgacgaggagtcctacgaagtgttcaaggatctcgttcgagcccatcatcgaggaccggcacggcgggtacaagcccagcgatgagcacaagaacgagcatcaaccccgacaacctgcagggcgggaaagacctggagcccaatacgtgctgagctcgcgggtgcagcacgggccggagacatccgtgggcttcatgcctaccccaccggactagcagcccgggggagaagccagagcaattcgaagaaagctcgcaggatggaaaggccacctgtacaagactgggacgggggacacatggggtggacgaatactacgatgcacaagaaccatgaagtgagtgggaaagaaacagatcagtcgaagacaaatacctcattaagaaaaggcggttttgccattttgtggacctaggaattgccaggagttggcgaagccgaga

SEQ ID NO: 617529 - DNA, 156 bp, Homo sapiens
acgtccatcactgtggtatcagtagttcttgtcacagtcatatatattcaccaacaacagtaaaaacccaggaaaaaaaatagaaacctagcggttgctgacactggagaggctactctcttgtcttccgtgcaggaattcccagcgttctcagca

SEQ ID NO: 617530 - DNA, 204 bp, Homo sapiens
acctctgagcgagtccacaaacacattaaacagctctcctcgtcctactctccaatttccaaagccagtgagtctcagttcccagtaacgttacctagaaatacacatacttcgttactcgtcttcatgttcacaaggtttacttaacagttaatttaggatacctgtcaaagctgtccaggcttatagacgtatggggaaaca

SEQ ID NO: 617531 - DNA, 298 bp, Homo sapiens
ggctagttttagaagtttgaatatcaaattacaggaacaggcagagaagacagaacaacattaagaacatgtacttgcatgtaggacaactcagttagaaaagtatagtgaactggatggaatctactggtatgataaaacctgctacaaacaccagtttagttgccatcaagtaagaaatttactggttttaagaaaaatccaaatgctggcatagtccacgaaaaatttaacaggtttactttactaattattataaggttgaaccgctgatgctattgaaacttctaaaactagg

SEQ ID NO: 617532 - DNA, 181 bp, Homo sapiens
  misc_feature (34)..(34): n is a, c, g, or t
catcctgggccctggccgatgtgcatatcaacanaaaaaagggactgaagaacatcggccatatcatccacacaagccaaatctcacacctttactttaaaccgcttaatgaatttcatgaccttgagggctaaagatcgttcttcgggcaagagcttttggactgtttttagaacagaat

SEQ ID NO: 617533 - DNA, 142 bp, Homo sapiens
gacatggtacggcatgtgcaagtggtttgctggggacgacgtccccgagccgtgttccttcctactgcgggcgcccagacacagggctgctaagtaggctaaggccagaggatctcactggggcgacgagcccagagcaagt

SEQ ID NO: 617534 - DNA, 151 bp, Homo sapiens
tagtgcaagtacctatggcaagagcattgacctagtacaataacacttgatcagaatgtcatgaacatcaaccaccaaggaagggatgggcacactggatacactctgcttgctaccacggtaaccttcgactggtacggtcaactggata

SEQ ID NO: 617535 - DNA, 848 bp, Homo sapiens
taggggatagtgtggggttttatcacgctactcagaacagtgtgcaatttaaaacaagaatcgtttatttctggaattttccatttaatattttccaaccacaattgaccggaggtaactggaactgcagaaaacaaaactattgttaaggggagactacctgtaatgtacttttcaaaggtacatacagaaacagtgtagtggggctggcaacaagagcaccagtataatctaccttagcctgtggaggccaaaaggaaggtcccccacacagttcacgcctcactccccaacaacatgggtagttccgggtcacacaaggcaccaaggtccctcggagcaccataaactgggagcctgacctaacacaattctgggcactgcaggggcctaacacattccctaagccctgtggtgaaaccttggcccaacttgggcaggcaagcaacacggcccggctcgaaggaatggcacaggcaactctaactcctggacacccctgggccaccggcggccgtccacacaggaccccagggacccctccggcaacacaggggacaccaacaacgacaacctcacaacagggcaaacgcaactcaaaaacggaacaaaattggccaccaggaacaaaggtcggcatatggacaatccacaggaaaaaaacgaatggatctccaaacggcgacagagccaataccccccaagtgccacacacaggaactacggacggaacacatgtcgaaagacattaccccacaccacacacacccaccccataatacaccgtactacaacgaaaggcacacccaggacacaccgcataatcaacacatcaacaaaacatccca

SEQ ID NO: 617536 - DNA, 91 bp, Homo sapiens
tggcccgagcctcaaaagcaggggcaatgttttttgtatgttttattgggcctaggaccctgtaaatggtcaataaatatttattggggga

SEQ ID NO: 617537 - DNA, 357 bp, Homo sapiens
aacggcatgttactacccagtgacaaacgcttcgcgcagttcatccacgtgaacaaactgctggagcagatgagcctgaatgtcatcggcaaatcagcgctctgagtgcaactacaaggaaccctcatgcccaagaccaccctgttcgacctcgatggcaagattgcgtttgtttccggcgccagccgtggcatcggtgaagccatcgccaagttgctggcccagcaaggcgcccatgtgatttgtctccatgccgcaatgctggatgggttgccagcatgtggccgatgcgatcatcgccgagggcggcaaagccacggccattgcctgccatattggagaaatggagcagatcac

SEQ ID NO: 617538 - DNA, 199 bp, Homo sapiens
acgtaccgagccgtcgtcgcggtgcttgagcttgaaggcgagatagccgatgccgccgaggcggtggaccgcatcacggtggcgctgacgaacgcgagattcagcagcagcgatgccatcaatagcagcctgatcggacgcatgaccgactctccctgtgagcggaggttggggggccgatctcccgccggtgccgggc

SEQ ID NO: 617539 - DNA, 172 bp, Homo sapiens
cgactctacaggatccttcaaacaccgcaatctcgggaggatcacttgagctcaggagtttgagaccatcctgggcaacatagtgagactggtctcttgaaaaaaaaaagtggctggcacttgtagcagagaattttatctacttctcaacctggttcagaatacccatttg

SEQ ID NO: 617540 - DNA, 148 bp, Homo sapiens
gtctccatgttggtaaggctggtatcgaactcccgacctcaggtgatccacccacctcagtctcccaaggtactaggttacaggggttacacccgacgcccggcggaggaaaaatttatgtgttaaatgtggctgggttgccaccatg

SEQ ID NO: 617541 - DNA, 176 bp, Homo sapiens
acgcgacgcataaaaattgatacgtaatgaaaaaaaccactttcagtggggcactgcagcttcccacaatctgagttgggatcctggcccccaacctgaacatcgtcttgaagacatggaacaggctctcagcccttctgttttcaaggccatcatggagaaactggagatgttca

SEQ ID NO: 617542 - DNA, 1514 bp, Homo sapiens
tcccttctaacactgttatttgggaggcttctttcgtggtggatttgtgagaaagttatacttcttgagtgtgtttatattaaagtttttttctccaaaagttaaaaaaaaaaaaaaaaaaaaaaaaaaaaaaaaaaaaagaaaaaaaaaaaaaaaaaaaaaaaaaaaaaaaaaaaaaaaaaagaagaagaaagagagagaaaaagagaaagaaaagaagaagataacaaggaggagaggcagaggacaaagaacacgggccccacaaaggagagcgaggacgcaacaaacgcggaagacgcgggaacacaaacatcaataacaacaaaacaaaacgcacaaccaaaaaacaccaaaataataaaaaatacatataatcactttacacaaacactaaaaacacaaatttataatcaccacaaaacatcatcaaacaaaaaaaaaacaatcatcatatacataacaacatcgccgcaaagacatacaaagatgaacagaagctaagaaaatgaagaaaaataagaggcaacagtaagaaacagacacacaaaaaagagacaaaaaacaaaagacacagcaagaaaaaaaacataggaacgaagaacaaagatacacaaacaagagcgcaagaaaaacacctgaccagctggcagcccaagcagcaaacgaggaaaccaaccgcaaaaaaacagaagatgagagagaacaaagaaaaaccgaagcaaagaaagaaaagagaaacgaaaaaacacaaaagcagacagacagcaggaagacaaaaaacgcggacacctacgagagcagaatgagaggaggagaccaagagaggagaagcacaagcagagcaggagagcacacggagagcaaaaggagacaaaaaagagaccgaagacatcgcgaagcgcaagcaagacagggaggagcaagcagggaacgcagggcaagaacgagccgagcagcagaaggaagcagagaatacaactaggacgacgacacacacgccgcacgaggaacaaacaacagaagaagaaagcgaacagacgaaatccagaagaagaagacaaaccagaccacgagccagaagcgcggaaccacagagagcaggagacacacaaagacggagacagcgcaccagccaacaggagaaaaacagaggaggaagacgagcgcaaacaagaagaacacaggacgacgaaaaaccaacgagagaacggcgacgtaacacaacaagaacaacagaagaagacacaaaaccagaacaagacccagcacagaaaagacgacacaaagagaagaccacgaaacaaaaagcgacgagcgcaagagagaaaagagaacaacagccaagcgaaaagcgataaaaaagaagcacagacgaaacaacacaaaggacaagacagcaaagagagcgccgaaccaacagacggaaccagaatgagcgagacagaagacaaacgaaagcagtcacagagcaaacaaagaacacaagagacacacaaagcacacagaacacg

SEQ ID NO: 617543 - DNA, 321 bp, Homo sapiens
acctccataatgtgtgcccaggctaaatattttcaaacagagcattaaaacttttatttagtggccaatacttacttagagagatacatcttatatggatacatagttctatatagggaatacttatttaaaaaactcatagatcaataatgaaagtgtaatggcacctggatgcggtgtctcaagcttgcaatcccagcactttgggaggccgaggcggatggatcagttgagctcaggaatgtgagaccagcctgggcaatgtggcaaaaccccgcctctacaaaaaatacaaaaactaggtgggcacacattatggag

SEQ ID NO: 617544 - DNA, 124 bp, Homo sapiens
gataatacaacattttttaactctcatttgataacctactactaatcactagtaccacatatgggtaatgaccacaatttactgtgtgtttattgcacatccaatatcttgatctatagtctcc

SEQ ID NO: 617545 - DNA, 592 bp, Homo sapiens
cattgatctatctaaacccggtggggagaattatccccacattgtctcatggaaagactcaacttgcaactgtgccctccacactatccttacttctgtctccactctgataccagagtgcagccatgcagacggttattccagctctggtcacccgactcctttcaccaaattgctcctaactggaagatctcactttccccttgtggggtaggaaccgaatgccagtgggagggatgtgcccctgaccacttaacgactgttttttttttttttttttttaaaaaagtggagtttgtctggggcggaacatgcacccaatgtgtgaaacagacaaaatttgctttacaccttgttaggtgtaaaggtggccactagtgaactccctagtgttttgaaaggagggaggcaggcgttgcgtttcagccacaaaatgtggggccttatggaagacagcaggagctcatttcctctgcactatttgggctgttagcacctgtgttgtgtgtttaaaaaaagagaagtcagtgctccacttttggtatttaacatattaacaaatgattccactgcaacaaaaaaacacaaaaag

SEQ ID NO: 617546 - DNA, 357 bp, Homo sapiens
cggggtgaaatgtactgtatgtgcaggatacttttattgggaatgaaaaaaaataagagaactattccaaccctttgtaattttgcttttaaaaggtagtttatttctgtggtctgtgagagcaacagtgttgaggaaagttacttctgaaagctactaaagtttcttcctctttttcttcttcttctttttcttttcttttcagatagagattttttataaacatcacactgcagaacctttatttaccttttgaaaaacacataaaaactattgttggataatgttatcttttgagaactttctgaccccaaagctatacatgccatatatacagattaataaaagtttaaagca

SEQ ID NO: 617547 - DNA, 371 bp, Homo sapiens
  misc_feature (101)..(101): n is a, c, g, or t
ctgatcaccaccgggactgggctgctggcacgtgctggccatatatcttcacatgcacaggtgctccccgtctcttgggcacgaatgaaatccccacgtgnccattacgcagccgcttcagcaaacagggctcctcccgggccgatgtgcgggaccaccagtggccgtcagcaggctgaagatccgtctctgaagatgttgatggggattgtcgggagcaggagccgacctatagggtggggacatacgcattggcagtcgtcaccgtgtaacccgaagcagtgaacgggctggctgggaccgtgctggtccattgtaccttgactacgactgctggtagtcccccgggcagcacaaggcaaggtagggac

SEQ ID NO: 617548 - DNA, 208 bp, Homo sapiens
atgtgacatggcttgagatgattgacaagcaactgttctgagtatctgatacagcaggatgttcagcagtaaggacagagtagcagacttcaacaggcctgaggcatccttgctccttcagtcctgggacaatcagggccgctgacctgctttatgaagggtccagagctaaaggttggtccccggtggtgggccagaatccaagccg

SEQ ID NO: 617549 - DNA, 697 bp, Homo sapiens
  misc_feature (567)..(568): n is a, c, g, or t
  misc_feature (690)..(690): n is a, c, g, or t
ccaatgacgcaggcctgattttggcgcggtttgcgagaattagccgatcaccgcacagcgagctggaccgattgcacaatgtcatgaagatcaagatactcttggatcaactagatctggtccgtgtctatgaataaatcaacgtgcatcggtatctttctagtaccctctgtaaagcatagccgactggtgatcatgcgagagcatgagcagacacgtgtccatgagcgaaccaggatcctgctatcagttggtatcagctacaacagtgttcacgtgaatgagggtaacaatggcaacttgcaggtggacacatcatctgctaggacagtgaccttggcatgctgtacaacgatctgtgcgcatggtatacttgagtcaacagatcgtccatgctgacgcgaggccctgtagggagacgggccactacggttctggggtgcgaggcttcagcagttctatcaaaggcagctgcaatcgtttcaccgaatttcgactaatatgcttatcagactgtcacggatcgaagatgcggttaacctcagcaatggaatgatacttgagatnnagggcaagtgttggcacggatcaagtttggaagaattagatcaaggccattaatgtgaacaatttccctggccacctatgtagcgacaaggcttgtaacccaaatggttgcttcgatcggcncccctcc

SEQ ID NO: 617550 - DNA, 342 bp, Homo sapiens
  misc_feature (43)..(43): n is a, c, g, or t
  misc_feature (107)..(107): n is a, c, g, or t
  misc_feature (130)..(130): n is a, c, g, or t
  misc_feature (148)..(148): n is a, c, g, or t
ggcacgcaatcactagcaagctctcaggcctggcatcatggtncattttactgctgaggagaaggcctgccgtcactagccttggagcaagatgaatttggaagagnctggaggtaaagccttggccaanactcctcgttttaccctnacccagagattttttgacagctttgaaacctgtcgtctcctctgccatcctgggcaacccaaggtcaaggccatgcaagaaggtgctgacttcctttgagatgctattaaaacatgacacctaagccgctttgctagctgagtagctgcactgtgcagctgcatgtgatctgagactcagctctggtacgtatg

SEQ ID NO: 617551 - DNA, 802 bp, Homo sapiens
  misc_feature (268)..(268): n is a, c, g, or t
agcgggggcggggggcgccagggcgcgcagcggtgaggaccgtgggcacgagctcggcgccaaccaccgcgggactgcccagccagccccgcggcggggcaaccgcaggagcccctgggcctgtggtgcggggcgtgtcatgctgggcacatgcctggggcgcagtaggaaggccctcaggtggaaagctaggcggaggacagttatgagacatctaacggacattccgcatgatggttctgggacacggagggccgttcgtcggcangtagatccttggacagaagataagaggacgcagaacgcggatggccatcaaagtgctttgccacaggaggccctgtgagggcaaggacaggcgaagcatggatgaactgacgatggctgatcctggactgagaatcgagtcactcactaacattgttggccctggatgacattctattgagagtgggggcctactctctactcgtcatctgtagcacggtaggtagtcgtcatggggagctcttaggactcgtcttgtggaagaaggctactgacactggagcgggactgcctagccaggctcatcgttccaggtgcgtggatgctgtgaccataccgtgcatgacctgggacattgtatcaccgggagtctcagaggccatgagaatctagcgtgtacgtacgagccctggtatgaaagaactccacagacatcaattgatctctcgacgtttggccctcttccacgattgggagggaccctgggcaggtgtgctctccaacggcgtgtggaaactccgggatacgtggccct

SEQ ID NO: 617552 - DNA, 126 bp, Homo sapiens
gattgctgcaaccttggaaaataagcaaccaacacagaccatttaaccacggtactctacctccagcttgctatttgttcaaggtttcagaccttggggaaaccaattttctgcctgcagaactga

SEQ ID NO: 617553 - DNA, 337 bp, Homo sapiens
gggcccttggcgctgacgatacccccccccaccgaatggtcgaagccgaacggcgaaccgatggccagtacccactcacccaccttgagcttctcgcaatcacccagcttcacgatcggcaggttcttgccctcgaccttcagcagggccacgtcggtacgcgggtcggtgccgaccaatttggcctgcagctcgctgcggaccgacaggcagacgatgatctcgtcggcgtccgcgaccatcgggttgttggtcagcacgtagccttcactggcaaatgataagcccgagcccagggactgcgcctcgcgctggacgacaccgtgtggggagctct

SEQ ID NO: 617554 - DNA, 340 bp, Homo sapiens
ccactggtgccaggagtcgtaacagcctgggcaagtgaggatataccgtctctgcacaaatttagaaaggtgggtcgggcatggtggcttgtccatgtggtctcggctgctggggaggctgaggtgggaggatcgcttgagcctgggaatctgaggcaacagtgggctataatggtgccactgaatcctagcctgggtgacagtgagaccctgtctctaaaatgaaataaaataaaaatccagctataagagagacatctgaaatatatgaagatgttgaaagtaaaacaatatgaagccacttatgcacctatgcaaattcttggatgtcgggaggcga

SEQ ID NO: 617555 - DNA, 868 bp, Homo sapiens
agcggagtcgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctttgctcctcctggagccggtcgggaactgctgcctgccgccatcatgtctactgcaaatcctgaaactccaaactcaaccatctccagagaggccagcacccagtcctcatcagctgcaaccagccaaggctatattttaccagaaggcaaaatcatgccaaacactgttttcgttggaggaacttgatgttaggatggatgaaactgagattagaagcttctttgctagatatggttcagtgaaagaagtgaagataatcactgatcgaactggtgtgtccaaaggctactggatccgtcttcatttcctaatgaccgtggcatgctgcccgaagatacgtagaatcacagatacacatttccatggtacaaagcctgaacgctgggccctgcaatcaggaaacaaacattcatgtgccttatcatgtgcagccacgtcctttggctcctaattcatcctcctccaccacagtcccagaatgtctggactaatccaaacactgaaacttatatgcaagccacaacacgatgcaatcctataactcagcactgtccaggcctatcctactttacccaaattcacagttcaggtcatcactggatatccagttgcctgtatataaatgatccagaaagccaccacagctggcctgtaggggacccaacgaccagctcgccccccgcccaca

SEQ ID NO: 617556 - DNA, 186 bp, Homo sapiens
ggcgttcatgttgccatcctaaaagcaccccagttctctctaaggagactggcccagtcctctcccaagtccacacagggtagatgatagcatgcttccgtgtcacacttatgtaatgcaaaatttttttactcttcgccttaatacttttttttttttttttttttttccctggggggtgggctt

SEQ ID NO: 617557 - DNA, 122 bp, Homo sapiens
tcggtctgagtaactggttgatagagcgagactccatctcaataaaaaaaatgaaactacagttgattttttcggcgttcactgggtaccagtgaacacaaaaattcaactgtatattccct

SEQ ID NO: 617558 - DNA, 287 bp, Homo sapiens
atactatcatgggatagacctccctgtacttctagtacccattatcctgatgtctacctgacttgggaaatctttgtcaaagctaggagtatattactacgggtactcacctccctataaaaggggagcataccctgtggtacttcctccctcaaagaggtgacattatagggtaataccttgggagaccccaggaaatgagatgcaattagccgtgggctagtggagagacaggggctcttggacttactatagattgaacttgtaggtctgagccatcatgggca

SEQ ID NO: 617559 - DNA, 989 bp, Homo sapiens
ggccgcacccgccgcggacggagcccatgctgcggggcgaacctgcgcgcccccgccccctgccccggcccggcctcggccccggccctggacccggggcagtcgcgcctgtgaacggctggggcaggagacccgtgataggaggaccccgggaacgcaggacccatgaacgagcgaaagacggacatatcacgctggctggctggtggatgcgcacggaaggatagtgtagcacagagatgagatgtagcataacaaatagaataagagaaaaaataaagaaggagagaatgaagaacacaaacatataggaggcaataacatacagagaaaaacaagatgtgtcatatgatgagagaagaagatgaatgagtcggagcaacaataccatggaaataagacagcacgagacacaacgccaatggaagcatacaatgaaacgcactgacgagacaaacacaagataacgaaagacgacaaacacagaaacaaagagagacctatactactaagcatgatggactagatacgaggcacaatacacagacaagcacaagcacaacgatcaatctaagcgacagagaacacaacaaaacaacagccacaacaaccacgccgaaacaacaaagcaccacccacaacacagcacaaccaagcagaaaggacacaagactacagcaacaactagccccacaactgagatgaacatcgcacggatgagaaacacgacaagactgatacaccgaactagaaacaacaacacggccaaggatgcaacgacaaaaacaatacaaaaaacaggaatccaaaggagaaacaccacaacatacacaacccatagacacgacaacacccacaataacacgcaaaatagacacacacaaaaaagcaaaataaagcaaggcacaacaaggacaacgacgacacagcgccagaaacaacaccccaaaccccagatatagagagagggcaaaggaaataaaagctcg

SEQ ID NO: 617560 - DNA, 316 bp, Homo sapiens
ttttttttttttcagtaaaaacgggttttctccaccttggtcaggctgttctcaaacttcccacctcaggtgatccgcccgcctcgtcctcccaaagcgctgggattacaggtgtaagccagcatgcccggccttttttcaaatcatttgtaaagttaaggtctccctgttgcccaggctgatcttgaattcctgggctcaagcaatcctcctgcattggcctcccaaagtgttggaagtacaggcataacccactgtgccccggcattagcctgttattattaagaggaatcttatgctgtcaactaaacatatt

SEQ ID NO: 617561 - DNA, 325 bp, Homo sapiens
  misc_feature (38)..(38): n is a, c, g, or t
  misc_feature (71)..(71): n is a, c, g, or t
  misc_feature (96)..(96): n is a, c, g, or t
  misc_feature (198)..(198): n is a, c, g, or t
  misc_feature (223)..(223): n is a, c, g, or t
  misc_feature (227)..(227): n is a, c, g, or t
tcgatctagaggatcccgttggtcgatcactgtactangcgcgacggcgcgcgtgggggggattgagggantgcatcggacgcgcattgtagcggngcgatgtcgcagccacatcggcgataatgcgccaccgctccggttcgcgtgccccgccgatggccaaactgtatttctactattcggcgatgaacgccggcnagaccacgaccttgctgcagtcggngcanaactatcgcgagcgcggcatgcgggtggtcatcctgacgccgaagctggaccaccgcgccggcagtggagtacagtgatcgaccagggtacctgagct

SEQ ID NO: 617562 - DNA, 161 bp, Homo sapiens
agacaaacctcatatgcagacttatgaagttgaccttaataaatgtggccccatggttattgggatgctttaatcaagattaagaatgaggttgactctactttgaccttccgaggatcatgcagagagggcatctgtggctcttgtgcaatgaacatcaa

SEQ ID NO: 617563 - DNA, 402 bp, Homo sapiens
ccgctcgacatagagtttagctcttactgcacaggctggagtgccgcctcccaggttcaagcgattctcctgcctcagcctcccgagtagctgggattacaggcacccgccaccacacccagctaattttgtacctttagtagagacggggtttcttcatgttggtcaggcttgtctcgaactcccaacctcaggtggtccacccaccttggcctcccaaagtgctgggattacaggcgtgacgaccacacctggccacactggtttaaaacttaacacagtctgggagcagtggctcacgtctgtaatcctaatactttcagaggctgaagtgagtgaatcacctgcggtcgggagttggagaccagcctgaccaacatggagaaaccccatctgtcgacg

SEQ ID NO: 617564 - DNA, 372 bp, Homo sapiens
cgcgtcgaccccgtcctgtggtctgcctcagtttgcctctgtctctctctgtctctgcctctgcctctctctgtctctgtctctgtctctctctgcctctgtctctgtctctgcttctgtctctgcctctgtctctctgtctgtctctgcctctgtctctgcctctgtctctctctgcctctgtctctgtctctgtctgactctgcctgtctctctctgcctctgtctctctctgtctctctctgcctgtctctgtctctctgcctctgtctctctgtatctctctgcctgtctctgtctctctgtctctgtctctgcctgtgtctctctctgccgtcgacccggccgcgaatttagtagtagtagtcgacc

SEQ ID NO: 617565 - DNA, 352 bp, Homo sapiens
tcctgtaccctctctctcggaatctgaagagccagatttaggccgggcaaaggggctcacccctataatcccaggactttgggaggccaaggcaggaggatcacttgagtccagaaattcaagacccgcctgggcatcataatgagaccccatctctacaacaaaatttaataaattagctgggcacagtgttcacacctgtagtcccggccactcggggctgaggcaggaggatcactggaacctgggaggttgccactgcagtgaactgtgtttgcaccactgcactccagcctgggcaacagagtaagactctgtctcaacacaactatgaaaaagaagagagaaacag

SEQ ID NO: 617566 - DNA, 313 bp, Homo sapiens
  misc_feature (7)..(7): n is a, c, g, or t
  misc_feature (87)..(87): n is a, c, g, or t
  misc_feature (100)..(100): n is a, c, g, or t
  misc_feature (114)..(114): n is a, c, g, or t
  misc_feature (168)..(168): n is a, c, g, or t
  misc_feature (191)..(191): n is a, c, g, or t
acacagnggccctactgaataaataagataaaggacggccgacacggtgctcacgcctgtaatcccgcatttgggaggccaggcagncggatccacaagntcaggagatcaagnccatcctggctaacatggtgaaaccctgtctctactaaatatagaaaaaatcanccaggggtggtggcaggtgcctntagtcccagctactcgggaggctgaggcacgagaatggcgtgaacgtgggaggcggagcttgcagtgagccaagatcgtgcaaccgcactccagcctgggcaacaaagcgagactctgtctc

SEQ ID NO: 617567 - DNA, 809 bp, Homo sapiens
  misc_feature (156)..(156): n is a, c, g, or t
ttcaattcttggaggctccctcgggcacctccggtaccgctgctgccaccgtggcccccgctgggtgggttgaggaggatttgggacaagctatctacaactgcaggttctgctattcagctatattctgccccaagcgcaacacagtgcactacntggacttcttggtgtgcgtactttcagtacacgaaatggcttgttggattctatggatacctggatgttgggtcacaacgaatccgggtgaagctactcacgtgggttgtagcgctacgtgcctcctgtggaacgtggcacgtgccggatctggcagcgcatttaactacacacgcacgcgaggcatgtcatacaccttagcgattagaggcttggtacctcctctcagggtcgagacccctcacaccacaagtcgtacctgagcccgagtccgagacccacgtcgtgagtcaacaattactgcagaggtcgcctctcttgcttggctccaaacgccctgtctggagtacgtattgagaagagtatgcctatttttaggcgaaagagtcggagaatctaacgtggcttggccatttgctgtgtggcacaccacgtgtaaaacacgcggtcattgtccaagcaactaaatattcccagccagtgggaattcacacaagaaaaatccccttttgccgatcttagggctagtaaggtctatagttgcattgccctagttaatcacatgatgtacctgatggggctcgtggtgaccaagtttttcaacgaaagaaaggaatgcagagattgcgaagcccaataacaacggttgggta

SEQ ID NO: 617568 - DNA, 1116 bp, Homo sapiens
agcgggcttcccattcgccatgcgccggggggtgagtgcccgaaggttgcatgatggaattgaacatgacttcaagaggttgggtatacgggatgagttaatcgggtgatgtcctctgctgactgtgttcttcggatgcattgttaggtgtgctacttgagggattaatatgcacaagagatcacaccatggactacaaggaaaggtgccccaagatgtaagaattccccagctccagatgaacacagagagaatagaagaagaggttgactgtgttataaagttcatggttgtcagtgggaagaagtgaagtggcttgtcttcaggagatatgcagagttggataaactttataagaatttgaaaacaaacagattatcctgctatggcccgtgcaagactatcctgccacagacgacaatacactccggtgctacatcttgatccagatgtcgatttacacgaaagacgagccagcgactaaaaactgaaatagcattccagcaagctacggttaggtatcacaggaacgtctgcattaatcccatcccagaatgctcacgaggcactaccctgtcaacaagtgggcacaaggtcgcacagagagcagcccacgttacagaaataccagtcctgaacggattgcacggcactggagcacgcgtaacggtaccctcaagccacaggcgtcacaacctcacttaaacatctagacagcaaacacttcgaaccacttggtggcaccctgttcctggcaaactccagctccagtggccccaacacacccccaaaccaatcgccccgccgcatggacatcccccgcaacaaaaacgatcaaatcagggaacagcacagggcacgcccatcacggcgcaaagggactccctccccactgggccaaacaacgggccaccacaggcgacatgggaccgccagacagacaagccaaggaccgaaaaaggggaacgcaggaaaacacaacaagatacctacaaaccacacaagacacgccacgaaccatacgataacaagggccacagaacgacaatcaggagcaccaacgcacacaaacaaccacaacccactcccgcagaaggtgaggagaccgacacacca

SEQ ID NO: 617569 - DNA, 443 bp, Homo sapiens
  misc_feature (15)..(15): n is a, c, g, or t
  misc_feature (95)..(95): n is a, c, g, or t
  misc_feature (162)..(162): n is a, c, g, or t
  misc_feature (165)..(165): n is a, c, g, or t
  misc_feature (177)..(177): n is a, c, g, or t
  misc_feature (182)..(182): n is a, c, g, or t
  misc_feature (200)..(200): n is a, c, g, or t
  misc_feature (217)..(217): n is a, c, g, or t
  misc_feature (230)..(230): n is a, c, g, or t
  misc_feature (242)..(242): n is a, c, g, or t
  misc_feature (282)..(282): n is a, c, g, or t
  misc_feature (287)..(287): n is a, c, g, or t
  misc_feature (300)..(300): n is a, c, g, or t
  misc_feature (310)..(310): n is a, c, g, or t
  misc_feature (330)..(330): n is a, c, g, or t
  misc_feature (345)..(345): n is a, c, g, or t
  misc_feature (356)..(356): n is a, c, g, or t
  misc_feature (427)..(427): n is a, c, g, or t
aatcagggcctgcantcgaaactacaggttatttcaggctccttacttgtaagttaacaatgttaacagcatatttttactctgctttgtcaagncccccatggtgggaatgtcgtcatggatgaagaaagcagttaaatgcaccttacacttgcttaaaanatnatacagctaganttccnactgcaatattagtcttngaggccaataccaaatntgagagatttgcngctttgataagngatgttatctccagattcttccctgttccatctttttggngttcntgccagattttgngttttctttngctttgttttttcttctttnagaataccatgtttnccactagggancagctctctcctcccccagtccaacagatttttttttgctgctattgctttgggaaaacagaattttttgngcttagggggaatgtg

SEQ ID NO: 617570 - DNA, 219 bp, Homo sapiens
  misc_feature (5)..(5): n is a, c, g, or t
cgtancgacaggcacatcttaatgcacagccacaagttacaatgcaacagacatgctgtacatgtacgaggtcaggaacctttgactgcttccatgttggcactctgcccctcctcaagagcaaacgccaatgttgggtgaacggctgtttcctcttatacaagccgtgcaccctactcttgctgataaaatcactggcatgttgcctttcggagaaga

SEQ ID NO: 617571 - DNA, 216 bp, Homo sapiens
ttccccgcccggtgcgctgcccctcagcaatcttaggtggttgattttactctgtgaaggttctgatttttttctgcgtgctggccttcttagaagtgccttgttaatgcctatctgtgtgcttttaacgtatttcatggaccactttatactagattcgatgggctcttctggattttttcctcttttgtcacatgtgtcttgtgatttatcatc

SEQ ID NO: 617572 - DNA, 737 bp, Homo sapiens
  misc_feature (2)..(2): n is a, c, g, or t
  misc_feature (72)..(72): n is a, c, g, or t
  misc_feature (74)..(74): n is a, c, g, or t
  misc_feature (87)..(87): n is a, c, g, or t
  misc_feature (97)..(97): n is a, c, g, or t
  misc_feature (104)..(104): n is a, c, g, or t
  misc_feature (120)..(120): n is a, c, g, or t
  misc_feature (130)..(130): n is a, c, g, or t
  misc_feature (140)..(140): n is a, c, g, or t
  misc_feature (148)..(148): n is a, c, g, or t
  misc_feature (196)..(196): n is a, c, g, or t
  misc_feature (240)..(240): n is a, c, g, or t
  misc_feature (288)..(289): n is a, c, g, or t
  misc_feature (297)..(297): n is a, c, g, or t
  misc_feature (301)..(301): n is a, c, g, or t
  misc_feature (360)..(360): n is a, c, g, or t
  misc_feature (373)..(373): n is a, c, g, or t
  misc_feature (389)..(389): n is a, c, g, or t
  misc_feature (396)..(396): n is a, c, g, or t
  misc_feature (555)..(555): n is a, c, g, or t
  misc_feature (572)..(572): n is a, c, g, or t
  misc_feature (584)..(584): n is a, c, g, or t
  misc_feature (699)..(699): n is a, c, g, or t
  misc_feature (721)..(721): n is a, c, g, or t
gnaggggccccggccccaagttagcagcagggacgatgcaatcctgtgagttgcaagctccagttaggaganancaggactgaaggntccagcaggntggagtnccctgccgctggcccnaaaaaaagcntgcgccaaanccaaaggnctgtataaagccctcaaagaagtaccgctgccagcactgtagcgtccnccctcccccaggagcagggatgcctcgaccttccatgcacagcncagtctctccgtccttgtcgatgaaggtcaaggtgatggtggcaaagnntccccccnaacncagacgggacggaggtttcatatctaggtttccatctgagtctaagactggggcaaccnggctgggcgtggnggctcacacctgtcanctcagcnacttgggaagctgaagcaggaggatcgtttgggtctgggaggttaaggctgcagtctgctgtaattatgccactccactctagcctgagtaacaataagacccctctcgccaagatttaaacctccactccatcacaatatgtatctcagggaccagancagtaaattccccaganacgttgccatcnaccaagtggaactttccacctctgtttgcttctaatgttgcaggagcatgggtaaaggcctgcaccagcccttgggtggtaaacactctatagagctcctctggtgacgtcaggnaggtttccttaagagttatctnacaagttgggattttg

SEQ ID NO: 617573 - DNA, 177 bp, Homo sapiens
tttcttaagtctgttctagcacctttgccagaagcaactggacgatatctgcataacccttccaggcagcagcatgcaaagctgtatctcccaactggttctgcggttcagttcaatattgggttgagtaaatagcatttccaccacagtactcgtcaatgggctcggtcatatata

SEQ ID NO: 617574 - DNA, 245 bp, Homo sapiens
gttgaatgcgtgcgagttacatcccatcagaatctctggaaatgcttcattgtatgtcggcaacctggtgactttaccgacgtgaaacgcactgtctagctctagaggctcggcattctcccactgtgacgatatcatcgatctggacgatccttaagcagggggacaggtgtacagacatgttctagtggcgcctctcgaatcggttgtacttgcggatgtagtgcacatagtacagcgtctga

SEQ ID NO: 617575 - DNA, 743 bp, Homo sapiens
tggcacgaggagaacctggttgtagaattagccaagcatgtagcccagtctaacaatgtcacttcatgttatgtatgtggagaagctgtaataagagatcaaggccatgggaagcctgagaattagtacctacagtacctgatgaattcctggctcaaaagaatcaccctgataatttctgatcctaaaagcctcaattattaaacaatattgcatagctagagaaggaaaagaattctttcaccgcgtaggatgacttagttgtcggagacagaaactgtataatggtaccacaaaaacaatcactggtggagttcaaatcacacagagagaaaatttagtaaattctcaaagttgcaaactggacccacctggagtcccaccgggactggacagcccccactggattatactggatatgtaggcatagagcttatgacagattactgaccagtaggcaggtagttgtgttattggcactattaaaccatctttcttcctactgcccataaaaacaggcaaactccttggcttccctgtctacgcttcccgcgaaaagagaatcatagctataagaaattgaaaaaatgataaatggccccctgagagaatcatacaatattataggctgctacttaggcacaagatggctcatggggatacggaccccattactgatcaacgatcaatggttacagctgtctaaaatatcctataaacaggagctgatatctgctggagaa

SEQ ID NO: 617576 - DNA, 944 bp, Homo sapiens
tagacgaccccgtactgcgactcctacctgggaggaggacgaggagtgatgctgtgaggactgcggatggactgaggactgcgaggacggcgaggccgcgtcgcgagggacgcggacgcaggggacgaggacgaggagtcggaggatgcctgcgggcggagcggtccagttcgttccagtccagaatgatagggtccagaatactggcgagccacgagggacatgtgtaggtatcggctgcaactatccgggactctgtgttggaacgacgactgcaattgtgtggacacgccaaacctgagtttctacagaaagtgatgatccgcttcctgcccaacgtgtgtgtttcattgaggacattcgttcagaactggactggatcaactatgacctccttgagtgacaagtcactcctacatccagtggctgtttcctctgcgagaaccaggattgaactggcatgccaagcccctcacgctcagggaggtcgaggtgtttaaaatgctcccaggagatccaggatgctggcattgtcctgggcctatcgagctcatgctgggcttctactgggatccggttggagtgaccgatgtgcatcgggtcacggtggggccgagcactagaactaccagaatgcgcttcctagaaccctgtactggggctgtgctcggacaacgctccggagtcatcacgcgattcttcaagtcggtgggtgagctggtgtctcgaagcacttccaggctgcctgctggtccggttcttccgtgggggacgacgctgtgcggtgggagctgcgcgtggttctggacctttgccctgggtctacttcatgtttcgccgttcgctgcggctcgggcgcctgttggtggcttcgcttggagcttccgccccgtgcggttctttgggggccagaaggtgggagttacgccctttttgcccgtcgg

SEQ ID NO: 617577 - DNA, 951 bp, Homo sapiens
agaagccacataccacacacgacgccggctcgcggtcacatcgacgtacttctcggggaggggtcatcatattggcgtcacctctacaatgcgaggcctctcctcatcgacaagaagcaacaccaatcagcgtggtggcaaacccccaggggggacacacgaccgggagaagatccactttcgctggacaagcccgtgtgttcccccgaagaacccccgtcggctcccccgggggaagcgcagcagccgccgcagctaattacacagagcaaaagggggggaacacaccagcgaccggcccccgtgacagcgtcggcccccacggaggaaagcccaaagggttgggtccgccccgttcgggaagatacgccagagccgggtgtcaggacacacacaaagaatggctgcggcggtcgatatacagtaacaaccgtttactgagggagtaattcaaatcgaaagccccgtctttcccccacgggacatggggtgcggcaaccctccggtgtcagaggtgcccgctcgtgaagaagcaactgcccctctcgagtaagccaacgcccccaatcgcagggaagtaggtctacggtcaacacgacaggtggcacaaccaaggccggacctagagccgcacgggcctgcattatggtcctaactatgggcagcaaagacagccacgcggactaatgaattatctacacagtctgagcattgcttgcacggcgcatgccacatttagagctgggcaacacctctttcctcgggtcaagtgaaggtccacgttgttctccacacgtccctcgtcgaccccgcaaggaagattccaatagcgcttgacacagtgggaacactcgggtcattataacatttcttcggcgaatataaaccccgatggtccatttgcctgggatggaacagatggttgttgaaaaaacaccattccaaaggaac

SEQ ID NO: 617578 - DNA, 772 bp, Homo sapiens
attccgaactggagtgaaggtcactcttggctgtgctttagcaaagagagtggtggcatgtgcccctgctctagagatctgtgaactctgaactcgagagggtatctggcagaaaaaatttctaagcagcaaagtgttcaagatgtggcctgatgcttctaaaagcctatgctcatttgcatgaacaaagtggaacttatatttaaaacagaagctgagcttttataaaagttggagaatttgcagcccaaccatgtggtgaaaaagaaaaatccattttctggggaggaattcaaggctgcagaaatttgcataagaagagcctcatgttaacagccaagagagtgaggaaaatgcctctagagcatttcagagaccttcacagcagctcctcccatcacaggcatggaagcccaggaggaagaaatgctttgtgggccagcccaggccccactgttctgtgcagccttgggacatggtgccctgcatcccagcactccagctccagctgtgactaaaaggggccaaggtacagcttgggctgctgcttcagagggtgcaagccccaaagccttggtggcttccatgtggtgttaggcaggtgtgcagaaagagttgaggtttaggaacctctacctagatttcagaggatgtctggaatgcccggatgttccggcagaagttgctggagagggcgaagcctcataattaactctgggagggcgtgtggcgggggacatgtgggttgggagccacacaaaattcccactgg

SEQ ID NO: 617579 - DNA, 247 bp, Homo sapiens
  misc_feature (233)..(233): n is a, c, g, or t
tagacagagtgacagtgagagaaaaagagaggaaggaaaagggaaaaggagtagggaaggatgagggagataggaaagcacctacaggaggcagagagtttcctgaaggtcatgcgatcctttaccctcagaaactttcaggctgaaatcaccatctccgttatcccaacaaacgcactctcctacctctacaagcacttcaagtaaagcagaaatcacaccaatactgacgngcttcaagcgcaac

SEQ ID NO: 617580 - DNA, 537 bp, Homo sapiens
gtccgaaggaagagctaacctcactgcttgtagatagaaggaaaaaaggcactaaggtagcaaaactttctcatttcagagagatgccagtgatcctaatgtgcctgcacaacttaccaattctaaggaataagtggatggatggcattactgattcctacattactgattgattctgcatccgcacctggtattattaaaaacattctacgtcatgtgtggggagataaggaggatcacatgaagagaaagaatatcatggaggggaagttctactgaatagaaaaggtgttgaacgtttataaataagttttactattcacagggttcaaactatttgaagtaaagagattatatttaatgaatccatccctcaatttacccaggtgaccactttacttttactgtgtgtatctgcccagtattcattcctgctgatatcagtccataactgaatgatacgtgccgtcttcactatatttcattctagtcaggtagcagaccgtgtagactttactgcactggccctgttcataa

SEQ ID NO: 617581 - DNA, 305 bp, Homo sapiens
accccctctgaattgcacgcttgtgccttttccccctaatggacagtggaaacccccgctttcatgttactgcacgtgtgatcatacagaagttgtgttggggaataactaagtcggggggttgacaaaaggtccatgctcgtaacgttgttccttacggaaataatggaaagtatcagaaaacctgttataaattgtgtccgctcgacaaatagcatgtagtgacaacctaatctgtatgtcccaaggccagcccactggcttctacggccgtgtcaatcctcaagcaacgtcttcgttgatgg

SEQ ID NO: 617582 - DNA, 189 bp, Homo sapiens
gaaagcaatctgtttctagcatgatatgtattggtaaagtgcctactaagtggtatttttgtctagataccatgtcttaggcacacaacagaaaaaagaaaaagtgcagccaggcacggtgggcagattgcttgagttcaggagttcaagaccagcctggcaacatggtgaaatcctgtgtctacaaaa

SEQ ID NO: 617583 - DNA, 167 bp, Homo sapiens
tggtcgatggacttgacattcagtaaggagacaggacatgcatttcaagctgcatgcagctcactgatttcatacctcaagttatccgaacagtgcccaccagaagtatgtaccgacaatgccctggacagaaggcagactatcaatactcacatgtaacatgcccg

SEQ ID NO: 617584 - DNA, 217 bp, Homo sapiens
  misc_feature (35)..(35): n is a, c, g, or t
  misc_feature (134)..(134): n is a, c, g, or t
aggatcacttgagaccagcctggacaacatagtanggccccatctctataaaacaatgtttttaaaaaattagccacacgaggtggtaagtgcctatagtccagctactcaggaggctgaagtgggaggatcanttgagcctggaagctcaaggctgcaatgagcagtgattgcaacactgcagtccagcctgggcaatgaagcaagaccctgtctc

SEQ ID NO: 617585 - DNA, 227 bp, Homo sapiens
cagcgtctcgtcactgtttttttattcaaacacaaatctttcatactattcttattactggtatatagattttttaaaatttgtctatctctggaatgtaccttattactccatttaatgacttctgataatttttccgttgatttattaaaatgctgtacataatgacaatctttttactatggtcaacacatgtatcacatacagacttcacgatgtgacataat

SEQ ID NO: 617586 - DNA, 231 bp, Homo sapiens
taaaacccagcccatgacccctaacaagggcccctctcagccctcctaatgacctcccggcctagccatcgtcgatttcacttcccactcccataaccgctcctcatactacggcctactaaccaacacaccaactcgttcaaaaacggcttcgtaccgggtaatcctatttattacctacgccgttttttcttccgacggtttttttcgagcttttaacttacgtacggg

SEQ ID NO: 617587 - DNA, 190 bp, Homo sapiens
caatgggcgggttctgactcttatgctgaagcccttttcctaccacccagtgccccagcctcgatccttcaggccacagatcaccccacacaatgtgcccctgactctcccacattgcgatcagcctgatgcccacactaggagctcgctccctcccacttacctcagacctttctctacattgccccgg

SEQ ID NO: 617588 - DNA, 136 bp, Homo sapiens
aaattttttttccccccccccccccccccgtttggggcccccaaaaggggggtttgggggcgggccctttttccgggtttttttttttgcccccttttaaagggggggaaaaaaaaccttttttccggggctttta

SEQ ID NO: 617589 - DNA, 169 bp, Homo sapiens
gtaacatgttgaatataaaagaatctctgaaaatgtactggtgccaaaaaaaatacccatatttgttttctgaattaaaatatgtatcaataaatagattatttgaaagggaagggcaacagggcaaacattagtacataggtaccattctttaacaagaaaattcagg

SEQ ID NO: 617590 - DNA, 281 bp, Homo sapiens
acaatcacggcttcctccaacctccgcttcccagggtcaagcaatcctgcctcagcctccctagcagctgggactttgctcagcgctccggacgcctcccaccagcaaagaggaagaaatttcagtccaggggcaacagccagctgctgctattttaaatggttgaaaactaaacgggtggctccctgccattgtcaccaggttggaactcttgcctctgtgaggaagccttttttactgggcaaacccatgaaatttaatacccattttaaaacctctga

SEQ ID NO: 617591 - DNA, 130 bp, Homo sapiens
cacgaggagatttatgatttcatacgcttgattctatgtgaaacatctttttacttttatgcattttaataagatttaaaaatatttatattaaagctcccttgaacgagtacatgaaaaactcctggct

SEQ ID NO: 617592 - DNA, 229 bp, Homo sapiens
ttaatgggacttactaggagggatgctggaccaacctgctttcgctgactgctcgcatctaggcagccatggtgaatgtgttcagctccgaggccgcctggcagatgtgtgagtgaggcgctgcagaatcctcgcggggcttgtggctacacaaggggactatctcgtacgatacgcatactgcgatgacagccggtatcctcctcattcttcgatgggaaccagtgaa

SEQ ID NO: 617593 - DNA, 182 bp, Homo sapiens
agacagccagcactttaacggatgttttcaaagtataactaccttcaggtcgagctggcgcatggtgattcccatatttgtcccagctgtttgccgaggctgaaagcaggtggatcaagggctgcagtgagctaggatcaagccactgcattccaacctgggtgacacagtactgggccttt

SEQ ID NO: 617594 - DNA, 731 bp, Homo sapiens
gggccaattgtgtatttctagtttagatggggtttcgccatgttgaacaggttgggttttgaactcctaacggcaggtgatccacctggctcagcctcccgtgctgcgattgattacaggcatgagccaccgtgcacaggctctgacacgagtttttgatgatgcacggcttcaccctcactatccttcagctatactgggtagctgcatattttcatctccatcagcctactaagcgacaatgcctatcttgctatcattggtactgtctaacctgttagccaagcatctcctacctgaagtaattcgatcgctttttctatggactgcctgtctatctacccctttttcttaacgagctgccccagtccagcaccattactgccagccagccctcggccacctaccttgctgcatcctcatgtcgcctcgcctcatacaattcctagcactgtcactcgcgccgcggctacgccttctgcgcccagtcccactccgtccccacactgatctcctcccggcctacgtctccgccttcgcccctccccctccccgcccccttcccccctccactccccgctccctctcccctcagcccccatcccgccctcctctgcccctccactccgccctcctcacgccccgcctttcatctcctctcctccacgccatctcccccttcctcccatcctcccctccccctctctccctcctccctcctcgcccgctcc

SEQ ID NO: 617595 - DNA, 121 bp, Homo sapiens
  misc_feature (72)..(72): n is a, c, g, or t
  misc_feature (85)..(85): n is a, c, g, or t
  misc_feature (100)..(100): n is a, c, g, or t
gccaagttgggacccggacggcctcaccatgatgaaacgggcagctgctgctcagatgggaggagccctggnagtgggggctgtnccgtggtgctcagtnccatgggcttcattggggcag

SEQ ID NO: 617596 - DNA, 897 bp, Homo sapiens
cttccaagtaaagctgctgtgaaaatttgtgaacaagcttgtatagacgatatgccttcatttctcttgaataaattcctaggaataggaatggtaggtcagatagtaggtttttcctttttttttggtggagggggtggtatcttattctgtgatccaggctggaatgtggtggtgtaatgttggtcactataacctccactcccaggctcaagtgatcatcccaccttagccttttgagtagctgggactacaggtgcagtcctaccatgcctggctactttttgtatttgagtggagacggggtttcactctgttgtccaggctggtctcaaagctcctggagtcaagcagtctgcctgcctcggctcccagagtgctggaattacaggtggagctactggacccagcaaggtatatgcatttctaagaaactgccaaactgttggcaagacggtcgtatcatctcgcattcccatcaacagtgtgtggtgttccagagcttccacatccttaccaacaattggtacggtcagtgatttcattctgatttattgcattcatgcatcactcgagatggagtctcactctgtctccaggtaacagtgcagtagtggcgatctcggtccacgtgaactccgagtcactggtttcaaggcgaattcttcctgctctagcttcccgagttaatggagattaccaggacctggcaccatggcccaggtgaatttgggtataaaacgtggaagaagggagttacaccattgttggcaagacatggtgctcagaatctcctggacttcaagaattcgaacaaagttaggtctccaagatgctggataaaagcatgagcacacaacttggctggccagcattaatttgtgaatttaataaatg

SEQ ID NO: 617597 - DNA, 575 bp, Homo sapiens
gatcccaacttaattattgcgggcatgcagcccttgaggtctggaaatcaacgcaggtgattgttataaaaaggtcttggcgggttggcttatgcgcaagtggacaatccaattttttccaaacctaaccgcgccatgcttttaggtgatgccaaaaaaacatgtgacgcgctccaggcgaaagttagagaatcctatcagaagtaaatattaaggatcaagctgttagctaataacgccccctctgcagttttgggaacaggcaaaaaaagtatcagtaaacatggtgatgtacatttgtagcaaagcttttggagaaaatgaagcctgaagaaagcaaagcaaaaactgtataaagagatttttcaaaaccaggaatccccccattttaaaaaaggattgaaaattctaaatgtctttctgggcaaattttttgggttaggaatcaaaagttttttataaaaggaaaaaaaccacccccattttaaaggaagccctgttggattttttaagcccccccaggaaccaaaaatgttttaaaaaactaagggtttaggatttcaagcccccccata

SEQ ID NO: 617598 - DNA, 847 bp, Homo sapiens
ccaatttttccatgggttgccctgagagtttgcccccccccccagtttctctgcaaggcctcctggcccccccctgctttgcccacccctgcgcaagggtatccatggacaacttggttatctgtggaggactcatgaccacatccacgcatcactgccacccaggagacttgtggatgcccccctccgcggaagctttggcctgatggccgccggggctctccagaacatcatccccgcctcttactggcgcctgcccaggctgtgggcaagagtcatccctgggctgtacggggagctcactggcatgccttccgtgtcccccctgcccacgtgtccagtggtggacctgacctgccgtctaggaacctcccatatgaggacctccagaaggtggtgaacaccggcctcgcgagggccccctcacagggcctcctgggctaccactgagcccccggtggtctcctctgacttcaccagcgacacccaccttcctccaccctttgacgctggggctggcactttgccctcaacgaccacctttgtcaagctcatttcctggtatgaccacgaatattggctacagcaaacacagggtggtggacctcaatggcccaccacttggcctcccaggagtaagacccctggagcccccccgcccccgccagagcacccagaggaagagacgagaccctcactgctggggagtccctgccacactcagtcccccccccccctgaatctcccctcctcaccgttgcccagtagaccccctgaagaggggaggggcctagggaaccgccccttgtcaagtaccaatccataaactaccctgtgctccaaccca

SEQ ID NO: 617599 - DNA, 133 bp, Homo sapiens
ataaggtatgaacaccaagagcttattagtaggcaaatacacattaataaaatgcctaaaaggatgattcttcaacccggacccatggttgctgttgggcctgttagctctgcataggtaaatttatgtactc

SEQ ID NO: 617600 - DNA, 268 bp, Homo sapiens
  misc_feature (49)..(49): n is a, c, g, or t
taggcatggattgggtctggaggatctctagaggtgaccaggctccatntacgagtattggaggtcagcacggtgctcacgtgtcgacggaacttgtacagtgaggcatgcaccgcagtggtgaatacacgtcgaccaggctccatgttagcgagattgggaggtcagcgcggtgctcacgtgtcgaaggagcttgtccagggaggcatgcaccgcagtggtgaatacacgtcgagctggaggcatgaatgcatgctcgggtactgga

SEQ ID NO: 617601 - DNA, 483 bp, Homo sapiens
taggaattaccatattgttcttcatagtgattcaattaacttatactctctactaacaataattcaactccaactcttttcttttccaacatgcaattatacttccttcattactagaaatatttatttgtattgatttacatttcttctgtgtgctgtagtaatatgtgttatgtgtaatataattattctaaagtttagcatttttttattaactttaaacattaaaactattttacccaaaaagtttcttaaacaggtctcaattcatttaggaatttattttgtcaatgcttaagacatgccagtgacacagtcctcaggaggtccttactacataggccccgggctggttggcctacaacttgcttgtatacattttagggagacataagatatcaatcagtatgtgtcagatgtacatttatttggtttggaaaggtgggacaatgggtaagggggcagtggagagtggggacttca

SEQ ID NO: 617602 - DNA, 155 bp, Homo sapiens
gatgggggctcttttgtgtcatgtgagaaagaggcaggccggatgtcagaggggtgccttgggtaacctctgggactcagaagtgaaagggggctattcctagtttttattagctatagtccattattgctaaatcgcctcatgcacgggttacc

SEQ ID NO: 617603 - DNA, 389 bp, Homo sapiens
  misc_feature (278)..(278): n is a, c, g, or t
  misc_feature (304)..(304): n is a, c, g, or t
  misc_feature (354)..(354): n is a, c, g, or t
  misc_feature (365)..(365): n is a, c, g, or t
ccaaaaatctcaatcctgggctgggtgtagtggctcatgcatgaaatcctcagcatgttaggaggctgaggtgaaaagatcacccgagcccaggagttcgagaccagcctgggcaacatggtgaaacgctgtctctacaaacaatacaaaaattggctgggcgtggtggcacgtgcctataattccagctactcaagaggctgaggcaggagaatcgcttgaacccgggaggcggaggttgcagtgagccaagattgtgccactgcactccagcctgngcagcaggagcaaaactccatctcanaataaataaataaattgttcacttcttttaagtatttttttatgctattntaagcagaatngtttcttaatatcaattttggatt

SEQ ID NO: 617604 - DNA, 421 bp, Homo sapiens
cgtcgcattacgcatcggagaactacataggagagcacgtgtctgcacctcctaactgcagaagcaaccgtcttctcaaagacgaaggtcttagcaaagttcagtgctcggtgtactcggcacaacaatgcagtgtagttcagaaggtatgtaggcaactcttaatctgaataagaatggggggggcgctttcgaaaaatatggcttcacgaaggcttgtcattatagggctaaattttaactagaatgtgagtctgaactcttacatctagaacaaacaaaaccttaacatcacggattggttcaaagaatggtttactggaaaaattaatctgtaacaaaaagttggcatggagtgcgaaggctccaccgttgttttttttttttttttttttttttttttttgtgcgcgaccgccccc

SEQ ID NO: 617605 - DNA, 356 bp, Homo sapiens
tctctactaaaaatacataaattagctgggcgtggtggcgcatgcctatatcccagctacttgggaggctgaggtaggagaattgcttgaacctgggaggtggaggttgcagtgaacctagatcacgccactgcattccagcctgggcaacagagcgagactccatcttaaaaaaaaaaaaaaagatgaaaaaaaaatttgttttcagtttgaaatcctattgttggtattattcaattgccaacagaaaagggcttggttgggttccgctctgtgtcaggttaaagcatactaaagaccagttttataagtcatgggctttgaaaagcaggcacacttcacttacttggagaatt

SEQ ID NO: 617606 - DNA, 717 bp, Homo sapiens
  misc_feature (118)..(118): n is a, c, g, or t
  misc_feature (454)..(454): n is a, c, g, or t
cgggtcaggtcattcaaatgccccctcgggaggccaataatttggggaggttttccaccgaaaacacatgtgggtgcatagagtccacattgggaaagccagcacgacacaacacatntgctgttctctcgcgagagatttcgatagtgagatgaagtaactccccgctgggttaccgcagataaatatgtgaggacaattacatgtgatgagacagcagaacccccttgagataaagatactctcgcgtaagattggcgacccccacagtaggtgttgtttgtacacacaaggagccacacagtattctctgcaacgaatgtgttttctcaccacacatagcggtgatttgatggcgcactcatcatctccctcctctctagcaacagaaaacattccaccattcaattgggcgtgtgaccatattctcttcgcaaacccccacacctagcanttgtattgtattcacaccactgctgttcataaacatcattagtagtcattcccttctatataaaccaggggtgaccctcctcgtgcattctccctcttagcaattaatcattatataactctttgtgctcttttagaattacaattggacctacaaaggaattaaaagacccactaactattttttctcgtctattaaaataaaaaacacagcgagccccctcttctctctctcctggcgagaaacaacaaatagacaaaaac

SEQ ID NO: 617607 - DNA, 779 bp, Homo sapiens
  misc_feature (51)..(51): n is a, c, g, or t
  misc_feature (61)..(61): n is a, c, g, or t
  misc_feature (71)..(71): n is a, c, g, or t
  misc_feature (106)..(106): n is a, c, g, or t
  misc_feature (142)..(142): n is a, c, g, or t
  misc_feature (153)..(153): n is a, c, g, or t
  misc_feature (207)..(207): n is a, c, g, or t
  misc_feature (211)..(211): n is a, c, g, or t
  misc_feature (213)..(213): n is a, c, g, or t
  misc_feature (284)..(284): n is a, c, g, or t
  misc_feature (294)..(294): n is a, c, g, or t
  misc_feature (300)..(300): n is a, c, g, or t
  misc_feature (312)..(312): n is a, c, g, or t
  misc_feature (342)..(342): n is a, c, g, or t
  misc_feature (350)..(350): n is a, c, g, or t
  misc_feature (354)..(354): n is a, c, g, or t
  misc_feature (369)..(369): n is a, c, g, or t
  misc_feature (377)..(377): n is a, c, g, or t
  misc_feature (393)..(393): n is a, c, g, or t
  misc_feature (399)..(399): n is a, c, g, or t
  misc_feature (424)..(424): n is a, c, g, or t
  misc_feature (438)..(438): n is a, c, g, or t
  misc_feature (443)..(443): n is a, c, g, or t
  misc_feature (446)..(446): n is a, c, g, or t
  misc_feature (448)..(448): n is a, c, g, or t
  misc_feature (475)..(475): n is a, c, g, or t
  misc_feature (546)..(546): n is a, c, g, or t
  misc_feature (593)..(593): n is a, c, g, or t
  misc_feature (607)..(607): n is a, c, g, or t
  misc_feature (616)..(616): n is a, c, g, or t
  misc_feature (620)..(620): n is a, c, g, or t
  misc_feature (625)..(625): n is a, c, g, or t
  misc_feature (649)..(649): n is a, c, g, or t
  misc_feature (655)..(655): n is a, c, g, or t
  misc_feature (658)..(658): n is a, c, g, or t
  misc_feature (660)..(660): n is a, c, g, or t
  misc_feature (665)..(665): n is a, c, g, or t
  misc_feature (682)..(682): n is a, c, g, or t
  misc_feature (686)..(686): n is a, c, g, or t
  misc_feature (694)..(694): n is a, c, g, or t
  misc_feature (704)..(704): n is a, c, g, or t
  misc_feature (712)..(712): n is a, c, g, or t
  misc_feature (715)..(715): n is a, c, g, or t
  misc_feature (779)..(779): n is a, c, g, or t
gtaatttagatacaaagaaattctaaaagagtcttaaatttcacaacttcnatgtgttttntcacaattgnctcgcactcctcgttcctcccccactcgctaaganttacaacactctaggcatccgcctccaaaaaagttnttatctatgcncccttcatggctaacctctcaccattgccagctcccactcgcataatagccccnaagngnctattaaaaaaaaaaaaaggcaaaaaacgcaattactttcgcaccaacctaatactagttttatttttaantcacagtttnattttnatataaatggantcatacaatgtttattctttcatacctganttctttcnttcnggaacacgtttcagngcttctgntgtccagtagggggcntcaatngttctttttctttttattgtctgcnaccattccattgtntggantcnanctagtctgtttattcattctgcctgtnaatgaatatttagggttatattccagttatttgtctttttatgaataaagcattcttatttttatcttttnagaagtctatttgtttgttatgagtcttcacctctttatccttgganaaaaacctaagganggactcgcngganaatanaatagggtatttgtttaaatttanaagaancancnaaacnattttcaaaagtgtttncgtncttttccntactcacaanaaatacangangtgggcttgtttgaagtttgtggatgtgtatgcgcttctcatgtgtgtactggcatttgtctan

SEQ ID NO: 617608 - DNA, 371 bp, Homo sapiens
  misc_feature (56)..(56): n is a, c, g, or t
  misc_feature (59)..(59): n is a, c, g, or t
gccccttaaggggtccctttcaagggaggggggggaagggaaggggaaaacccttnggnggggccccctccccagggggttgtttaaaaaaggccctttgttccccccccccttttggaaaaggaaatttgggatgggggggaaaagggggggccccccccaaaaacccctcccaaaaaaaaaatggggacaaagcacaggggcggagttttccaggaaaaggggaggggttacccagctcccatgggggggggtttttttgtttgtccccctgatgatgaaaagcccccccctccccaaggggggggtttttagcctttttttggccccccttttttgttttcaaaaaagtttggtccttagaaagggga

SEQ ID NO: 617609 - DNA, 408 bp, Homo sapiens
caggccctctccaggagcccctggctgtgataaatgtgcatctgtagagtgcacaacctgaacatccttaccaagcagccctgcccaatatcttcctgcctaaagagtcccaatgctgagagtatgcctttaaaaccccattttggccatttctcaagaaacctgtacttgatggatcagctggcaccatccagatcaataaactggctcatctgatctgggccccccacctaggaactgactcagcgcaagaagacagcttcgactctctatgatttcattcttgaccaatcagtactcctggctcactggcttcctcccacccaccaagttatccttaaaaattctgcttcccgaatgctaggggagactgatttgagtaataataaaactctaatctcctgctca

SEQ ID NO: 617610 - DNA, 161 bp, Homo sapiens
gggtcctagaattcagcaaggagccaaaacaagtttgcaagaagaaatggattcttttcaggttcacagaaggttgaacccatttacttgaaccagaagttgaattttaaatatcttgatctcaaccttaaggggggcacgttatttttaaccgggcaaag

SEQ ID NO: 617611 - DNA, 117 bp, Homo sapiens
agggtatttataggttcacactaagtgaaaagtccagtgggatattctagcttcaggcacggttggatccagtgggcacaaacgctgtcatcaggattcaacgtctctccactattt

SEQ ID NO: 617612 - DNA, 289 bp, Homo sapiens
gaaagttgttaaaataaaaagtgggtgtgggaatcgggtgttctttccccccattgggaggatggtcaaaagggttttagcagggtccccctttttttcccccccccccttttttttttattaatcaaaagaaacttcaaaggtaatgggaggggggggtctccccgggtgagaactcgttccccccccagcctttcatgaaaaagcgggttttttttaatcaacccaaccccccccctgatgggagggggttccccaatctttccaaataaaaaggaatggcttggga

SEQ ID NO: 617613 - DNA, 139 bp, Homo sapiens
  misc_feature (106)..(106): n is a, c, g, or t
  misc_feature (138)..(138): n is a, c, g, or t
aattcgcggccgctcgaccgagaagacgacagaagggactgtggcaatgtggtgtgtgataaaattaagccaaatcaacagcccattttgtgcaatcagggtcgantctgtgtggactctcttgggtttttggctttnc

SEQ ID NO: 617614 - DNA, 183 bp, Homo sapiens
  misc_feature (49)..(49): n is a, c, g, or t
  misc_feature (56)..(56): n is a, c, g, or t
  misc_feature (119)..(119): n is a, c, g, or t
  misc_feature (137)..(137): n is a, c, g, or t
tcggaccaaaaaaattatggcccatgaaaggagagagaaagtgaaacgnagcgtcngcctcgtcctgagtacccacgtcctagggaaggagaagatcgccagcatgctgcccggagcantcgtacgttcctgcaganccccccggagaggagcccgaataccaccccgacgccttaagcccag

SEQ ID NO: 617615 - DNA, 129 bp, Homo sapiens
tatgcccactatctgctgtgcaaaatggccgacgatcgcggcgtatttcccggccagtgggcgctctccggcggcggcgtcgagccaggcgagcgcattgaagaggcgctgcggcgagaaattcgcgag

SEQ ID NO: 617616 - DNA, 901 bp, Homo sapiens
cagtcatgcgggaatccaatgcatgaatgatgatcgttggcagcccacgagaaggaatggacaggtacttcgtgttattccagctacgcagaagggaagggcacatgggtgattgatagtcggtcagagggactgtctgtgattggatgtggaatagtcctcgaggatgtgccttgaagagaaagctcagtgaatatgaaactgacgcagattgtaagaggtggaatactctagacagacaagactaggtattacattcttatatgctggaatctggtcattcgccattgcccaagaccaggtctagtgagcggaatgtgggaagaatcctcttcatggggacctctttctagatcattttgcttacctattacagctatatggtggctgcccgatattaggagtctggtgaggaagagatttggagatgtcatgaggcgaggttagatgtgtaagtgtagactgactttcagaaagtgtctcttaagtattgcatgaagtcaagaaaaacacagagtgtgtgggaggaccggttcagtgtccaaagaaccagcccatgccgtgtttaacacgcttggatgtcgggaattcccagatatgtctcagagtgattggaaatccctatttgttcaactgcaagacagggtgtctcaactcatgtggaccacaaggtcctggatgatgcaagggggtcgtgatctgcaaggatcgtggcaaattctacgatctcctttggttgaatagtagatcctgcttgcttcaggtttcagtgagtagaggtggggactaccaggtattttggccacaattgggtcaaggtgaatatgtaggtaattttttatgggaaagttcggagagtttggcagtggtgggtcagcgagctggtgttaagagtgtgaaa

SEQ ID NO: 617617 - DNA, 90 bp, Homo sapiens
ggaagtggcgccgttttttgaaatcggccgagtgggctcgcgccggacccgagccgccgggggtgccatgtccacccctccgctgggcgg

SEQ ID NO: 617618 - DNA, 266 bp, Homo sapiens
gttaagcccccccccccccgccccagttttccaggggggttactatttttggggtcatgggggcagttttaggacccttgaaccctttttttccccccttcccttcccagtaaatggggcaggggcctacggggaggggcttgttcttaactatttagtggtcccgttaacccctaactttccttttttttttccggggccggggtaaaacgacctcatggttttcccccttctaaaaaaagtgtgtttttgggggaaagagagga

SEQ ID NO: 617619 - DNA, 806 bp, Homo sapiens
  misc_feature (328)..(328): n is a, c, g, or t
agcgggcggcgcggcggggcgatgtgtgattaccatggcgaggagtctctgtccggggtgcctggcttcaggaaaccctattacctccagcgctcgcttctcatatgtgcggatgaaatatctattgcttctctgcctgagttagtggttttccgttcggaagctaggattatatattgtgcagtgtattctacctatacagaatttaatgcaagacggtacatagggactgtagaaggaaatactagagtatgtgagcagagatacgaaggactgtgtagttacttgatgtggcctgctgtgtaatcattgcctttgatgcttccgngaaactcgtttagcttaggagaaaatgtttatccaccaaggcaccaagcaagtcagatgtgagtctagggatgtagggatagatctagacaggtgtagtagacaatgtcaacatggaatgagcgctacagtctatgatttgggaactgaattggaagccaagaaaatagaaatagtgcgtattagataagtcgcaagctagaggaagctacgtgttacaaaaaatttccctacgaaagtgggtctgagtagtctctgctcataggcacacaatagcgagtgaccgaatggcataaccatcgtctgaaactagtttaatcctcatcttagcacgcgtggcctgatggacgacgaaaggatgcgccagggtttccttgggggagaaagcaaaagtcgagcagtggagcacattcttcagactggaagtgaatgtctatcgtcatgggtgataccttcaacgataaaggaaccataccccc

SEQ ID NO: 617620 - DNA, 118 bp, Homo sapiens
aaggcaggagtacagtggtgcaatcatagctcactgcagcctcaaactcctgggctcaagtgattcttccattcttcacctcagccaccatgccagttattttaatttttgtagagac

SEQ ID NO: 617621 - DNA, 112 bp, Homo sapiens
  misc_feature (86)..(87): n is a, c, g, or t
ctcagtgactctggcttctatctctgtgcctgggtcgccaaaatctatggatacaccttcggttcggggaccaggttaaccggtgnngaggacctgaacaaggtgttcccac

SEQ ID NO: 617622 - DNA, 396 bp, Homo sapiens
catcgaggacgcatcatattacagcaatgcttttcttttctgccaattagcaccaatataaatcgttattccatctaaggccctgtattacttcagagaatataaatctaagtcccggccaggtgcagtggcttacgcctgtaatcccagcaccgtgggaggctgaggctgagggatcacaaggtcaggcgtttgagaccatcctgaccaacgtggtgaaaccccatctctactgggaatacaaaaattagtcgggtgtggtgtcacacgcctgtagtcacagctgctcgggaggctgaggcaggagaatcacttgaatccgggaggcggaggttgcagggatccgagatcgcctcactgcactccagcctgggcaagagaccgagactccctctc

SEQ ID NO: 617623 - DNA, 224 bp, Homo sapiens
cgacagaggaggcgcgagctcctgggtagatgtgctctctgtctgttcagattattatgtccctgtatcacagctacccaggagctcgtggcctcctcgtctgtccacctcctctgtgctgtccacctcctctgtgctgtccacctcctctgtgctgtccacctcctctgtgctgtccacctcctctgcctcctctgtgctgtccacctcctctgtgctgtaca

SEQ ID NO: 617624 - DNA, 108 bp, Homo sapiens
atcagatacgaatccagtataaagccctaaaacctgaagtggataagctgaacattatggcagccaaaagacaacatggttcgggcagctcgagctttgctctctgct

SEQ ID NO: 617625 - DNA, 308 bp, Homo sapiens
  misc_feature (5)..(5): n is a, c, g, or t
  misc_feature (185)..(185): n is a, c, g, or t
  misc_feature (293)..(293): n is a, c, g, or t
acaangttgccccccaaaccttccgtgccccatcaaagagtctattgtaggatgggaaggaagtatagatagatctgtaaacaagtaaaactggttgtcaaatgtgctaatacaactgtgtgaattatgatgtaaacatgtttatttaataactgcattaaatatgacataagcacctactaatngccaggcacaaccactttatatgaattatttaattaatacatactgtaatggaggtactgttatcctcccaatttaaaggggacacagtgaagcagcaataaattaantaatttggctaaggt

SEQ ID NO: 617626 - DNA, 321 bp, Homo sapiens
  misc_feature (50)..(50): n is a, c, g, or t
tgcaagtcgattcatagagagatccccctatacggagtctcatacattcnctcactcagcgtatggccctatctcctgatacgcttggagcgaccttatggctacgtcgcgtggccttgttattacaccgcttgtagtatatacaaccccctgcagcggcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaac

SEQ ID NO: 617627 - DNA, 351 bp, Homo sapiens
ggggccaggcgcactccatctctatacattagcacgctattccgaggcgcgccctgtggactcatgcgtcggatcccagcactctgtgaggccgagggccctggagctccacacggcctaccctatagcccacgatgtgaatctgaatctacaggcagactggaccacctctctcccatgccccgagaatggtcacaagggcttccttggctacgatggtccggaggctttgggtggagtatacatacccggtcggcttgataagggggaactttcattacatcccgggagactgtcccacggcacacgcacaggcgtgcttccttgccccaacacctgatctcctctctg

SEQ ID NO: 617628 - DNA, 131 bp, Homo sapiens
ccaccttggcctcccaacatgctaggattgcaggcatcagccatcacacccagcctggatataatgattttaataagcaatttagtctccctggtgtccctaggacgccaggctcaacatttgccatgaat

SEQ ID NO: 617629 - DNA, 267 bp, Homo sapiens
cacgcggagagagagagagagagagagagagagagagagagagagagagagagagagagagagagagagagtgagatatagagaccgcgccctcttgcttgacttcttctcccccttctctctctccccctcatccttcctctctgtgccctccctccctctcctcccttctcttcctctccctccctcctctcgctctccttcctttccttttccttccttgttctcttcccttccccttctccttcttccttccccccttttcct

SEQ ID NO: 617630 - DNA, 234 bp, Homo sapiens
caatacatgagggctaggctaaaacacagtcaggtcacgttgttatggacagcaaaggctacagggtgcggatcctggctcttgtagtacgaattctgactgcaccaactatgcctaggacggacgggagttgtagtttaagtagacaggtgctggggtttgcagcagaccagtctgcacaagcaatggaagggcagagctattgtagtgtattaatgcagcacattcatgcca

SEQ ID NO: 617631 - DNA, 297 bp, Homo sapiens
gtgtacgaccctcgcgggtctcgtctcggatgcgttcaaagtaaacgataaaggagtatgctgtcacgccgatggccacgatcgcgccggcgataccagccagcgaaagggtgaatccgacggcctcgccgagcaacaccatggctgcgtaggtagtgataccggcaatgacgagggagccgagggtcaccaatcccaggccccggtagtacagcaagcagtagccgccgaccagaataaggccaatgatgccagcgataatgccagctcgaagctgctcacccccaagggtgggcg

SEQ ID NO: 617632 - DNA, 298 bp, Homo sapiens
ggcggtcccattcattcatgcccggcatcgcgttatctttcaattccattcctttccattccattccattccgttccgctccattccattccattccattccattccattccgttccgttccgttccgttccattccattctattccgttctattcgggttaattccattccattccattcgattgcaatcgagatgattccattccattccattccattccattccattccattcctttccattacattacggatgattccattccattgcattccatcccattccattcccctgta

SEQ ID NO: 617633 - DNA, 228 bp, Homo sapiens
ttgctgaggtactctcgaggattctttgaccagagtctgggagtaatgtgttgctgtcgacacacattggcctggtaagagagagagagagagagagagagagagagagagagagagagagagagagagagagagagagagagagagagagatatgtgagagagagagaagagagagagagagtgttgtggtgtgttctgtgacacacagaaatagtatgatgatgag

SEQ ID NO: 617634 - DNA, 384 bp, Homo sapiens
  misc_feature (13)..(13): n is a, c, g, or t
  misc_feature (291)..(291): n is a, c, g, or t
  misc_feature (325)..(325): n is a, c, g, or t
  misc_feature (331)..(331): n is a, c, g, or t
  misc_feature (357)..(357): n is a, c, g, or t
taccctgtcttancgtagaaatgtttaccatgtaaatacacagccagaccaagatagaagtaggattactaagttctgttgggacaagccccgggtaaacacagagtatcatgtaatggatgtgtgaggcaaggctggggagtatttggaggcaaggggtgaggagcattcacctgggctatcaatattccctgtaagcattaaaaagcttcagttccgcttccctgcctcagccagttgttttgaatacgtccagattagaacagccaaatgtgagttttagaagtaagnagtgcctcaatctgtccaactgttctcgagctgnactganccaaccttgttgggttccatggcttncaaacacaaagaagtggattgttgaac

SEQ ID NO: 617635 - DNA, 493 bp, Homo sapiens
  misc_feature (10)..(10): n is a, c, g, or t
tggcccccgntggatggttactaatcctggagaaagaatagggtagagaagaggctgaaagacacagaagagggacaaaagatggagaacagtccctgagatggtaggagcaatagagagagactgggactaatttgccttcagaaaggaatggcttttcactgaaaatggaaggaatataagaggatatgtggccatgcatgctgttctacattagagtcagaagttgagcgtttccctacacaatggcaattagtgttgctttttcttgtgacgtagaggagagttaggtggatgagtaggtaatctaggaaataataataaatatatgacatgttcatgaaattagaagaagaattaacatggatatggttatttgcagttctgaaggcttactgaaagttggaaagcataaatatatgcatgggaatagacaggacatagagttgcagagtggcttcgcccctacaagtcggtggcaagacccatttag

SEQ ID NO: 617636 - DNA, 248 bp, Homo sapiens
  misc_feature (35)..(35): n is a, c, g, or t
gggttatagaggacaaggaggtgcccggtacagcnttcctgcttgaaacatcctgaggctgtcgcatttcctgccacttcccgccctgtccctcctcccagtatgggctgcgaagctcacacacagcttttcccctacactccaatcacgctgagacttccaagtaggcacatctccgtttctccactatgtaaactttcaacgagctcatacggtctgttctatgttcttcgcgaagcgccgcacac

SEQ ID NO: 617637 - DNA, 367 bp, Homo sapiens
  misc_feature (135)..(135): n is a, c, g, or t
  misc_feature (187)..(187): n is a, c, g, or t
  misc_feature (219)..(220): n is a, c, g, or t
  misc_feature (247)..(247): n is a, c, g, or t
  misc_feature (280)..(280): n is a, c, g, or t
  misc_feature (282)..(282): n is a, c, g, or t
ttataaatacgtttagctgtagactttgtacaaatgcatttttatgtggaagattaatatataaaataggactaaaaagaactattcttaggggtggggtatggggagatgtggtcaaggacacagaattcattnagggggaataagtcaagagatctctgtacaccatgatgactatagttaacantatattgtatacatgaaaactgctaaaaattnnaagtgttcttaacacaaaaaagtatgncaagtaatgcatatgttaaatagcttgatttancnattctacgatgtatgcatatatcaaagtgtagtgtaccataaagttataatgttcgtcaattaaaaaaatatttttagaaaaact

SEQ ID NO: 617638 - DNA, 267 bp, Homo sapiens
gccctctccaggggaccagttcaggaccccagctgccccccaggatggctatgagctgggagaggtgagtgggggaccttcactgatgtgggcaggaggggtggtgaaggcctcccccagcccagaccctgtggtccctcctgcagtgtctgaagcgcctgcgtcccaactgcactgccacccccaggagttgactgcatgaatttgttcctaacagcactgacacctcttgctttcggtttactagattaaacggggccgttgaca

SEQ ID NO: 617639 - DNA, 985 bp, Homo sapiens
agtgacacagccgctttctttttgattggtgggggccacaaatatatttttttcgggcccggcccgagttcttctgtattggcccccggtgttccccgtatagcaggggccaccgagatcccaaggcaatacttccccagggaactctctggagcaagggcccgaggacctctcccttgccggttgcccgccccggaggcccacctcccacggcttgcaagattccgaggttcacccttcttaaaggacacccacgccggtggattccctaatacacgttccttctgtcagtaaacaatcgcttttctccattcaggacttctgttccttacgacgtttttccttctgcagtggctttccgagagccctgggaactgctgcccctgcggccccgtctttggcatttccgcctctgggttctcgactcatggccgggtggcgctggcacagccttctcccctggccggagtccgtggcccagtccctgccccttgtgggaagtcaccggtcacacgaggggccccgctgtcctcaccctgtctcgaacacccaagcctgttctgggtgtgcgccactttttgtgcttttatggttaattttattgaagggcccacggagtctgtagttcgacctcaacctcagaggacgatctttggacctcttggacaccacgagggagctccaacttgccccaacaaccgaggggcggaacccacgctacacatgcctacaagtcaagttacctaagccccctacctttagcttctgtgcatccgcggggcagcttttggaagcggggttttctggggaactggcgccatcgccgggagctccagaactgcagatagcctccccaggttcaacccctggatggacggcgcggctttttatagcacacagggcttaacatcgggtaccccccttccaaccacaccgccacaattaagatctgccccacacctccaccctccaaaaaaaaaataaa

SEQ ID NO: 617640 - DNA, 179 bp, Homo sapiens
ataggcgaacgtacagtggagaatgtgatcagtgttcggaacggcctcggccagcaagcacgaggcactgaaggagaatggggtcacactatcccatcgacttatcacacgactgacgtacgtgggatgagatcaaagaagatttccccttaaaggaggtggacattgtcatggtaccc

SEQ ID NO: 617641 - DNA, 331 bp, Homo sapiens
  misc_feature (12)..(12): n is a, c, g, or t
  misc_feature (33)..(33): n is a, c, g, or t
  misc_feature (41)..(41): n is a, c, g, or t
  misc_feature (48)..(48): n is a, c, g, or t
  misc_feature (60)..(61): n is a, c, g, or t
  misc_feature (91)..(91): n is a, c, g, or t
  misc_feature (123)..(124): n is a, c, g, or t
  misc_feature (147)..(147): n is a, c, g, or t
  misc_feature (179)..(179): n is a, c, g, or t
  misc_feature (202)..(202): n is a, c, g, or t
  misc_feature (313)..(313): n is a, c, g, or t
ttttcgaggtcnacaactttagctgggattttntttctgcntaaaatntaggagcgattnnaattgaactattcttgattccaggttggancctgttggaatatttggctaaaggaccagttnntttagagctaagacatgtaaaanatcccaaatggcagtacctcattgtttacttnagcttttggtacgttatatgttntcagaggaaaaagacactactgtaaattgtgaatagccaatacataactgtattgtatgcaaatctgtgattgttggcagtgtcatctctgagaaacagataaataaagtntatttactatataacatt

SEQ ID NO: 617642 - DNA, 630 bp, Homo sapiens
  misc_feature (450)..(450): n is a, c, g, or t
gggctcaaaaaaatacctttcccctcccccgcgagatttttctcccttggggggctccaaaaaagggtggtttggacaccccgtgggaagagtgtggggggcgcccgtttgcgcccccccccctggggggacccttcttttacaccccgtgggtgtttgtggagcagttaatttgtccaaggccccacccccgggttcttctcccctttacccacggggggttctttgaaagggaccttttttttctatccctcgggccacgggaggggaaaaccccggcctataggggggttaagagccccccccttttttccccccccatttgggggggtcttttccgcccccccccccaaaacggggttttttttcgggaaattggggggcccccctttttttaggggggcccccgggggccccccccccccccccatttctttttccctttggggnttgggggggggtttgccccccccctttggttttgggttttcctccctggggggggaaattttgcccgggttaaaccccgggggtttgggcctttaccaaaattgggccccccccaaaggggggggtacccccctggggggtttttttaaaaaaaaaaaaaaaccttttttttttttttta

SEQ ID NO: 617643 - DNA, 1576 bp, Homo sapiens
tcaaactttagaactttatttataatgataatttttatacttttatttactttaaaaaattaatttatatttttccattcatttaaacaaagagttaggccgtgagttcttcagtgccttttgtgcacagctttttacctttcaaagaaaagtttatctgtgggtaagaataggcaggaaattatgtgtgggaaatgtgcaaatttaaacagttcttacattatcttcttaattattgtaacagttcgtgtgtaaaatatttcctttttctttctcgttttacgtgggaatttgcaagcggaaaagaattgtggttcgtggtttattccacaccacaaatatgagacacgagacatatctggggaatatctccttattttttgagagaagagatcaatataactttttctgtgagaacctatatatattatgagagaaaacatattttcttcttctattcctatcacagatatgaacagacacttcaatatctatcagactatctattattctcctgtgtgtcaccagagcaaggcttcacgtgggtcttctcacactcccttttctatgtgagagagagacccaaaacacccgaggggtctttttattcctcaagtgtgtcaccacacacacactatttatctccaccgaggcttcacacccaaagaagcgcacaaaaagtgtggcgtgggcctcatctcaccattcacggggggaaaaccccatatttattttctcacacaggggttgtaaaatctctcacggactccacgatttatttatttaaccgcgggcacaaaggaactatttgttattttacacggctaattgcctgtggacaccatattatacacccactctgttggtttggcaaccctcttcccaggggaacagataatcaccgccgtggtggctctccttcctttttaaccgtcttctacttcttcaacaccacggaaaggcacaccacctctgggggcgcatttccccaggggctataacccgccagggttctccacacaagctttttttcttctgcttaacccacattgtggaggatttcttatgcgtgggacgtctttctccgtcaacagccccatgtattgcctttggtctccccctaaaaggggggggggttacaacacaaagcgtcttttctacatcctttgtcaaacagaccccccctgtcagtttctcaactggggcgccgccgcttataataaaaacaggcggcgcacccacattaaacaacacgtcgcgtcgtccacaccctgttcagcacaacacatcattctttggtgggccgcacaccgggacagcatacaaccctcctgcgcgttataaagttcaccgcacacaacatatcatgtgtggcaccccccacagggggggcgacaccctctctcgcgtcgcacgaagtttcctctgctcattctatcttacgaatacacgcgcgtgtcggtatttaatactcacacccccacaaccgtactaaccgtcgtctgtgattcacacacgcaccgtgcaccagcagtacatccctcctctaccacaacagctctgccctccagcctgc

SEQ ID NO: 617644 - DNA, 208 bp, Homo sapiens
cccgcgggcggggacgaggaacaggaaattctggaaacaagtggctaactttcgactcatgttgcttggagaattgatgtgaaccctgcggagtgctaggatgagaccccagtgtcatcagtgccagcggctcacggaacactcgccaggttggtctgagattgaagtgtagacagacagtacatgcaagagacttccgatggcgtgc

SEQ ID NO: 617645 - DNA, 279 bp, Homo sapiens
  misc_feature (142)..(142): n is a, c, g, or t
  misc_feature (154)..(154): n is a, c, g, or t
  misc_feature (160)..(162): n is a, c, g, or t
  misc_feature (167)..(167): n is a, c, g, or t
  misc_feature (177)..(178): n is a, c, g, or t
  misc_feature (185)..(185): n is a, c, g, or t
  misc_feature (203)..(203): n is a, c, g, or t
  misc_feature (240)..(240): n is a, c, g, or t
  misc_feature (243)..(243): n is a, c, g, or t
  misc_feature (248)..(248): n is a, c, g, or t
  misc_feature (254)..(254): n is a, c, g, or t
  misc_feature (268)..(268): n is a, c, g, or t
atcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggntttttttcacantttttnnnggggntttgggtaanngtttttntcttttcttgactttttntcctgaacacttatgtcttagcaagtggtcaacatgnggntttgnccgccnaattgtcggtaaanggttgaggcag

SEQ ID NO: 617646 - DNA, 930 bp, Homo sapiens
  misc_feature (470)..(470): n is a, c, g, or t
  misc_feature (473)..(474): n is a, c, g, or t
  misc_feature (476)..(476): n is a, c, g, or t
  misc_feature (481)..(481): n is a, c, g, or t
  misc_feature (483)..(483): n is a, c, g, or t
attccgagcctcgggtaccctcccgtaacgagcgccaaagaagtatattacataaattattggaatgatatcattccacttgtagatcccagagactaataagtaacacaggatttcttatgttcttggtcaaatctgataaaattaaagtcatttttgttccttaagtttctttagttgtacatacagaaattagacgatgaaagaatatttgggctgcatatgaagaggcaagacacagttataagatagagaacttgttttaaagaggacttcaatattcccacagtttcaagtttgtgattacctgtcaagaagactcaggttgtgtccccatgtgttaactggtcctgtcctctaagtgttagctctcctatgcccataaatctcaaagtagctggggttttaggctgtaaactttagctacttttccttttcatctcaaaagaatgaagaaaactggctgggcncgnngnctcangnctgtaatcccagcacttgggaggctgaggtgggcggatcatgagggcaggagatcaagaccaccctggctatggtgaaaccccgtctctactaaaaatacaaaaaattagccgggtgtggtggtgacagacgcttgcaatcccagctacttgggaggctgaggtaggagaatggcgcaaacccgggaggcggagcttgcagtgagccgagatggtgccactgcactccagcctaggcgacagagcgagactccgtctcaaaaaaaaaaaaattgaagaaaactaagtcaggcttagtggcttgtgcctgtagtctcagttactctggagtctgagatgggaggatcacgtgatccaggcaagcgttcgaagatgcttgtgctgtgatcacttctgtgaatggctacggcactccattctgggcaatgtagagtggagaccctgtgcc

SEQ ID NO: 617647 - DNA, 300 bp, Homo sapiens
ggctggagtgcagtgacaccgtctcagctcactgcaacccctgcctcccaggttcaagcgattctcctgcctcagcctcctgagtagctgggattacaggcgtgtgcaccacacatggctaattttttatacttttagtagagacagggtttcaccatgttggccaggctggtctcaaactcctgatctcaagtgatctgcccgccttggcctcccaaagtgctgggattacaggcatgaggcaccgtgcccagccaaaaagttttcagttagaacaaaaatggaaaacagaaccacagt

SEQ ID NO: 617648 - DNA, 110 bp, Homo sapiens
tactaacccggacgacaataacccggacgacagataacccggacacaataacccggctgactataacccggacgacaataacccggacgaaattaacccggacggatgag

SEQ ID NO: 617649 - DNA, 360 bp, Homo sapiens
ggattaaagttcttttgatcccccttcggcccccctttttgggaaggtttgggggaaatggttgggggattttgccggggcttttttttacctaagcccactttattttttttggcctggaaaaaaatttgccccttttggttttggggtttacaaaggttttttccgacttggtttaaccccctctttaaactaattaaaggcttgggccccttaaaagggctctaaatttgctggccacaagaggctttttttttttcccctgttgggggccggggggccccccccttttttcccgggggggggccgcccccttagggccggggttggtttttggttttaaaatttttttacccccca

SEQ ID NO: 617650 - DNA, 327 bp, Homo sapiens
cccgctcggggctggtgcgctcaccagcactgtaactttctttcatgaattcccactgatcacaaaccccacaccaccatctcactgacaccatgttcaaccatgtcttttacttacaaattccaggaactggtcttaggaaatccaagtatcaaaccaaggttgtggagtattccacctcaggaaggaatgctgaacaactgatttacagacttgttgccccagctagaccaccaggtagcccattactcaaggtaaccattacaaccaaatagtgctaacctgcataccctacccctcacatgctttgccaagccccagctgcgg

SEQ ID NO: 617651 - DNA, 684 bp, Homo sapiens
gaaatggatcagagcggggggtgtggacttccatctggagccgggacaggacctcagggggcaaatgacgaccgtctgtgacacgcaggcccacgtctgtgctagaaaagccaccccttgatatggggcgaggatgggacccgagagaccctcgccccaccctgcactggctcagcagccgggtccagactcccaggcctctggaaaacgaacctcggggggacgcagtagggtcacacagggcttcacccccagctcgggttcagtcctgactcagagacgacccggcccccacgactggaccccacaacgcacagggcccccgccggccaacaagaccaaggtcacgcacagcggtgctgggatcctccagaggactccacaggggaccgagggcctgcagggattcgaaaaccagtgccggacgcagccttcctcccttacagcaagagctaggagataaaacaggcaggccgggagagcagggcccgggtcgcgccttcctcacggctggaagcctcccaggttgacgggaggaatgatggggacggggcggggtacttggagaccttcctctgtcagatggctctgatgtttccactgttgctgtgagcaggacagggttaacttggcagctggctcctccacaccctgagcgcccacatccgtgccctccttgccccg

SEQ ID NO: 617652 - DNA, 803 bp, Homo sapiens
ggaatggtgtgtgagatgcgcaggcttgtgccatctggcctgcgacgtcaatgtcaaattcgcgccgacgcgtgtctgtgtccttggtcggagacctcatcgtgctacccatgcatttcagaactcactgccaagtagccctgaacaagtgagccaccatgcagtgtcttcagacttcattaagacacactgcatgatcctcgttcaatttgctcatctttctgtgtggtgcagccctgttggccgatgggcagtctgggtgtcaaatcgatggggcatcctttctgaagatcttcgggccactgtcgtccagtgccatgcagattcgctcccacgtgggctacttcctcatcgtggccggcgtggtggtctttgctcgttgggtttcctgtgctgtatatgtgtgctcaggactgttgagcaagtgtgccctcgtgacgtgtcttcttcatcctcctcctcatcttcattggctgaggttgcagctgcctgtggtcgccttggttgtgcaccaccaatggctgagcagcttcctgacgtatgctggtagtgtctgccatcatgaaagattatggttcccaggaagacttcactcaagtgtggaacaccaccatgaaagggtcaagtgctgtggttcaccaactatacggattttgaggactcaccctacttcaaagagaaccggtgctttcccccattctgtggaatgacaacgttccaaaaaggcaatgaaccgcccagcaaaggtcccgacacaagttagggtgtctcactccgtttgtggaatcgaaaatgcgcccggg

SEQ ID NO: 617653 - DNA, 667 bp, Homo sapiens
aactacaaatcctaatccaaggattcccaaatcagcccgcacatccacacgtagagcccgccacgaacctttctttctaactaccctccgctcccgcccgagaactcgattttactaaactacgcgcctccagaagctcgattctttatatttcgtattatttcgtgtccgctgatattgcgagggctactacgggccgaaagccggggatccgtgaattctggttctgactatagcgctgatagagtagatagctactaacggattgctttgtctgtctagcctcgcctcccgtatgcggggttaaatctatgtacgcgtttataattctgggtcctaagatccgggtcgagattctttatacggggtgtgcatgactgaatcctggcctcaagagtcctagctcgatctaaaagggaacacgagtcttaaaagaggggcggctctttgaggagatctcaccttcgatagatagcggagtctctcctatctctcaattcgcgggtattgccctggctggtccgtcctctagtatcgcctactggcggcttcccctataacgtcgggccgatgacccgtttacgactgatgcgggcgcttctttgcgtttggattttatttgcagagtttgacctgcggtcgtgagaactaccgactaaattcgggt

SEQ ID NO: 617654 - DNA, 373 bp, Homo sapiens
  misc_feature (13)..(13): n is a, c, g, or t
cccgcccattcgnggtgctgctggtgttgttgaggtccctgggagcattcttctggacttcaccatttctccaaaattatcagcgcagtcagcttcatatacccagatatggccacttctacacgtgaaattcaaactgaagataaaactctgactttggagtataaacttttgccttgagtatgaaaccttgacattgctgaaagaaaagtggaaactgtaagggacaacaagtttcaccaaggcacagtcttctctgataggccagcagagcagctaaggagaagacagatcattcaagaacttaagtcatttgttagctacagcatttccattgctgtgatacacattcagccattctggaggaaagcta

SEQ ID NO: 617655 - DNA, 300 bp, Homo sapiens
  misc_feature (12)..(12): n is a, c, g, or t
  misc_feature (27)..(28): n is a, c, g, or t
  misc_feature (34)..(34): n is a, c, g, or t
  misc_feature (171)..(171): n is a, c, g, or t
  misc_feature (189)..(189): n is a, c, g, or t
  misc_feature (205)..(205): n is a, c, g, or t
  misc_feature (271)..(271): n is a, c, g, or t
aaacccgtgccntggcaatccctgacnnaccgcngtgatgcccagggaagacagggcgaccgtggaagtccaactacttccttaagatcatccaactattggatgattatcccgaaatgtttcattgtgggagcaagacaatgtgggctcaagcagatgcagcagatcccnatgcccttcgcgggaagnctgtggtgctgatggnaagacaccatgatgcgcaaggcatccgagggcacctggaaaacaacccagctctggagaacttctncctcatatccgggggaatgtgggctttgt

SEQ ID NO: 617656 - DNA, 142 bp, Homo sapiens
agtacggtgagaaggagctgaggatgtctaaggaggggagatcccgggtggtcagaaagcactggtgtctggaaagcatttaagtgctttattaaatgttagtccctgctgggcatgacggctcacacttgtaatcccagca

SEQ ID NO: 617657 - DNA, 882 bp, Homo sapiens
  misc_feature (5)..(5): n is a, c, g, or t
  misc_feature (65)..(65): n is a, c, g, or t
  misc_feature (74)..(74): n is a, c, g, or t
  misc_feature (76)..(76): n is a, c, g, or t
  misc_feature (86)..(86): n is a, c, g, or t
  misc_feature (99)..(99): n is a, c, g, or t
  misc_feature (125)..(125): n is a, c, g, or t
  misc_feature (131)..(131): n is a, c, g, or t
  misc_feature (135)..(135): n is a, c, g, or t
  misc_feature (140)..(140): n is a, c, g, or t
  misc_feature (146)..(146): n is a, c, g, or t
  misc_feature (154)..(154): n is a, c, g, or t
  misc_feature (173)..(175): n is a, c, g, or t
  misc_feature (179)..(179): n is a, c, g, or t
  misc_feature (181)..(181): n is a, c, g, or t
  misc_feature (191)..(191): n is a, c, g, or t
  misc_feature (205)..(205): n is a, c, g, or t
  misc_feature (212)..(212): n is a, c, g, or t
  misc_feature (217)..(217): n is a, c, g, or t
  misc_feature (223)..(223): n is a, c, g, or t
  misc_feature (235)..(235): n is a, c, g, or t
  misc_feature (241)..(241): n is a, c, g, or t
  misc_feature (257)..(257): n is a, c, g, or t
  misc_feature (260)..(260): n is a, c, g, or t
  misc_feature (266)..(267): n is a, c, g, or t
  misc_feature (314)..(315): n is a, c, g, or t
  misc_feature (338)..(338): n is a, c, g, or t
  misc_feature (429)..(429): n is a, c, g, or t
  misc_feature (494)..(494): n is a, c, g, or t
  misc_feature (671)..(671): n is a, c, g, or t
  misc_feature (729)..(729): n is a, c, g, or t
  misc_feature (804)..(804): n is a, c, g, or t
  misc_feature (809)..(810): n is a, c, g, or t
  misc_feature (817)..(817): n is a, c, g, or t
  misc_feature (859)..(859): n is a, c, g, or t
ttttngaatggcaggattaacaatatctaaaatctcacttgtaggagacaccacaggcaccaganctgccactngngctggcaccngctccaccaaggncagggaagagcccaaatgtgagagtnggggtnaggntggcnccagcnctgaagcnaccactggtgctggtactnnnactngnactgttattngtactggtactggnaccagtnctggnactgcnactctcttgggntttggntttagcttctgctccngcntggatnngggctttggcccagggtccgatatcagcttcgtcccagttgcagggnncggcagcattctccgagccgagnccaatgcccattcgagctctaatctcggccctagccttggcttcagctgcagcctcagctgcagccttcaaatccgcttccatcgcctctnggtactgagctgcccattccttgggatccttcttttgtaccttgcaggcaaacttgaggactttnatcttgctggtctcatagtaagagcgcaggccccagaagaactcatattcagggggattgctattggggactctggcatagtccaggtacttctgcttcacaaactcatcagtgatgagcttcttcacgtccccaaagagtgaatgatgtatcccagggcgcaccaaacttgcgcanacctcccagatgacagcctcactggaccgatttccattcatgaagatgatgctaagangcacatgagcagaccagcttgggtgagtcttagtcgttccagtatgcctgcatcagtgggtctaagtgtgagagnatgtnnagtggtnttcttatcatttcttcaattgaatccaatacttctccaaganagctgctcgttcatgattcgggg

SEQ ID NO: 617658 - DNA, 101 bp, Homo sapiens
tggactctccggacttctctgttctcctccgtcttctcgggcttggtatttaccatgctcttgctgaagccggaggaggactcagagaaggtccaggtatg

SEQ ID NO: 617659 - DNA, 337 bp, Homo sapiens
acgcatctgtgagccgatctccacttgccattgtctctctacaagaagttactcaactgtaaagcctgcctaggaagacttaaaggagttgtcacccagtgaaggaaggagtctccaagagctgtttagatttgcccggggaggatgtggaggagactttctgcctcaacttcacgatctgccgagaaagctatggagtgattgaacagaaaaagctgatacctgggggagataatgtaactgtgtgcaaggataacaggcaggaatttgtggatgcttatgtgaattatgtcttccaaatctcagttcatgaatggtacacagccttctctagtgg

SEQ ID NO: 617660 - DNA, 861 bp, Homo sapiens
  misc_feature (144)..(144): n is a, c, g, or t
gaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaanataaattattaggaaaccattaaaatatgtggccaagacagctaacaaggaccaccttggtttacagccttataaccatcttttggaaacctaagcgtttaggggtaactgaaaggttatacagtaaaggtgtctgagcaagtaaacaaaatgtgacgcttcatgaagataaaaccaagagaaaccaagtctgaagagaccctggatgagggtccaccaaaatatataaatctgttcctgaaaaagggagataaaaccaattttcccaaaaagggagatgtgtgtcactggtggtatacaggaacacttacaagatgggactgtttggatactattattcaaacaagtgcgaaggaagaagaaaaatgcaagccttaaagttaaggtcggagtaggcaaagttaatcagaggatgggatgaaggtctctgtgaatatgagtaaaggagaaaaaggtcgatggagattgaccagaatgggcttagggaaagaaggacagctgatgcaaaattcacaagtgaaagctcatttggagtgataagtggtatgatggaatagagggttcagctaggttaggaatgtaaattgttgaaaattaacataagtgatttgcattggaggaggcctggatcaggggaattgttttggccttgaggaaccagaacgggaaattacgggaaagggaggttcttggagggaaaggtttggaaaaaatggg

SEQ ID NO: 617661 - DNA, 298 bp, Homo sapiens
  misc_feature (45)..(45): n is a, c, g, or t
  misc_feature (94)..(94): n is a, c, g, or t
  misc_feature (98)..(98): n is a, c, g, or t
  misc_feature (135)..(135): n is a, c, g, or t
  misc_feature (166)..(166): n is a, c, g, or t
  misc_feature (191)..(191): n is a, c, g, or t
  misc_feature (219)..(219): n is a, c, g, or t
  misc_feature (259)..(259): n is a, c, g, or t
gaaggttagctgcacaaaaatacaaaaaatacattacatggagtnccttaaaaaatcccctttttatgttggcctcaaacagagagagatctancccnggttggaaaatgcctaagtattaaaattctcctttcncctcaggctggaaggccctgtgttgaagtanggtaagaagagcaactagggtgacnggataagcatctgtaaggatgggcagcnggacccctggtcatgttcagaattatttgacgacttgganccaatgttctctaattaataagcttggtgagttattttc

SEQ ID NO: 617662 - DNA, 502 bp, Homo sapiens
ttttaagcggggggtttttatttctcccccccttccaagggggttttgaaagtgcccgggggggttttttcccgggtttggggtttcccccccttctggggatccccccccccaggggggggcccccttaggccccccggggttccccccccccctggggtttttcctggggcccctggttccccgagggcccccaaaatccctttgggccctccccttctgggggggccccctttttggtttgtttttatccccaaagtgtgaaatttttcccggggggggggggttgggccccccgttccttccccctctttttttccccccgggtccccccccccaaggggatttttttggcctttatgggccccggggggtcctccccctgggtttttgggggggctttttttggggttttttcggggggtgggccccccccggggccccccccccccccccccccccgccccttccgggtttttttttttggtttgaggggggggca

SEQ ID NO: 617663 - DNA, 117 bp, Homo sapiens
ggctgcttgaggatcccctacaagaccctgacgagatggctgctgctgaagaaaaagtggtagaatgaacaaggggagctgaagacctcaagaagccagaggggcagaagcaggaag

SEQ ID NO: 617664 - DNA, 1324 bp, Homo sapiens
ctgctgtgaggtcgaagcttccagtgtagctggaccgcagagactgaccacagtgctctggacatccatgagcccaatgtcccccacactcagtgcagtgatgatgtgcggaatgtgaagtgtgacatgggcagaaccagtgagcaattatcttgctccgtagccaagtcgtgcaatgggggcagctgttggccacactcatccatcacggtgcttggcagtgccccatggttgtctactgtagttattggagacactgcttgtggacattgcaccaattgtatacgacagacgcatggctagagagttgactattgccatctaacctatcctggcttgcgtcacagctgttctgcattcatgcggaccatactgtctgacatacctatagcatgacagtcccggggaatcattccatcccactcaaccagaagggcatccagcacgcaataaagcattcggaacaccctcatccagcttgctatccaccgccattggcaagccgtacaacatggttacaactgctggtcactcccccactatatgccaaagatggatgtagcatggagcagcgctccatattgaccccatagacggctaccctgttgccggcgcacagcctggcaaagcacccctctgatgactagcagtgccttgttgctacatggcactaggaaccgatcacaaaccgactgtggcaccacccctagaaccccaacgcagccacaaccccacgccgggaggacgcaggagaaaagcccctaccagccaacacgggcccggtgaacaacgaccaagcgccccagggcaccaaacagcacacacacgtaggcccccgaaaacaccctgcaaacgagcacatggggacactgaaagacaaccatgacacaagagaccagcagtcacgcgccaccagacccacagacagcgcacccaccgcctgacaccgccgcccgcccacacccacacacccctaggggacgcccccaaacaagacgagggcacctgaaacaccacgcacaaacatgaggaggaacacctgaagaccaaccacaaacacaaacacccaacacaccgcacgcacgcggcagagacagcgaccctgccacccaccaacacagcgagaccccccgaacacccgcctgagacagcccacgcgatgaacacatgccccgcacaccaacccccgccacacacacaaacaccaccacgaggcaacggtgaccgcggtacacaacacaaagcgcacacaccacagcacccgcgcgccacccccacgaccacccacccacccagcacccaccaacaacacccaccaagagaa

SEQ ID NO: 617665 - DNA, 697 bp, Homo sapiens
  misc_feature (29)..(29): n is a, c, g, or t
  misc_feature (289)..(289): n is a, c, g, or t
  misc_feature (360)..(360): n is a, c, g, or t
  misc_feature (365)..(365): n is a, c, g, or t
  misc_feature (380)..(380): n is a, c, g, or t
  misc_feature (384)..(384): n is a, c, g, or t
  misc_feature (390)..(390): n is a, c, g, or t
  misc_feature (394)..(394): n is a, c, g, or t
  misc_feature (414)..(414): n is a, c, g, or t
  misc_feature (426)..(426): n is a, c, g, or t
  misc_feature (450)..(450): n is a, c, g, or t
  misc_feature (467)..(467): n is a, c, g, or t
  misc_feature (528)..(528): n is a, c, g, or t
agcgggctgtgcgtcttgggttggcgtanccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagttatagcgacatgcctcctttgacgttagagggcattcaggaccgtgtgctttacgnattgaaactctatgacaaggattgacccagagaagctttcaagtaaattctcattttatgaaagacctgcncttanacagtttggaccaantggngattantcangggccatggaagacgaattngggtttgaaatncctgatatagactgctgaaaagtnaatgtgtccacaagaanttgtagattacattgcagataagaaggatgtatatgaataaagtatcagaccctttggctntgctgagagaggactcagatgatagtgacgaatgtctggcagtgaggacacattttggcattcttgctgactctgacagagtgattctgatggacttgcatttaaaatggatgtggtttactctttggaaaataatctataaaaccaacattttccctccaaagaaggt

SEQ ID NO: 617666 - DNA, 1443 bp, Homo sapiens
  misc_feature (1370)..(1370): n is a, c, g, or t
ggaagctcacgctcgcaatcgtgatccagagggagcgaggaggtcctaaatcccgtaactcctggtagtcgttagtttaccgctcatagcgaaatatgaggcctccacggcgaatgagccgcggactccatggacagcgaggtaagattacagaagactggattgcacacatcgatgatcgagtgacgcttggtggtggaatatggcgcaactcattactacctgcctaacaatgcatactcgttggcactataccgagtagtcactgtgcacaactcccaaggttggtgcagcgcagcgtagacgtcggaacttcctacgagcttgtggtgcccgactgtcattccattccacatcggcgtatcccagagacattgtgacccaacgatagacgtcgatgagctcttgtaagccgatcctgatggagccatcagggagacactcatcctgagatgctaacaggaccgactcgaagctccttgcaccgattcggaagcattcaggacccatggctacatggttccagaaggctatccaaaaccttgggcgtcacgcaaatcggagacgtggtgggcggcactggtcgcgcgcgctgtgcaaatttggcggttgattgcccagagggtccccttggcaaggaaatgccccccgtaccgtgacaaagtaagttccaggaaaagcttgaaagagctttcccaagaaaaactatgtcttatggcctttgtaatcgagggagaggggaccctggtggctttgaccgaggggaatacaccttaggatcccccatggctaattctaatctttaactcagacggatctctccatatgctccccccatattcttctttgacaatcgtgggaaggacctttgccctaaaaactaaccaatgcatccgttaggtctaacaatgtcgtaactttctggggtggcgtggaatcaagacttgggggtctgccttagaccatttcccattggctctttcctttggccttggaaatgtgcgggatctgttaccccgtttgggggatctccccccccgatgatagtgtccccgcgtccctgggtaacacacaatggcccttgggcaaggagcctagaggaaggtattaaatatgtggcacggagcgccctttgcttacaggtggagcatgtggacccaagagttcatggtgcctgaaaggtcccttcctctcagaggccccgtttccccgcatatggtctttccgatggcggggtccccaaaatggtcgctgaggcatcttatcacacacgggtaatggccttccaaccggggggttaaaggccactaacccacaccctcgaacccaattctcaaacgttggacagggcggcctagagcgtgattacnccgggcttgcatgtctatagattgcgcccaggcgggcccctattgaaaagggagactcttcccccctccactg

SEQ ID NO: 617667 - DNA, 876 bp, Homo sapiens
  misc_feature (29)..(29): n is a, c, g, or t
agcgggctgtgcgtcttgggttggcgtanccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctctgctgcagtgtgactcgtggtgactttgcttgcctgctatgtgcaatggtgtcagtggatttggtgccctggtggggtgttgggggtgcctgtggtgcatcctggtggctgctgccagctgcaagtgcagggtgtgaccctggtggggcagccggctcgctccgcagcccccgctgcctaaaggtgtttagttgacccctgactgggagtgccgggtgacctcgtaataacgagcaagagcacttgactcgagtccagcactgctggtgctgccgcttaccgaaacttttggacaagtctcctagcctggctcacactcacctgcaaaattgggatcctggtctctaccttgctggagtagcaatgaggattagatagagttaatgcgggctagagcacctcgtcacggtatcaaaatacgcggtcaccgtaatagtaggtgaaagcagcatgcaaaggaggcagccaacactggcctaacagccttctccagagcggtttctctctgcagttctgtccttactcttcctgcgcacctctgcctgtgtcagggctctggcagtatctatgaacagccagtgccttgaccaaaggttgattggcggtccatatgcggttttcccaccaccggccggttggttgccccgtaggggggcgccaaaggccagggaggggcgagaaac

SEQ ID NO: 617668 - DNA, 440 bp, Homo sapiens
gggttgtcgaggcgtcgccaactcacatgaaggggactgactgtgggcacgactcacttctccactggtctgctgttctgaaatcatctgattggctttctgatcgtttggcagggtcgtgactgctcaataccctcactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtct

SEQ ID NO: 617669 - DNA, 361 bp, Homo sapiens
agcaggtccatagcttactggagcaacaagggcccagccgacgtgcggttgaagctcgagctgctcaagcagccctgagacgagcacacagctggccgtcgtgacgatgtcccggcgctgtgaactcagaggagaacttccaagaaccgggaaaactcgccgcatcagatccagcacgccttacgtgtctcggtcctgaccgatggcaggaggagacgcgccgctgaatcggcgcgttttcgggctgcacaaaccacgggacggagcctcgagcaggcgtgcgaatagcagctgcagcgcatcaggtctggacgcagagcctgaaacctcaagcccaggagccagcatggatctcactacg

SEQ ID NO: 617670 - DNA, 1367 bp, Homo sapiens
gactgtttctttaaaaaaaaaaaaaaacaattgtgtccttcccctaaaatgggcttatcatgtgatcagggattccagggcagtggcagaataaattactcagaaaactatagggtcataggccttttatacaggtaaggttttggcattaaaccctggtgaattaaggggaaatactggtgggctggtggtgtaaacaatatggaaaccaagaatcttctgcccattattttaaaagggttaatttcctgggtgtgggggtgttgcgagagagacacaaaaagggacgggaacaaaatctacaaagggaaaagataccacacgcagagagccacgcggaacagaaaaaaagaaaaaagataaaacaccagtaaagaagagaagaggaagagaaaacaaaacaggcaagaacagcaacaaagcaaaaaaaagaacgaacaggcacgcggaagagaggaaacagacgaaaaaaaacgaagagaaggagaacaagcaggaaaagacaaagcggacacagacagaaggaaaagaaagagacaggagaaaagggagaagaaaagcggaggaagcacgggtcaagacgaggcgagcagaaaggcaggagacagagcacagaaagcaggaggcagagaagagagggcaaggagagggagagaggcggagaggggccaggaggcagagaaagggacgggaacaggaaggagcgaagacgacaacagaaggacaaacagaagaagaacaacagaaaggggagacaggagggcaaggggagaagggaaaaaggagcgggctgggagaagagggaagagaagaggagaagaagggaaaagaaggaagagagagggagagggaggagaaggagaggaggagaggaaaggaagggggaaacgcagaacagagaaggcgaaggaagagaggggggagggcaggaagcaggaggaaagaggtggagaggaagagagggagggaaagaagaaggagaaaagagagagaggggagagaaaagaacgagggcaaggagggagagggagggaagacgcgggaagaggagacaggaggaacgggagggaggaggaaagagagcgaaaagagaacaagagaaagaaaaagagagcagagaggacagagacaagcaggagagcggcacgagagacggagagacagcgagaagacacaaggagaagagagagagaaatgagacagaggagaggaggaagagagaaggagagaaacggagacgagggtcgaagagcaggggacgaagagagacgaggaaagtagagagaggagagagagaagagaggagagagaggaacggaaagagacagacaggcggaggagcggggggagagagaagtggggacggg

SEQ ID NO: 617671 - DNA, 135 bp, Homo sapiens
tcttcctggtggacacattgcccccctttcatgcagtcggctctggttctctcccacctctctgaccattccttctcaggctcctttgcgtgcgaggcaatgccatagtcccaactacttgagaggctgaggtgg

SEQ ID NO: 617672 - DNA, 365 bp, Homo sapiens
tccccccgacccccccttccatggggccggttccccgattcctgcccccagttctccaaaaaaccaaagggggtttgtgaaagtttcaaacgggggcttttctgtggccgggccacaggggggggcccggggtggcctgacctcccaggaaagccggggggccttttcccccccacccggttccgggccattgagactgggttttgtcccccgtttcgcccggaactttcccatgcccagccctccctcagggggcccgcccgttggggaaaagtcggcccttgggttttttttcttgagtcattttatttttatcatggaatagggggggccccgggtcccccccaataaaagggtttttccta

SEQ ID NO: 617673 - DNA, 222 bp, Homo sapiens
ctagaggatccccccgtaccaccctgaagtcaaaaaccatgggactccttttggccatagcactggagagcattagagccagtccaaaagcacctccttactcagtccatttgagttaatatacggacgcccctttcctccttacaaaaacagggcccccttctaaactctcaggctaaggagaaataaccttcccaaacaggtcttccccttcaatggagc

SEQ ID NO: 617674 - DNA, 275 bp, Homo sapiens
agcaagtggaagcaagccttcaatgccacggttgtggtgcggcacatgaggaaactgcagctgggcaccagccaggaggggcaggggcagacggctagccatggtgagttgatgacaccagtggttggggcagggccggtagttggctgttgctgtcgagactgctgcgtggagccgggcacagaactgacccccccactgtcctaccaactctagggccctgaacctcgggtcatgatcctccgcgtgggagggctttgtggaagcctgctact

SEQ ID NO: 617675 - DNA, 610 bp, Homo sapiens
gtcgccaaaacaggatggggcccaatttggcttggagcttcgttccattgagagtctccctttggttcccccgggaagcaacaatgggccatgtgataaccgcatagaagagaaagctcctcatttggggcacacaacccctcaaagaggcccacccccctcttgtgagaggtgcttttccaacagcccaaagaggaattgtggctgtggagaaaattagggaggtgtgagagccccaccagacccagcatattctgcccctcctagaggaaagagtgtaaagggtgcccacctggaatcaaagattaggcaaagaaaatcccgaagcccctgtgtagaccccccagagcgcggtggcttgaaactcttatttggaggggaaattaatgaaaatgttcttggtttgctgggagtattggtgtcgcaaaagttccacgctgttggtggataatttctcggagagtgcccctcttaagggggtgttccagaagtaagcccactgttttcctgcttttggccccataacacaaaggccaagagaaggggaaaacccaaatcaaaaaaatttaagggggaaaccccttggaaaaaaattttaaaacccaaaaaa

SEQ ID NO: 617676 - DNA, 145 bp, Homo sapiens
ggtacatgaacccaagtagaaagtggacttaacaaagtatctggagaaccaagcattctgctatgactttgcacttgatgaaacagcttcgaatgaagtcgtctacaggattagtcccattgcatccactattttcccatccttg

SEQ ID NO: 617677 - DNA, 632 bp, Homo sapiens
tttctcacggccggtataatcgggtctttattcaaaaaaagctgcccaaaagtgtttcgaccttatagtggaataatctcaaatttataaaagttttagtgcagcagggcttcttcctcctcggtatagatagggtttctctcctcgtgcgaggctctcttttgcagggggcgtggtttctgggaagctggggtgccttttttctccccaccaagagaggcttctttcgtggtttctttaacacaccaaacaagacaagccttctcttttcctttctcttctaccttacccacagaggctttcatgtgccgtggaaaaccggcgcggcctttcttcatatcgtgatatgtggggctttgtgtaggtgcgcggtgtagcgtgacaaagaccagcggtggcgcttttatacccacgccgggaagacttgggggaaataccccgggggccgtgggggaaaagaaaatggggtgttcccgcggggccgcaggggtgccctgtgggccaatatggggggggttataagcttctcacaacaagtgtaattctctcagagtgttttttacacagaggggagataccatctcccttatagagaaccatcgggggacagtggcacatcttttcttggggcg

SEQ ID NO: 617678 - DNA, 326 bp, Homo sapiens
ggtcgacggacattttaacaatattaattcttctaatacatgaacatgggatattgttccatttatttgtgtcttcagtttctctgatcaatattttaaagttttcattgcagagctctttcacctccttggttaaatttctttctttttcttttctttttttttgttagctattgtaaacaggattgttttcttgatttccattccagataatttgctattagctggcatgcagtggcgtgatcacagctcactccagccttgacctcctgggctcaagtgatcttcccacctgagcctcccgtttagaaataatactgctactg

SEQ ID NO: 617679 - DNA, 931 bp, Homo sapiens
gaagcgccgtagtggtgtccttgatgtcggggaccctacctggaacccatcaggaaaaggtgtcggggcttcataacacgggcagctgacgcccagctcgagtcgtggtgcgtccagagtagacaaataaccggactaccggtttatggcgtatgttgtagactgaagacgccgcggttatgaagaacctataagaagttggagacatacggagtagtcggcgatatggacagccaagacttgactcggtagagtgagtgtccgtagccacatgacatgtctgagttactcgtcatgcagtccatcggacatgactcctcttgccctgaagtctccttgggggcacctcgctatgagatgataacgacttgctagctagaggggtctcgccagcaactggttcgcttgacgtaagtgacatgtgtcattcccttttctgcagcaaggccacatggtaatctctgacttgagctcctggcgcagaggattgaggaaccagtggtagagaagactgctggacgggagaagcttgggggaccgaggaggtttcgcgggctgaagggaggataacgccacgcgtggatgtgctcctttctacaactgtaacgtggtacgtgcccccctgccccgaggaggtacaaggtgactttgccctcaatgggtggtggtatctggtgatgtgatcaccggggagcgggaccatgtataaacgagagagacctcgatctaatgaatggcgttgcgaaggtgaacactctgttcactcgatctatgcactatgactcttaagtaaacatcatccgtggaaatggcaaagtgctttccagatccaaaagggaatttttttggggactttgtcttctaaaaacttggaaaccttcttctgggagccggcgcggcctagcataggaaagggccacttacttggaaa

SEQ ID NO: 617680 - DNA, 152 bp, Homo sapiens
gaagcacctccttccctaaacacctccttcccaacacctccttccccatcacctccttcccaaacagctctttcccaaacaccgtccttcccaggagacctccttcccaacaccgcctagtttagaccaacccctgttcggttgagcggaga

SEQ ID NO: 617681 - DNA, 1054 bp, Homo sapiens
  misc_feature (1054)..(1054): n is a, c, g, or t
taactttgaaaaaattaatttattcccatgatgggggctagaaggagggcccaaagtctagagccgtggttcatttgtgccccctttgccttctttctttccagattgaagagaggcttagctgaggccttgaacaggcctgtgggatggctcatggggcttgagggcctgctcgtggcaggatggcaagcagacacgtggacagggttcatttggggcggccagatatggccaagtcttccagacattcttacacggactgagaccattttgtgcccgcttaatgggtgtgtaagaccagggggcacacatgacaaaggccatacatacatacaagcattccttgagccccatggcgtttacagaagggtccagtagctttctggggctccaaatattgtgcccaagcggacatgagaagggtgtgaaacacatattctctgtggagctaatctggggagactactgtggcacgcatgggggtgtgcgccactactgtacaaacatctttctaaaagacctatctcttgggtgtcacatcattcggctgcactgggggacgcccaataggggcaacaatgtagggcctataggggccacaaaggagaaaacacggattcaggggagttgttataagaaaacgcctaacaagaagagaacccccttcatccccccacgaaatggttagcgaaccaacccccccacggttggatgagagaactgagcagtatctacacgcaatgaaggataaacgccccccccaggataggaacgacacagtggaggaacagcaccacagacagtcggttaaataatcaccaatcacaaacaagaaagacacaaaagttggccgcgataagagccattgagggaacaaacaagaacgtcgcataaccagcagtagcagagaggctacacaagagagaggacgaggccaaaaaggacgcaaccccccaggggatggttaaatagagggccaacgagcgacccagacaggacagacggaccccattccaaatgacgataaagagcggggagagataacataggggan

SEQ ID NO: 617682 - DNA, 128 bp, Homo sapiens
cttagaatgcactttgtccttgagatcactttattctcatattcatgccatctttcttatgcttactctttccaaaatgtatattttcctggatcagtatttagttaatttctcagcttagaattcct

SEQ ID NO: 617683 - DNA, 130 bp, Homo sapiens
  misc_feature (18)..(18): n is a, c, g, or t
  misc_feature (85)..(85): n is a, c, g, or t
  misc_feature (123)..(123): n is a, c, g, or t
tcccacctcagcctccangaatagcggactacaggccggcagcaccatgcccagctaatttttgttgtgttgtattttttgtggnagatgaggttttgccatgttgcccagactgtgtctcanaactccg

SEQ ID NO: 617684 - DNA, 1499 bp, Homo sapiens
  misc_feature (813)..(813): n is a, c, g, or t
  misc_feature (891)..(891): n is a, c, g, or t
  misc_feature (1135)..(1135): n is a, c, g, or t
atctgtatccgccccttggtggtttggcttttccctccttttttttccttttgctcgttgatatatttcctcctcgcgtccctctttatttgtcctcgtggtagaatataatcccctttgttgaaagttgtcgctcgtgtggtgccccctgttgtctggagcgagttgcttttctcttatatctctcccggcggctgtgggtttgtcccctcgcttttttatcgcagggccgcctgacacattgtctcttggttgtttgttgagaaacgttcttatgtatgtttgtttgttgttgggtgttgtataactcacctccccgcctcctcgtcccacatggtgtcaggtgtgtttgcaaacacacgatcgccttcacaatctttcttgtgaaggataaggagtccttttaaaggttgtttttcgttccccccccagcccttttgtggcgacgccaccatattataaccttccgcctcttttttttatgtggaaagacccctggttgatataagggtgttgatggttttcacaccaccacggtaggagaaccccccgcgtgtggtgcccccccacgacgagaaacctcccctcggagaatttttgtgttttatataataaattataaatacactttgggggagggaccacatcggtggtgatatttaaaaggtgggggccccacaacagggtgcctctacaccactctcttaaaaactctggggttttatattgagagactcttttataaccccgcacctgtgtcgctctcacactcgggtctttctataaaacacatctgtctcgagaagagaattncatctctcttctgagagcggggtagaggggaagattggaaatggctccacacgttggttccaccacatccacacaagngagatatccacgccactttattttttctatgcccacgcgcacatctccacatcttctctgttttataagcccctctcgcacactcgctttatagagagaattttgtagaggttatcacactcgagatatatgtgcttttatatatgctcacatatacctcgagatgttggccctcgcgagagagaatttgggtatatgtgagaattttatatatgccactctcacgccacgcgaccacgcgcanaaatggtgagatgtatatttgtatatgcacatgcgcacaatatacaaggagaatgagcccgttctttgtttctacacacgaggaaatgtgagaaattggagaagctcacaacaccccctttgtatattcccacaaatatagggtcttcacaacacattttggtaaattttcacatttaaaattgttatggagggcgttggaggctaattagttaaatctaatcttccacaaaacacccgtttaaataatagcacctgagatataatgagatgccacgttgtccaatggagatgagagtgagtcacaactaatagctctgctagtaattgatttattttttttccataaagttgcataaacccca

SEQ ID NO: 617685 - DNA, 567 bp, Homo sapiens
  misc_feature (307)..(307): n is a, c, g, or t
gataatgtggtctggaattaagagcactaggtttgatttgagatcaagctccattatttactaactgaatgactctttgagttccagtttccttaaccacttaaagttattatgaagactaaatgacatatggtaaattaaacttttgcaaattataaagggctttgcagaagtaggacatttataacatgttctgttcttacttcatgatggtttagtgatttatattctctgactgtaagttccatgagagcagggatgacacgttttgttcagattgtaccccagaaacttgtatagtggcacntaatagacacccataattgtgtgtgcaactctatctttaaagaacgccactactacatctagaaatatatttcaagaaatctatcggcttaattaggtaatgaatttcaattgtatctcaaagcgttccttatatttagaagacacataagttttgtttttttctttcaacttatataagtatcttaacatgctacttctagaatattttaattgttaagaacaatttcttaataaacttccactgtcttcctgagaaaa

SEQ ID NO: 617686 - DNA, 175 bp, Homo sapiens
tagattgactgtcatcggttaacctaaagcaactgttcaggacaagcctctactgtctgcctggactttgaaaagcagagttccacaggagatctttccagcatctcgggatcagaagactcagactcagccagtgaggaggacttgcagaccactggaatcgggaagagggcta

SEQ ID NO: 617687 - DNA, 412 bp, Homo sapiens
taacatatagctaaaccctattaaccatagcatcaagatacaaacagagtattgatttttcatctcctaacctatcagtacaaattaaaaagatcaataatatctagagtcaaaaaagaaggtacaggaaaaatggttattttcagccactgctggtacaggtataaactagcatagccaatttaggtcaatttgacattattaacatcaaaatctcatcacccactaatgccacttatagacattataaatgctctggaaagtcttagcaatacgaattgaccaagttagaacacaggaaattcagagcctgaagaccaggtcttctaattaaccgaatccataaagaccaagaccaaaagaataagaaattatgaagaaggcttccaagacgcaggacctggggggatcc

SEQ ID NO: 617688 - DNA, 124 bp, Homo sapiens
  misc_feature (31)..(31): n is a, c, g, or t
acgggcgacctagaggatcccggcaccatgngctggctgagtcagattagaatctcaggctatatgcttataaaaaattttaaggatctgtacccactgtaagattaacagtgatttctgcctt

SEQ ID NO: 617689 - DNA, 149 bp, Homo sapiens
ctagaggatctcccttcacagacttgcgccgatgtaagcaggaacccgtgcgcacggatacgtgccgcgctatggcgtgcgcttcaagcctacgactacctcgagtgctctgccagaccaaggaaggcgtgcgcagggtcttcgagacg

SEQ ID NO: 617690 - DNA, 469 bp, Homo sapiens
caaattgttagacaaacatgttagcaaaagaagatagcccatctcatattactcatattcgagcacatactaatgtaccaggaactataactaaggcaaatgaacaagctgacttgctagtatcatctgccttcatggaagcacaagaacttcaggccctgactcatgtaaatgcaacaggattgaaaaacaaatttgatatcacatggaaacaagcaaaaaatatagtacaacattgtgctcagtgtcaagtcttacacctgcccactcaagaggcaggagttcatcctagaggtatatgtcctgacgcattatggcaaatggacatcacacatgtgcctacattaggaacactgtcatatgtccatgtgacagttgatacttattcacatttcatatgggcaaactgccagacaggagaaagtactacccatgttaaaagacattaattatcttgatacgcagtcat

SEQ ID NO: 617691 - DNA, 117 bp, Homo sapiens
  misc_feature (109)..(109): n is a, c, g, or t
ccggagttcagtacttaatagactttctgtatcttttgtctagaaaaatgagactgtactgtagttcagtgtgatgccactaattttatgtatattttagtgtaaatgnccagcagt

SEQ ID NO: 617692 - DNA, 887 bp, Homo sapiens
cccggagtcacttgacactacactatgaatagtagccataaacgattcatcactgatcctaacgcggaatagctagatatagtcgagtcacaacagtcaatatccgtccctacgtatggcgctagacaaggtccgtaatacatactcgccttaggacatggatagcatacactcgtcatcaaccgctcgaacaacccgagctactcctcttaggcaatgatagctcgcactatcagccaatcactagtcacttaggcgcgccatgccgaagcccagcccgagacgggagacctagcaccccataacaatagcctcctacaaaactcattccacaccacaactatctgcgccccttacatcctaacgctacacactctcaaccccaacacaccacctacagtcccaacacttgtcctacaatacccatcacaatacgaataccccacaccacaacctcactccttcaaccttaccaccaaacttagaaatcaactgacacaatttcatcccctacacaccacccacacacccacccccattaccctcgtcccgcatcacgtgccaacacccatcccatcgcacaaccccttcaacccatgtcaacctcaacaactgtcacttactaaacgaacaactttccaactaccccccattccactcaacccctcattcaccatctccttaccatatactcccccacaccactctccacattccaccatcctacaacccccccgtcaagtctaccgacagacctttcgctcttacccaccacaccacgaacccccatctaccaacctcctactcaccgcacactcccaccgccataacagcacttacactcgccccgcccttacgcccttcacaatcaccctctacacaccaca

SEQ ID NO: 617693 - DNA, 349 bp, Homo sapiens
  misc_feature (14)..(14): n is a, c, g, or t
  misc_feature (44)..(44): n is a, c, g, or t
  misc_feature (52)..(52): n is a, c, g, or t
cctagtcaccgcgntagaagacatgtatgtttgtagcatccaantattcgtnttcaaatgaaataaccccttctatcgcgggcgctgcttgaaaacctaagttgtttaataaccgaaaaaaaacctgctgccgtgttgcttccaaaaaggtgcgatatttttttaatatccattttccgcgatctgtctcgatgatggaaacgtgcggcttgatgaacgtgcttttttgcacatttatgccatattccttctcaagaaatgggaagagacgatgcgaatcatcgtctctgcgctgtttattcatcacgttcactgctttccccatattgtggcatacgcgggtaaactt

SEQ ID NO: 617694 - DNA, 150 bp, Homo sapiens
cgttaatacatcagaactatatacaatcaacttcgtactaaaaacactcgccattaaacaatcaccttcctatgaatccgagcatcatacccaacgattaccgatcatgaccacactcaatacatttcactactgaacaaacgcttcctt

SEQ ID NO: 617695 - DNA, 128 bp, Homo sapiens
caacgatggtcctcagctgaagatcggaggagctgagattctagttagagggtcatgcagcagaaggctcgagggatggagctgattgttctatgattgagggacccatacagactggcgacacctga

SEQ ID NO: 617696 - DNA, 200 bp, Homo sapiens
cccagggggaaggtgcagcccctcatctttcagtgtgggtgcaacagtcaacctccttctcccaggaatagaggtattctggggaaggtgagccctctatccaggactgagaaggcctgctcacctcctcgggagggaagcaccagggttggtggcatcggaggcttaccactcctatgactcctgttttctctctcaca

SEQ ID NO: 617697 - DNA, 347 bp, Homo sapiens
taacccatttggaacccggccttttcttagccactgccttatcaattacaggatttgccggtaaaaacagactccaaaataaagggttttgggttaacctgggttattaaaggtgctctatgtttggaaaccgaccatctttaaagtctgattatttggatcccagatttgcagctgccttgggcttgaatcccagcaatgtttaaagggggaaggccgttacctggtgatgtttttttactggatcaatgaaaaacaaattgtcatggccgttcttgcccgggacttttccacaaaaagggttttttttttcaggatttccataaaaattgatatgccccgcccga

SEQ ID NO: 617698 - DNA, 137 bp, Homo sapiens
cgttaccttcgcgcttctgtccccaccatactgaatctcctctcacagtttccatgtagaccccttgaagaggggaggggcctagggatgccgcaccttgttcatgtaccatcaataaatgtaccctgtgctcaacc

SEQ ID NO: 617699 - DNA, 424 bp, Homo sapiens
  misc_feature (32)..(32): n is a, c, g, or t
  misc_feature (63)..(63): n is a, c, g, or t
  misc_feature (170)..(170): n is a, c, g, or t
  misc_feature (243)..(243): n is a, c, g, or t
  misc_feature (258)..(258): n is a, c, g, or t
aattaccgaaatttaaatacgacctcacctanagggaaatttggcccctcgaggcccaagaantcggcaccgaggggaatccaggagacccaaaacccacaacactgccccggaaccccaggatggcctacagttgttcaaaggtatcgtttttagcccctaacccctanaagcactgggggagactgcgcagttcatatttgatgaatgacctcagtcttatccaatgttgtgtatcgcaantgtaatctttctaancttttctggtgatactttatctccgaatatacaaatgtagtagagaagggatgttgtggattttagggtcagggacctttaatgttactgcccagtgttgcccttgagctccagccttccagatgatcccacataagtgtaggctaactgtaaacggttaatacaa

SEQ ID NO: 617700 - DNA, 106 bp, Homo sapiens
acaaatttcaagtaggtttcatctggaatcacggggggacccaaatagtctcagagcccatattctacttccatagggaaagggtaaaacaaggcttaagtaggcc

SEQ ID NO: 617701 - DNA, 278 bp, Homo sapiens
ggcccccttttttaaaagtttccccccaaccttttggttggggtggggggaagaaaaacccctttttgggccggccctgcccccttaaacccgccctaaaggggaggggcccctgttttattcctggggcccccccggggggggggggggccccctgtttttttccggggggggggggccccccccccccccccccccccccccccccttttttttgggaaaccccgggcccccttccaaagggttttagggggtttcccaaaaatttttttttttta

SEQ ID NO: 617702 - DNA, 385 bp, Homo sapiens
gcgcactctagtcaacaaaaataactagtagtacaatagaatatttataacagtatgccaacatcactactctgggcttggggtcattattaagtaaaataagaattactcaaacacaagcatcttgatactgctgcagtcaatccgataactaagatggctgttcagtgactaatgagagggtagcccgtacagcgaggataagctggttgatgggatgattcacaagtcaagtggaatggagagggacagtgtaagatttcatcatgctcctcagaatggcacacaatttaagacttatgaattgtttattactgaaactttccatttaaaattttcagaatgtggttgaccgtggactagaggggcgggggatctctagagt

SEQ ID NO: 617703 - DNA, 266 bp, Homo sapiens
ggatgccgccgggggtccccttcctccccctgggggccaaagatttattttttataaaatccttaaatttggggtgttttggggggggggggggcccccccccccgcccctgggggcctttttttttttttttgaaaatccctttgggggcccccggcctccctggtggggggatttgcccccgcccctgggccccccccgttgttgcctgggcggggggaaggggggggccggggcccgttattttttaccctggattcctttta

SEQ ID NO: 617704 - DNA, 103 bp, Homo sapiens
ctccagtgggggataacgtttcctgcctgtctcccttgtgttttaaggacctctattgttctagtgtctagataaccattcacaaataatgaggttgtgttta

SEQ ID NO: 617705 - DNA, 144 bp, Homo sapiens
ctactaacgtcctaacctttagctggaagcggtttctgatttacagctctaggtactcccagacatgtaggtgggagagatttggtttcaaggggttgttagatggagtaaattttcttttgttttattttttttttaaacaaa

SEQ ID NO: 617706 - DNA, 300 bp, Homo sapiens
atccccgtcttcacgtattcgtcaccaggagcctcctaggccattcaagacgattactaccctatgccagccccttaaacatcccgtccccacactcaagcccgattgatatttcctattcgcctacacgatttctccgatccgtcccttacctcctcggactcctgcctcactcatttatctaccaaccaccctactatctatcatcctagccatggccatccccgttatgagcgggcgctgtgattatgggctttcgctctaagattcaaaatgccctagcccacttcttaccacaag

SEQ ID NO: 617707 - DNA, 147 bp, Homo sapiens
gagtccttaccgggatggtcatactaggtggcagtcgtgagccttaagcactatgaaagctaaaggttgctactttaagaagggaactgagatcgtgcaactacatgctactccaacaccttttctggggtctgatgtcgcgttgca

SEQ ID NO: 617708 - DNA, 224 bp, Homo sapiens
gctgcgacgttgtgttttttttgttgagatggagtgtcgctcaggagtggggggatctaggctcacggcaaccagcggcgcccgggtttcaccatggtgaccaggctggtcttgaacttctgacctcaggtgatccgcccaccttggcctcccaaagtgctacgattacaggcatgagcaccgcgcccggcgacttttttttgttgttgtgtttcactgtggac

SEQ ID NO: 617709 - DNA, 523 bp, Homo sapiens
gaccaactcccctgctgacagccttgggccctgggtcaaagagccagccacctagctctgggaagctggttaatgctgatgtgcacacctgggaacagagtggacaaatcaaataattcccagaaatctgagctggagcccctacccatgagcctgttcttagaggaaaggcgctgcaggaatgaaagtgaccacgctgcaaaatcactgttttgaccctctttgactgagatgttcttcaaaataaggaccatattttatagtgttgcctttgaggcaagctcagaagctctgcctctgatactcgcttgctcctggtgtggctttagaaaacaaaacaaacaaacaaaaaaacaaggaaaaacaaattgtgaaagtctgcccttatccctcctaaacctacaaggctcacttccaataccacctcctctgtaaagttttttcccaactgtttctctacatcttagaattactccctctctcatttgtctggggtgaggggtggggatgaattttactggtc

SEQ ID NO: 617710 - DNA, 313 bp, Homo sapiens
taaagccaaaacatggatgaacctaggaaacattatgctaaatgaaataagccagacacaaaaggataaacatggtgattccaattacatgaaatctctagaataggcaactttatagagttagagagtagattagaaggttccagggactaagggaagtggaatggtgagttattgcttagtgggtacagtttctgtttggagtgatgaaaatgtttttaaaatagaggtgatgaaggccggatgcagtagcttatgcctataatcccagcactttgtgaggctgaggcaggaggtcgagggtttggcttta

SEQ ID NO: 617711 - DNA, 1254 bp, Homo sapiens
  misc_feature (258)..(258): n is a, c, g, or t
tttgtttgtggtactggtgttggggtggggtactgttgcctggtgcgtggtttgtttggttgttggtggtggggggttgctggttttggtgtggtggtctggtgggtcgtggtgttttcatttttgtgcgctcgtgtgggttgcagtgtgggtgcgtgttgttggtctgcgttgtggggccgtggtgtcgtgtgtgtctccctctggtgggtggggctattagccgggtttgtttatgtgtgaccctcccgggtccgnctggtgtggccgcctcccgcccaccggggtggtggcgctcccgattggatgtccccccggggcctgggtgccggcttctcgggacatttttgcgcgtttgggctcgggggacagggattcaccccatgtttgagcaacccgggggcacccaggctatggccccccttatggccctttttaaggggacacacacgatttagaaaccacagagtttgtaacccccaaaaagacacgcggttggttaacccggtttccgcggatttttcccccgggattattctcttcgaacccacagggtgtccccgggaacgctttgggccgcccacacccatggggccccgcgtgtttgcgccccacaaaacccccctggaaagaaagggccgggccccccggggtgcaattcaatatagggaagaagtgatgctagacaccgggcgcctctggggcgacacacagagactttcgcaacaccgcggaaccacaaggggcggcgtgggttgcggagagggggatgtctcccccccttagtatccccccccccctcaataagcttctccggcccaccacacgatatataccacaggtttatatgttcacccgcacatttgagatgaaaagcggagaattctcagaagaagggcccaccggtaaagagaggtattttccactccacaagctccccaggagaggagaggagagaagagagaaaaggagagaagaccacactataatgtgttcctcgagaggtttccacagcccctggagatcacacagcgaggagattatattgtaaatatagagattcctcgagcacctcaaggagaattgctgaaagctctttggaacttcggcacgttctgtccacaacctcttcacggtcacctcacgcctcacacacacttgggatgaatttccaaaacgcgcctccggggagacctcgtttgaaattttttctgtaatgctgtattattttccataaatttggggccacagcca

SEQ ID NO: 617712 - DNA, 962 bp, Homo sapiens
  misc_feature (962)..(962): n is a, c, g, or t
gaagttcaggagccaagatcgccgtcattgcactgcagcctggtgaggggtgtcgcaaaccaccatggcacacatttaactatgtaatggaactacacatcctgcacatgtaccccagaacttaaataataataataaaagatcacttgaggtcaggagttcaagacaagcctggccaacatggcgaaacctcacctctactgaaaatacagggtcttgatctgtcgcccaggctgcagtgcggtggcatgatcctgtctcactgcggcctcaaactcctgggctcaagcgatcctcccacctcagcctcccaaagtgttgggattacaggcgtgagccactgcgcccgggcaagaccttttttttaaaaaaaaaaaaaaaaaaaatttccatttcttttttcctccagttttgggttctccaaataaacaagaagtaattggggttcaaattaagaagtaggccgtaaacggatagtacagggggaggtgctcacataatgtttctaagagtggtgctcgaacttcctggggcttcaagccatattcccgcagtaaaaggctttcaaaatagggggggttacaagggaattgagccaccacacgggcaggattgggtggttccaacatataaatcgtgaatcacccccctggtataaacccttagggtttaattacccctcattaaagggtaactctgcaccttgcgtaatgaactggtttgccttcccttgacatattaagggattcttggaaagctcagccaagtggatccatcaactaatgatgggctacaggcattcggagtataggttacccacagctgatcggtggctatccaagtgaaacggctagccgaagcataggtgacactgtcgcaagatggataattaagagtagtcagcgaggactggtcacacaggggcatgaaagacccaattcacgggtgcgaccactggctcn

SEQ ID NO: 617713 - DNA, 708 bp, Homo sapiens
tcttccaaagtggtgggattatcgatgtgagccaccgtgcctgaactagaacttttttaagaaacagggttgtgctctgtcactcaggctggagtgcagtggtgtaacccctcagctcactgcagccttgtaactcctgggttcaggtgctcttcaccacctcagaactcctgagtagcaaggactatagatgtgcgcacccctggctaattttttttcattcaatttattggtggagacaggggtctcagcttatgttgcgcagatctggtcctcgaacatccgtggattcaagtgatcctcctgactcagacctgaccgacgtgcatgggaattacaggcatgagccatcgtgtcatggcctaagaactaactgttaacatataattcacaccacaaaaaaaaaaaaaaaagaaatagaaaagaaaagaaagagaggagaagaataaacaacaaaaggaaaaaaaaaaaaaaaagaaaaagaacagaaaggacaacaaaaggaagtagaattaaaaaggaacaacccgcatgaaccaaaaaagaaagactgaggacaacaaaacaaaagaggaaaagaaaacaaaaacaacataacagctaacacagcggagaagacaagacagtttgaggacaaaaaacacaagagagaggtaggaagacaaaataaggaagatgtaacacaaaggtgaaaaagggatcaaaaat

SEQ ID NO: 617714 - DNA, 107 bp, Homo sapiens
ctttttgtattaggacttgactgttggatttctatgccatgtctctcacatctgatcgtcagtcccatcatgactgtcgagaggagctcgagtgctggtgggtgtgg

SEQ ID NO: 617715 - DNA, 388 bp, Homo sapiens
tcggtgaattcactccccgcattgcttattttcgtcaggtacaacatcttccactctcctgggctggcagcataaattccgcttaagttcttatgacgctcttcacactctgcgagtgtagactcaatgattcctttaagcctgtcaattcgggatatatgattccatacatctgcaattatttgatcgtaaatagtaaggtcaccaccgatgcaatttgaaaagatgattactgaaggctcgaacaccgcctcggctgaaattgaccgcgtatcgacgctgggaaatgtgccggattatcaacgatgaagataaaaccgtaccgcttgccgttgaagcgcgtactgccggatatcgccgcgggatccgatgttatccacgcccaggt

SEQ ID NO: 617716 - DNA, 90 bp, Homo sapiens
gcggccgcctactactactactgctcgaattcaagcttctaacgatgtacggggacatgaccaaaaaccaaaagtgcattcaaccttacc

SEQ ID NO: 617717 - DNA, 488 bp, Homo sapiens
  misc_feature (484)..(484): n is a, c, g, or t
tggagggatctcacttggtctcccaggcgggagtgcagcggcatgatctgggctcactgcaagccctgcctccggggttcatgccgattctcctgcctcagcctcccgagtagcggggactacaggcacccaccatcatgctgggctaattttggtattttaagtagagatggggtttcaccatgtgggccaggcgggcctcgaactctggacctcaggtgatctgcccacctcggtttcctaaagggcggggatggcaagcgtgagccaccacgccgggcctccagtggctttggaagagggtaaagtcaagtttctatttctagaaaccttttttcagaaattggtggcgatgttggtacaatttacctcataagagaaccacacccttctccaaaagggcgggtacggcatcagtgagatgagtagggtgtgggtgggggatggtaagactattaagatcctagtaagtcaggggtagttnacgg

SEQ ID NO: 617718 - DNA, 149 bp, Homo sapiens
tgtgcctcatgaggtcaggagttcaagagcatgctgaccaacatggtgaaaccccatgtctactaaaaatacaaaatcagccaggcatggtggcacatgactgtaatccactgcacctggctttctactgcggtggcctcatgaggcca

SEQ ID NO: 617719 - DNA, 497 bp, Homo sapiens
  misc_feature (131)..(131): n is a, c, g, or t
  misc_feature (171)..(171): n is a, c, g, or t
  misc_feature (195)..(195): n is a, c, g, or t
atccatcacgtgcatgtgtatatcacattggagatggatattgtcctcagacattatccttgttcacaaccagtatactcctgagtatttttacgtgtacaattaaatattactaactgtagtcctccccngtgtgctataaaataccaaatacttattcattcttctatnttgtctctacttattaaacatccncccccatctgctgctacccttcccaacctctggtaaccatccttctgttctccatgagttcagttgttttgatttttagatctcacaagtaagtgagaacatgtgaagtttgtctttctgtgcctggcttattttacttaacgttatgacatccagttcctccatgttatttcagaaggcagaatctcattcttttttctggctgaatgatactccattgtgtgtaggagccacattttcttgatgtgttcatctgttgatggtcacttaggttgcttccacatcttggctattgtgaacag

SEQ ID NO: 617720 - DNA, 931 bp, Homo sapiens
tatagtacaaacttagggctcttaattcaggcagtaaagtaaggaacagcaaagggggagggctacaccatcaccagtggcaacagaaagcctcaaaaacataaagtccctcgacttatgtcgggatagactcttccatagctcaggagaaacacatttaccgtggctgaggacaaggccaggcagccgtggccacacgtgcggaagggcagctggacgcgcggcctcgtggctcagtccgtggaaggtgcttggtgagggcttccagcagatcctgcttcttcagaccactcttcagcccgtaagcccgggaggcctctttacagcatgggcccagtgaacttgcccagggtacccttgctgatgtgggtctacagatccgtcttcggaatactccacctgtgggcctttggcttccagaaccttcaatatactcgggtataactcatgggccaactttagcccttcaggatggcacactcgtggggggataaacaagctcctttaaactcatccaccaaggagcccagtctaatcatccatggcttacaaccttgggcaatgtcaggtccactgcattgtcaccggatccatcaaatccaaggccaaggcctccaggttcctgaaatgctgctgcagcacggggttctcaaagctgcacatcctgatgtgaagcgaaggttctcaaggatagcctacatctggcccacatgtcgggaagttggcctagtcaccaaagaacagactcagttgaccgaaacgtcacacctggctgcaacctggcagggaaccagtagcccagaagagaattcgagtggcaaagaccccggaacggagtccccgaggaaaatcaccgggtgggaagaacccgaggccgggacaagcacccaaaaaccggggccagtggcacacaaagagaacacaaggggaa

SEQ ID NO: 617721 - DNA, 528 bp, Homo sapiens
ttgtcatagctgttcctagagtaacacgatgacggctcttagaggcatgacttgttgtacgcgtgtgtatgtatgtaattgggttgaatatagctataaacaaaagttgatgcacacgtaaattcatgcttgttgtaacgtgtcaaacactacagaggtgtagggaaaatacctagtgccaccctccactccaaaatcccatgtcgccagagataaccatttattcagactgtgagtatctattaagtatctattgctaggctttggagatagcatcatgaacaacctggatgtgctctctgcccttgtgatttggacagatgcttcagttatcttttactgtgtatatattgattatgtttcgtatgtctgtgcgtgtgtgtgtgtgtgtcgtgtgtatcgactgtcttcttcctcctcccataccattccccacaaaaggagggggtagggatcacgctacacctataggcaacccagttttctcactaaatggctgggcatgtcctttcacgtcatcacatatag

SEQ ID NO: 617722 - DNA, 1016 bp, Homo sapiens
catttgctcacaatttatagtagttatttgctatctacctatattaaaattcgagagtgagttaaaaaataattgatagatttggtgacagtaatgatttacagtatgcccaatatatgccttatttctaaataagtcatgctgtataaagtcatcttggtgttgttcagagaaagttcaagatctatattcacaaagaaaaacattttataaattgagtcgcatgttctcttagagtcaaaatgttaaagctggaggcagtattgaaagctttgcaattaggagttgcagagatgccttggcataccacgaaaaacactgtcaatatccaactcattataaattgtctatcagaattaacctaataactttcagtacaggacaagcagcatcctagcaacttgtagtagtctgggttcccagcagagtatcacagtaaccgtctctgacaacttcactcagaattatccaaagctgccaaataatctgtcatagagcctacattgaacagatttcacaaaaagatttactaggcgacgaacagtcataacaaatgtgaatatgttgactccttgaagaagccgactgtttcaaataagttaatagttactcctgggaagacacatatctcaacggcatattcactaagaattcacgaggcgacaacaaaacccgcatccataagggactcgatctgaagcatccaactttagcataacaagctgaacaaatggaaaccaaatgcaaccaccaactacacacacaagtgcccagcacagaacacctcgcgacggcacacagacacgccaaccacaaacaacatacacccacactggagaacgcaagagcacaacacaaactaacccgagacagaaacaaaaagagcgagaagacagacaacgaacaaaacgacaaaaaacataaacaaacgcacaaacaaacaaacactacacaataccaacaaacacaacaataacaaacacaaacaaccagacacaacacgaacaaaaaaccac

SEQ ID NO: 617723 - DNA, 1214 bp, Homo sapiens
ggaaacgtttaccttgtctcagatgtaactggtaaagagctgatttctaaatttttctgtaattgcagcaacctttctctcctgtctaccctttgtagtttactgtatgccagtggttttgttcttggttaccacttgaacagacaagttaacttcgcgaaacactttgggacgaaactctaactcactggcctattacccggactgtaacgatcattacagaccttagaatgaaacgattgtgaaacagctcggtggacgaacaatgcttaacggacactgcatacgggagaaaacacacaagtacaaacttagaagtgctatatgcagacatggctagcaagtacatgtaccttatcattactgactgaaactgactattcggcagcaccctataaacttatactcgctaaacaatttacatttagagggacacacctccataccaggtatgacctctctccttggaaatagcggtacataaaagagcttggcaaagtaacggataccacagacgaaagcacagcgcaacctggagctataacttagccccataaaggggactcctaaggatatacactaattagagcccacatgtacgaccattatacatgttgctaattcacactcatagaatctgacacagagaaaagagaaaaaacacatcaagggtccagaggctacaacactgcaccacgtattacaaggagaaaccaatggacatcgccaataaacccaggcttccacaccaaggcaataacacttgcatacaacgccaaagctcctaatatgaaaaccatggcacgatgacaccaccgcaacctaaccaagcaagagaaaaaacagtaacagaaaggaaagagacccagaaaaaagacaggaaaaactggacaacatggaagaaaaaacgaaacacaaaaaaaagaacacaagcccagaacggaccacgagtagacaaagagcagaaaaaagacaatgacaaaaaacaaaatgacgtagagggaggagggttgagatgagaccgtgaaagacgggacggaaacagcacgcgagcgacctaggcagaacatgaagatcgacataacaagaagggaggcaacaaaaagggtacaatgcaatcggcagaattgtaaggcaacgaacaaactaagaagaggagaaaaaaagacaggaaaagaaacaacgccgccgcgcacatgcacggagaagagaga

SEQ ID NO: 617724 - DNA, 335 bp, Homo sapiens
atcatggggtctggagtctaaggtcatggttggttcctgcttcacagttgcccagctaggaaaatgttgtgtccgaaattgttgggttcttggtctcactgacttcaagaatgaagccgtggatcttcgtggtgttacagtttttaaagatggtgtgtccggaggttgttccttctgatgttcagacgtgtttggagtttcttccttttggtgggttcgtgggctcactggcttcaggagtgaagctgcagaccttcgtgggtgagtgttacagcgcttaaggtggcacgtctggagttgtttgtatctcttgtccagagttgttcattcgtccc

SEQ ID NO: 617725 - DNA, 848 bp, Homo sapiens
gaacggcctgctgaggtaccgctctacatttcacataatcctgggcaccacaaaatatataccaaaacttccatcagggacattatgatcctcggaccatgcgaagatattctctatccgaatcatttctgtcaccgtacaagatcctatacttcgagtttgagctattggattctgtatgtagtcccccaaatacgaagagttagagaactcaaaggtagttctttcctatcactgtccacctctgctttcatctcagatgttaccataaatggtccgcgctgttttataacaagatagagtctcagtgcgttcctccttcactgtttcatctaagtgcctcacatttttttctacctataacactctaggatgtatatttcatataaagtatccttaacttcttttcaaattaatatctttctgcacacaaatattattgtgtttcctaaatccaaccattttcattaattcaggcatattttaactccatgcttacctactttcttcaggtaaagggcaaataatgatcgacccaccataattatctatacataaatggaagtcgttctagactattaaatggtggctaatgtgccttatggttgaaacgcacttcacaccggtcaccatgtctttcccacaatcatttcttgacttacttatacacactcttagacccaatagcacgttaaattcctcaaacagtgtttctccggacaacatacattttgccactctttaccttatgggtatctccatgatgacaggttgcgccggtgcactgggagcactctgctggtatggcaccggttttaactgccacaaggattctagctattataaga

SEQ ID NO: 617726 - DNA, 266 bp, Homo sapiens
  misc_feature (16)..(16): n is a, c, g, or t
  misc_feature (65)..(65): n is a, c, g, or t
  misc_feature (70)..(70): n is a, c, g, or t
  misc_feature (185)..(185): n is a, c, g, or t
  misc_feature (190)..(190): n is a, c, g, or t
  misc_feature (200)..(200): n is a, c, g, or t
  misc_feature (206)..(206): n is a, c, g, or t
  misc_feature (208)..(208): n is a, c, g, or t
  misc_feature (212)..(212): n is a, c, g, or t
  misc_feature (214)..(214): n is a, c, g, or t
  misc_feature (227)..(227): n is a, c, g, or t
  misc_feature (232)..(232): n is a, c, g, or t
  misc_feature (241)..(241): n is a, c, g, or t
  misc_feature (247)..(247): n is a, c, g, or t
  misc_feature (257)..(257): n is a, c, g, or t
  misc_feature (259)..(259): n is a, c, g, or t
  misc_feature (263)..(263): n is a, c, g, or t
taatatagagattttntttaaactgtattgaatttttacagcacattgcatgtttgtcacaacgnaactncacagtttggatttttggccacatcatgtcacttacacccacaacagctctgaaaggagtatttgatgaacacatctgagccaagagcccagagctctctctccaaggccatganagttngttcactgtntggganantccntnaaaacagccacgngtagntgcacagcntacagntctccccaantnttancaa

SEQ ID NO: 617727 - DNA, 202 bp, Homo sapiens
  misc_feature (173)..(173): n is a, c, g, or t
acagcgaagtgaattattggtgagtattaagaggggggcagcacattggaagccctcatgagtgcagggccttcaatcacatgctccttgttctgcagcttggtgcggcatggacattgataactttggccaattgtgaacccgtggccacaggtgccctgggtctttcccanaaggcacctcgctatgcctgttgtggagc

SEQ ID NO: 617728 - DNA, 873 bp, Homo sapiens
ggtggttgtgtagtaattgttgtgtgcgaggtttgttgattaatctagatttagtatattgcattacgtttgtgagtgttacatgtatgatatagggttgctgagtgaggtataattgcttggtgtttttgggtaattttgggataaaatgtagagtttgcaggggatttctaacttgcaggtagtattaagatgattagcttgtcaggacatttgctggttgtaagtgaacagatttcaagtacatggggcattccacgacagaatgtcgacagtcacctggggccagcatcagtttgtagccagatcctaacagtgccaacatcaccgtccttgccactgtagccctctagtgagaatattgggagctaccaggcaggtgcccagtggcattcagggaagatgggcgacaacatcagggagtgggcagctgtatggaagactcctcattcactgaccaggtcatgggcagggccaacctgggctaggaatgaggctgccctgcagggcttctcatctagtgtagcaccagtcaccagtcccaggtcacagaagaagcccctcccagcacaccatcatggagaggggaagttgaacgcccagggagacgggctccatggtggtcccacatggacgctgttttgcaataccctggaaaaggcggctctcccctgtcgcctctacactcttcagagagcaggaacacagagttaatctcgtatgaatgttatttctactttagtcctaagcaagcataagctgccctcttggttgatcatactttatacggagagctatcgatttatgaaatgctttcagtatgcattttaaattatgcatgcgaaatgaccacacttaaagacatgtgacttc

SEQ ID NO: 617729 - DNA, 657 bp, Homo sapiens
actgaagaaaatacccagtctgtatatatatgtaagagccatgcagtgagcgtggtgatagtgaagatggcgtgtcttgagaggtgaagaatatcgttattgtgacagtgataaatgtcacacttgattctggattctagtagcaagatatgtgattcgaatgccaacactgaatcagacgtaccaggaggtcagagttttggtgtacaaggggaagcagcgtgtgtcagatattaccacattatagatctgaagaatgtatctgcaatggtgataaatgggaatagccattaacctgcttttaagtcttggcaggaggacctctgcgtctcggagaacgctcagctgtcatccaacagctggaccgacctgactcatcacccttggaaagaaggactgtcctccagtatcataccacacacgaaagtgaaagaatcgaggacaaaagccagcgtaacactacaatgatcccagaaaaagaggtagggacatcctcatctaaaggcacagagatacaccataggaacacgaagataacatcacgacagtgcaaagagatgaaaaagagagaggacagaacaaaacttatacaaggcgcaacaagcacgtgcgaaagaacactcagagaaatacgaggaacagaagaaagggcaagaa

SEQ ID NO: 617730 - DNA, 310 bp, Homo sapiens
ttttgagatggagtcttgctctgtcgcccaggctggggtgcagtggcatgatgttggctcacagcaacctccgcctcccgggttcacgccattctcctgcctcagcctcccaagaagctgggactacaggcgcctgcaccatgcccggctaatttttttatttttagtatagacggggtttcaccgtgttagccaggatggtctcgatctcctgatcccgtgatccacccgccttggcctcccaaagtgccgggattacaggcgtgacgagtcagtgcctggccaataaaaagtatttttaaagtccaga

SEQ ID NO: 617731 - DNA, 333 bp, Homo sapiens
tatgctgtttatttgtgtggttgcattatagtgtcactggtctgtgtacttaagtgtgtttttgcagttgctggtctttcctttccatatttagtgcttctttcaggagctcctgtaaagcaggtctggtggtaccaggtaccaggtctggtggtagcaggtctagctaggttggggaagttctcatgaatgatatcctgaaatatgttttccaaatatgttttccaagttgtttctccccatctatttcaaagatgccaatgagtcatagatttggtctctttacataatcctatatttagtgacgttcctcatcccttcctcatcccagtg

SEQ ID NO: 617732 - DNA, 254 bp, Homo sapiens
cagtattgcctaccggtctcattcatcctcaagacgagcctgcaggcagaatcacccttccgctaagtaaattcagaagagaataggagccccaaggctttcacagaaattcacattaatggttaaacagcaaggactcactcgcctctgaaaactggggctaaagggcacaaagggggcacaaagctcaggctgtgggggacagattgccttcaccagtaattcccatgccccccccatgcgtggattgccag

SEQ ID NO: 617733 - DNA, 165 bp, Homo sapiens
gctgagctagaggatccccttatgttctgacccaccatctatattttttgtactatgtaggtagagagggggcctctccatattggtcaggctggtcccgaactcccaatcctcaggtaatctgcccgacttcagcgatcccagatgctggtgattacagtgcgt

SEQ ID NO: 617734 - DNA, 433 bp, Homo sapiens
caggaaagggggtgggcgaggactagcgaatgtagaagggaagggcgcagagaacttgacttcccaccttttgcgctttccaggccagctcaggggcgagtgtgggcagggcgagtgtgggcagggcgagtgtgggcacggcgagtgtggcagggcgagttgtggccaggccgagtgtgggcagggcgtgtgggcacggcaagtgtgggcacggcgagtgtgggcacggcgagtgtgggagaccctaggtctgcgccaccgccggcgtgagcctgaaaagctgctgggagaaccagctccgaaacagagtgcccggaagagattgtgacacctatggaaatttaatgaattgataaagggatcgattcgattcaatgtgagaatgttagtttatttaataaatagtgctggtatagttgtcgatctaaaaaaa

SEQ ID NO: 617735 - DNA, 238 bp, Homo sapiens
acggcacaaatcacattatactaaatcgctggtagtgccgtgatccggtactctatgtctattactgtctgcttatagcaataggcagctgagtattctctagattgtctatcagtacttcagccattgcttctgtgcattaatcccatcaattgctggaatcatcctttcattccattacttctttatatctacttctttcgtgactaggttcttcaggttcgattttgaacatttt

SEQ ID NO: 617736 - DNA, 119 bp, Homo sapiens
tggtgactttccatcccttgaaccaaggtcatgttagcacttggctaccagcatagttgtcaccattccaacctagaaattggcacaaatgcaactgtgtcgcgggttgtagagggtac

SEQ ID NO: 617737 - DNA, 529 bp, Homo sapiens
aggagccgtgtacaagtgcgtcgatgggcgaggtgctcgtgctgtgtcgcattgcggagattggtggcagcggtgggggtctgatgtaaggtgtggagaggagtgcggggtgcggtgaaaatgagcctgtggagatactagtggcagaaggccgcgagccaccaatggtgtgcagggaggatgttcagggcgatgtgggtgtggaagcgtaccataggtggtgcaagtgacggtgcatcggtcatggtgtcttcgtgtcgaggcgcgggattcaactcgcgaggcttggccgtgctgatgagaatgttgctgccataggtacagagacagacatagagaatggtaaagaggcagaaagagagccatggccccgcccccaaaaaggccaggttggatttcctatggaaggaactgtggcccccctggacacttgggttccccctgcaacttcagggcccctgggcctgggccccccttgggaggaaaagtccccctcctttccaataaaaaaaagtggttttagcctggg

SEQ ID NO: 617738 - DNA, 666 bp, Homo sapiens
  misc_feature (165)..(165): n is a, c, g, or t
  misc_feature (190)..(190): n is a, c, g, or t
  misc_feature (262)..(262): n is a, c, g, or t
  misc_feature (306)..(306): n is a, c, g, or t
  misc_feature (328)..(329): n is a, c, g, or t
  misc_feature (331)..(331): n is a, c, g, or t
  misc_feature (440)..(441): n is a, c, g, or t
  misc_feature (445)..(445): n is a, c, g, or t
  misc_feature (449)..(449): n is a, c, g, or t
  misc_feature (580)..(580): n is a, c, g, or t
gagtccctggctttttagtggggtgggtagagtccactgatacatttctatcagcacctgatggcctgggtgcttgcttgaccccaggtctgatgtgtggcttgtcaaatgttctgggcctcacagtagtataaaatctgtgtggcgccagagtggtctgtagtncctcttgactaggacttggggaaancatgggtataaaagggatgcctcgtgtctctagaggagcaggttcgctctgagagacctcagggtatggttnatgaggaaggagcacatcttttggagcaggtgtggtgtatgacncttctggacttggtgacgtttnngnttttgcagtaacacgctggggcaccttaggaactggttgtgtttgtgggattcttgggcgtggtgatgtttttggcttaggaggagcacgtggtgtctgcttgggagcnngttnagtntgaggtacttctggatggggcgtggttttaggtttgggatgtggacgacgggttctttttgttgttgttggagctgaagatgtcccaggagtaataggtccaaagtctagtttggtctgcagtgtctctgngcgtggcgtggttttatgtttgggacgtggacgacgtgttcttgttcgttgcgatgtttttggagctaatgttgcactgtagccta

SEQ ID NO: 617739 - DNA, 386 bp, Homo sapiens
aggatccccaatgtctcatcctacctgacatgtttataaaaactgctatgctaacatgcactaagtaaaaagtgggatctggtattaaagataattagttggctgggtgtgggtggctcatgccgtgtaatgccagcactttgggaggccgaggcaggcagatcacttgaggtcaggagttcaagaccagtctggccaacaaggcgaaatcccgtctctattaaagatacaaaataattaaccaggtgtgggagcacacacctgtaatcccagctactcaggaggctgaggcaggagaattccttgatcccgggaggcagaggttgcgggtgagccaagagcgtgccactgcactccagactaggcgaaaaagtgagactccatct

SEQ ID NO: 617740 - DNA, 616 bp, Homo sapiens
  misc_feature (165)..(165): n is a, c, g, or t
  misc_feature (190)..(190): n is a, c, g, or t
  misc_feature (310)..(310): n is a, c, g, or t
  misc_feature (354)..(354): n is a, c, g, or t
  misc_feature (376)..(377): n is a, c, g, or t
  misc_feature (379)..(379): n is a, c, g, or t
  misc_feature (488)..(489): n is a, c, g, or t
  misc_feature (493)..(493): n is a, c, g, or t
  misc_feature (497)..(497): n is a, c, g, or t
gagtccctggctttttagtggggtgggtagagtccactgatacatttctatcagcacctgatggcctgggtgcttgcttgaccccaggtctgatgtgtggcttgtcaaatgttctgggcctcacagtagtataaaatctgtgtggcgccagagtggtctgtagtncctcttgactaggacttggggaaancatgggtataaaagggatgcctcgtgtctctagaggagctattgttgtctttggtggctcaaatctaaaggtaacaggctgcagaacaggttcgctctgagagacctcagggtatggttnatgaggaaggagcacatcttttggagcaggtgtggtgtatgacncttctggacttggtgacgtttnngnttttgcagtaacacgctggggcaccttaggaactggttgtgtttgtgggattcttgggcgtggtgatgtttttggcttaggaggagcacgtggtgtctgcttgggagcnngttnagtntgaggctcatctgggctgggtagggttatagattgagaaggcagaggcgacgtttctagtgtggtctccaggtggttcagatacatatgtcatagattccacaacttcagtctttgggt

SEQ ID NO: 617741 - DNA, 325 bp, Homo sapiens
aagtctgggcacagtttaacaccagcactgtgagaggccaaggcaggaggatcacttgagctcaggagttcgaaaccagcctggataacttagtgagaccctgtctctacaaaatattaaaaatttttggcactccagcctgggcagagagtgagatcctgtctcaattataaacaaacaaacactgagagccaaatccaatatgtttatgggcccgccggaatgatagtatttactatcaatgtagtgtatgtatcttcaactggtgtcaaagacaagttcttgggagtctgattttcaaggttgtataacaatggaggcttcc

SEQ ID NO: 617742 - DNA, 1021 bp, Homo sapiens
cccacgcgtcgcttcgcgacggcacactcatcacagcgctaagctcgcactgattttttacctgagtaggcctagacaataaagatgtctagctttctattccagttctagaccaaaaaaaataaaccctcgttccagagaagctgccagtcaagtatttcctcacgcaagcaaccgcatccataatccgttctaagtagctatcctcgttcaacaagtatactctccggagcaatgaaccataaccaataggtaccaatcaatactcatcattaatagagtcataactggctataggcaagtaaaaccatggaataggctcccctttcacttcgtgatgttgccagaaggttaccccaagggcatcccgcttctgacattccggcctgctgcttctcacgattgactaacaagactaggccgcccgagtctcaatcagtagtaccaaattctctcgcctcactacacacgtaagccgttctaccgtcactcgtctgcaactcattgatccagtcatagcaggcacgattgaggctgggagttaaaccaaaacccatgctacgcaaaattcctgtagcatactccatcaattacccaacatagtgatgcatataattagctaggttctaccgttacaagccttaaacagtaaccagttctgtaatgtttaactagttttactattattcctaaactacttatcggcattcctacgtatatcaaacttaaaacctccagtcatccacagagggcgttagtactatctcgcacctgaaaccaaggctaacatgacgtaacagcccttaggtccaatgcaaaccttgctcttccctaggaggactggccccgttaaccggagtaattgcccacaaatgggccactatcgaacgaaattcacaaacaaccaatagccctcatcaatccccaacatcataaacacccatcaaccctacattaaactcatacattatacgtacccaaatttactccacctacatcacaataatcccatttttaaccc

SEQ ID NO: 617743 - DNA, 1113 bp, Homo sapiens
ggcccgcgcctcccgcatcgcctcgcgtcccgtggcgccgcccgggcccgctgttcgggggcccggaaccccggccaggcgcattttctgcaccgtccgctttgcaagaaggccctcgagtcagcgactggattgctcgccatcaaggtccagtgacaagtcctccaagaagcgaaaggcgcacaccgccaccaaggccttccggaggcacaagcctgctcgcaagggctcagtgacacgatttaaccaattaaaccctgtgaagccgaacccccacagaaaaaataacagcacgcaacaacacaagcttcaaagagggcacatctaaaatgcaaagagagagtacgcagagagaaaaaaaaacggggatactagcgagcacggtgcacaattggtccaccaattagaccagtgctaacccaagaacaccaaaaagattttcttgtgaaccacacacgtgtgcggaacaacttctgcgccgtgacacaaccacaaaaaaaggggagaacgaagaaaaaaaaccaactccgcgagaaaaagaaacccccagagactaaaacccgagctcaaaaagaaaaagaccaacgaaaaacacaacaaaacaacacgaacaaagaagaaagaaagacaaaaaaacaaagagaaaaaagacaaaagacgcaaacagaaaaaaacaacaacaacacacacagcgaagagaggacgagagagagcagagccgaaggaagcagagcagcaacaaaaaaccaaaaacagccaacacaacacagaaacaacacaaagaaacgacagacaaacacaggcagacgaaggcacgccagacacaatacacaaaacaagcgaacagagaagagagaaagagcagcaaacaacaaaacagaaaaggagagaagagagagcgaagacaaaaagacaaaaacaaaagaaagacacagaaagaacgaaagaacgacagaagagaaggagagagaagaaagaccagaagacgacacaaacagaaagacgagaagaacagacgaggaaaaaacaaacagacagacagaacaaacaaaacgaagaagaacgaaaaggaaaagacgaagagaaaaacaaagagcgacaaaaaaagacgaa

SEQ ID NO: 617744 - DNA, 611 bp, Homo sapiens
  misc_feature (83)..(83): n is a, c, g, or t
gggcctgcgctgcgccacgatgtccggggagtcagccaggagcttggggaagggaagcgcgcccccgggccggtcccggaggntcgatccgcatctacagcatgaggttctgcccgtttgctgagaggacgcgtctagtcctgaaggccaagggaatcaggcatgaagtcatcagatatcaagcctgaacacataagccctgagctgggttcgtttacagacaaaatccgcttatggatcctgcgtgccaagattcctgggcaaaaacaagtccaggggatccagcgttggcatcttacggaagatacttggcccaagtccaaccgttgatgacgtagcctgcgatgaacgcatacccagtggaagaagctgttgccggatgacccctatgagaaagcttgccagaagatgatcttagagttgttttctaaggtgccatccttggtaggaagctttattagaagccaaaataaagaagactatgatggcctaaaagaagaatttcgtaaagaatttaccaagctagaggaggtactgactaataagaagacgaccttctaaggtggcaattctatctctatgattgataacctcatctggccctggtatga

SEQ ID NO: 617745 - DNA, 412 bp, Homo sapiens
  misc_feature (78)..(78): n is a, c, g, or t
  misc_feature (113)..(113): n is a, c, g, or t
  misc_feature (377)..(377): n is a, c, g, or t
aaaacttaggatcccctctgaaacccccaggattaggggacacagcagtggctagggcattcagcccacagaactgancgggaaatgcccacttgtattggctgtaaagaaanccctggctttgggcccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccacntccagcctgggcgacagagcaagactccatctcca

SEQ ID NO: 617746 - DNA, 366 bp, Homo sapiens
ggatagagcccagattgacttcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtctcttccgccccacctcagactatgtgattgtgatgaaccagctcagcagggacatgatgcatagagaacggcacaccctactgtgctgcgaagcttcaacatcggcagctcagtacacaagcagcagcacccagtcgctggtgtacacccagcccgagcacagcgagc

SEQ ID NO: 617747 - DNA, 216 bp, Homo sapiens
gttttagaggtgtagtatgagatttgcactagcagtagtgtggatacagaggaaatcggtgcatgtcttgtagcaactggatttttagttcagcttctacaagtctactgtaaaccctgaaaagcatagaaacacacttagttttaaaagccatggatgtgaggcaggagagacggctcagtctgtaagaggtgtcactgctattccagagtcccg

SEQ ID NO: 617748 - DNA, 111 bp, Homo sapiens
aaaaaaaaaagaatgagacagtaactcagggaaatcctccttggaaggaaaggaagagatcatcaagctcggcctcataactccaaagtttcacgtgctccaggggaaatc

SEQ ID NO: 617749 - DNA, 468 bp, Homo sapiens
ccaaacatagcttccaatgccaaatcatatcagcaatgattccaccgctggcttgtctgctgccatactcgcgggctcatgtggagagggcaggcagcaccccaaggcagccatcacgggcaagcagctggagtttgattacgtcagcatctgtgtgtgtgtgtgcgtgtgtagtgtgtgtgtgagcagcatcatgtggggtgtcaactgtcatttgcagtgtgggcagcaaagcaaatgggactaacataggcagttttgtgtcttcagcaagtctgaaaatgtcatcatcagcagcattaaaattcatagcctcaaagtcatatggggttcagacaccagcttcagttactatacccctgtgctgtaaccatcacacataatttgactgtcacagagaaatgtttctataaacgttgtatgtgtctgttgaatcataacactgtgcccggcatcacacacaactga

SEQ ID NO: 617750 - DNA, 82 bp, Homo sapiens
aatattcaaacgaacacctttcctctggccctcacttagcttgtgaacagacatatttaaaatcctttcttggtgtagcagc

SEQ ID NO: 617751 - DNA, 420 bp, Homo sapiens
  misc_feature (100)..(100): n is a, c, g, or t
  misc_feature (127)..(127): n is a, c, g, or t
  misc_feature (133)..(133): n is a, c, g, or t
  misc_feature (186)..(186): n is a, c, g, or t
  misc_feature (217)..(217): n is a, c, g, or t
  misc_feature (252)..(252): n is a, c, g, or t
  misc_feature (259)..(259): n is a, c, g, or t
  misc_feature (326)..(326): n is a, c, g, or t
  misc_feature (360)..(360): n is a, c, g, or t
atcagcagcttctcgataagatctcaaaagttgggtaaatgggctcaagcttatgccccaaaaggcaaaatggcggagtttaatggtacatgcccttccnccaggaatgctagatctgtaagggaanaacgtnttaagtgagcatgtgcccttcagtatactgaaccccctgtgcttgtggccccnccaagtgctggcaggcccccgtgcatgtggncagcccatgccaaggtaggaatcaggggaaaaaanatgcaanccgtaaatccctggaagcatgccagcatatgaaaccccaatcaaaggtcaaaccagggacttgaatntgtcaagtcattcacgcctggccctcttccaagnggactttacttcctttcattccggctctaaaactttttaataaacgttcacccctgctct

SEQ ID NO: 617752 - DNA, 995 bp, Homo sapiens
tggagacggagtctctcactgtcgcccaggctggagtgcagtggcgcaatctcggctcactggaacctccgcctcccaggttgacaccagttactcctgcctcaccctcccaagtagctgggactacaggcgcctgccagcacgccgtggctaattacaggtattctagagtaagagacagggtttcaccgtgttagccaggatggtctcgatctcctgacctcgtgatccgcctgcctctggctcccaaagtgctgggatcacaggcgtgagccaccgggtcgggcctctgtgaacctttcctttatactggagacaaagtctccacgtgtgtacacccagactggaatgccgtgacacaatctcggctcactgaaactctttgccttccaggttcaagctattctgcatgcctcagcgtctcaagtagctgggactacagattgtgggccaccatgtcgtggctaaatttgacccgtcccgtctaatgccgggccacacaaccggggtttcgccccattgttcggacgaagctgggctcaaaaactccggggcacacacaggatgattggacgcgcactacaggtatttctcgacacaggcaggcggagcagacactcataagggcacttgaccgcagtgtatggctgtgggccataaaagacgtttttcacgaaaagggcccgttaggaggaagcacacaatgagcatgggcgagctcctcgtatgcgcgtagcaccaggggaatcacctctcagtaaaaagagagacccagggcccccctgtgttgggggcggcgccccgttgtcaagaaacaaagcgggcgaggcacggctaggacagacacaacacatgtgcacgggggggaaaacaattcctcccggcgcgcgcacacacagtgtgggcgccaccgtggggcaccccacattaaagaagagcggcgacgcccacaaccccccgggtgttcacaagctcccaggcgagggagaacaaca

SEQ ID NO: 617753 - DNA, 188 bp, Homo sapiens
agctggattgcagcatttccactgtcagttcagcatttagcttcaatcatcagttagtgtctgttgtccattcatgtcacatcctttcctcatggccaggcacaacagctcaattcaccattttaatctcactcagcatcttgttcatgccagcatcatttgtgccccattggccatcagtttatgct

SEQ ID NO: 617754 - DNA, 314 bp, Homo sapiens
ttaagtacttccacatacctctataactcgctgatgcactgggcacgcgtcgaacaaggtttcctcagcaagctgccgtatcagactcaatcgaagtaaacaggttctagggttccttgaatgtatacatatagctagtataaattgccttctctgctgcgacctgggcctttactgctatcttccagagcttcctttaccataatctgcagcgactttaacatactgttgcactataagctagctcttatagattctatctaacaacatctcagctctgccataacccaataccaaacgcccctcttcgtctg

SEQ ID NO: 617755 - DNA, 638 bp, Homo sapiens
  misc_feature (626)..(626): n is a, c, g, or t
ggcttctctgcccctttcaccccaggcgcatccgccgcggcgccatggcgcgaggagacgccccgcgggacagtacttccaggcgcgactggccggggccggcaacagcacagccaggatcctgagcaccaaccacacgggtcccgaggatgccttcaacttcaacaattgggtgacgctgctgtcccagctgccccttgcttgctcttcaccctcctcaactcctttccttgttaccagttgcgtcccggagacggttgcgcatttcttgggcagccttgcttggccattacttgcttgcttcttttgcccttgacagcagcgcttggttcaaggttggacattgagccccggaccctttctttcttccattcaccattggcctccgttcttgctttcattcaacttcctttcagttgcagttccttacagggcagccttcttcgggcagctgggcaccatgccctccacctacagcaccctcttcctcagcggccagggcctggttgggatttttgctgcccttgccatgctcctgtccatggccagtggcgtggacgccgagacctctgcccaggggtactttatcacgccctgtgtgggcatcctcatgtccatcgtgtgtnacctgagcctgc

SEQ ID NO: 617756 - DNA, 1010 bp, Homo sapiens
  misc_feature (405)..(405): n is a, c, g, or t
tccaaaaaagccagttttttttttattggtaaagctcggccaaaaatttctagggtgtgccaagtggtgtcacctggccaaatctcgcaccaggttgtggtccggtgtgtgacccagacaaaacagagatgttctgggccatacagacaaaccagggccaggggagggtggcactgggggtgggtttctggctcttggtggctgggtactggataacttctctgtgtggttctcacgttcacatctctatacaagggattctttctccctctctataaatctcccaaattctgtgtgagtcgctggggcgcctgtgtgggacacgacacaacaggccaggatacggcgggtgtaggcgcttagaaacgccaccagtggggccgtgtgtggagtatattggttccncccagccaatctcatagcgcgtgtgtataagaggggtgttgtgggcgcttcgcggtgtgagaatttccccatataaacgagtgggcgcgtgggccaaactcatgtggggcccctcacgagaaaagccgacacagagagggggaacttcccattctgtggaagagggacacaggggtccacccggggggtgtgtacagagaaaataccgctctgtgtgtgtgtgcggcccacagcggggtggggtggggggccttctacaaggctgtgtgacagagtaaaacgcccagaggggtccacatataccctgtggaacccagggcttttggtctccaggcaccaaagggacagaccagaccagaccacggggggtgcgcatgcgcataggtacggggggacaaaacaaaaacgggggagacaccaccaaagagaagcaacccccaacatttcgtagaggggggggggtcccaacaatctctgggagaaccgggtggctcaatttggggcaacaccagcccccagggggaatcattccccaaaaaagagctgagacgaggcggtcaaaaactcctccagagagaccccaagagagacaacatccctgggcg

SEQ ID NO: 617757 - DNA, 169 bp, Homo sapiens
caacggatgtgccgctccgacaaaaacaaagggaatgcgtcgagaatgtcgtttggtttcggtaagctcgttgtctcacttggaatgctgtccaccgtcgtcggaacaagcctcccggccgccgcgcagagcggagcggcctcctggtacgggagcggcacatgcgttg

SEQ ID NO: 617758 - DNA, 836 bp, Homo sapiens
  misc_feature (1)..(1): n is a, c, g, or t
  misc_feature (155)..(156): n is a, c, g, or t
  misc_feature (158)..(158): n is a, c, g, or t
  misc_feature (160)..(161): n is a, c, g, or t
  misc_feature (163)..(167): n is a, c, g, or t
  misc_feature (169)..(169): n is a, c, g, or t
  misc_feature (272)..(272): n is a, c, g, or t
  misc_feature (276)..(277): n is a, c, g, or t
  misc_feature (285)..(285): n is a, c, g, or t
  misc_feature (289)..(289): n is a, c, g, or t
  misc_feature (305)..(305): n is a, c, g, or t
  misc_feature (325)..(326): n is a, c, g, or t
  misc_feature (334)..(334): n is a, c, g, or t
  misc_feature (345)..(345): n is a, c, g, or t
  misc_feature (347)..(347): n is a, c, g, or t
  misc_feature (374)..(374): n is a, c, g, or t
  misc_feature (377)..(377): n is a, c, g, or t
  misc_feature (430)..(430): n is a, c, g, or t
  misc_feature (500)..(501): n is a, c, g, or t
  misc_feature (507)..(507): n is a, c, g, or t
  misc_feature (589)..(589): n is a, c, g, or t
  misc_feature (591)..(592): n is a, c, g, or t
  misc_feature (594)..(594): n is a, c, g, or t
  misc_feature (596)..(596): n is a, c, g, or t
  misc_feature (608)..(608): n is a, c, g, or t
  misc_feature (619)..(619): n is a, c, g, or t
  misc_feature (735)..(735): n is a, c, g, or t
  misc_feature (738)..(738): n is a, c, g, or t
  misc_feature (819)..(819): n is a, c, g, or t
nagtttcattagagatcacaaaagttcagttggaatcaaaagggacagaagcctgtgctctcacagaagcagaaaagcttaaactttcaaaaccaaaacagagcagagctttgcaggtttatattctgaataataagaaaaggggaggggtaggnngngnntnnnnncnacaaccaaaggaaagcatttcaaattgaaaatgccaaaggaaagaagtaataagagagaaaaggagaaaaacattgaatgttttatttattttaacaaaaganaaannagtttacnaaanataaaagattccaggncgctttgggctagggcttgnnaccataanggtgatgtganangctcatcattattttgttgtgacttcnagngtacaagtgttcaggtagaaatatttcctaaggcgttgctccacaattctgcnttctttctttacttttcttgcttaagttctgaccactttctgaacataatttgttgaatgatggtatttnncatgantttttttcccgataatatggctttcttttttcctctaataaccacattccaaatcaagccagttttgcaatttgctttaatnanntntnttttttttgggntactaagaggngtactctgtgaagtaaacgtaacctcttagcattaaaactacagcattgagcctggcccaatatctcattaactcttcatccaaaaccaggactcagctggcagactggccccaanganttcttcctgcatgtagtttacttaaccaatggtgcccatcataccagcatctcctgcgggactctcctggaagaaaaggcntctttggttggaagagg

SEQ ID NO: 617759 - DNA, 457 bp, Homo sapiens
gcgccctgttagcagcgtgttggctcatgcctgtgatcctcagcatgggagtccgaagtgggtggatcacctgaggtcaggagttctagaccagcctggccaacatggtgaaaccccgtctctgctggaaatacaaaaattagtcgggcatggttgcacatggctgtagtcccagctactcgggaggctgaggcaggagagtcgattgaacccgggaagcagaggttgcagtgagccgggatcatgccactgcactccagcctggatgacagagcgagcctccatctcaaaaaaaaaaaaaaaaaaggtaccaaatttttttctggacttctattccccaaaattccgggccccaacactctgggacgctaaagtgctgtggaattgaggatggggaaagcagggaggttaggagggaaagagatttgagaatgtgacgctggcctacagcacattg

SEQ ID NO: 617760 - DNA, 658 bp, Homo sapiens
catacggaactgtaagtccattaaacctctttcttttgtaaattgcccagtcttgggtatgtctttatcagcagcatgaaaatggactaatacagtaaattggtaccaggagtggggcgttgctgaaaagatacccgaaaatgtggaagctactttggaactgggtaacaggcagaggttggaacagtttggagggctcagaagaagacaggaaaatgtgggaaatttacgaacttcctagagacttgttgaatggctttgactaaaatgctgatagtgatatgaacaataaggtccaggctgatgtgttctcaaatggagatgaggaacttgttgagaactgaagtaaaggtgactcttgttatgttaaagagactggcggcattttgcccctgccttagagatttgtgaaactttgaacttgagagagatgatttagggtatctggtggaagaaatttctaagcagcaaagcattcaacaggtgacttgggtgctgtctaaaggcattcagtttccaacacgggaaaacactataacaaaatttgaggggtgcattacagttggaccaattgcagcctgacatgcatagacagaacatcccatttctgaggtgacttgggtgctgttaaggcttcacttcccagggactccgtaca

SEQ ID NO: 617761 - DNA, 260 bp, Homo sapiens
gaacatcatagcacacaggcgctagcaagaaggggcggagacctccaaggagctggcctgcagtcagcttcgggatcaggcgtaatcaacagtcacttctggctggggccctctgagcccagagttgactcctgggggttccacgccccctaccaagtccctactgcctgggtcatggcgcagggaatggagccttatcttcgggggcaatagagctgggctcaaaccctgccttgccattcactaagtttccctgtgtg

SEQ ID NO: 617762 - DNA, 108 bp, Homo sapiens
atcctgtaagtggtggccactgctaggcattgaagatacagtggtgaacaatatatgcagagaaaataacaaacaaacaatggtcacgctgattgcctgttttgaagt

SEQ ID NO: 617763 - DNA, 287 bp, Homo sapiens
aggcgctcgctatcattgaggcctcggctggcagcgccgagaaggtcatcagcgacgccatctacgagaccggcgcgcagaacctcaacgtgcctgctgtgccatcgtggccacgctgcgcggggagtcggtcccgcggttcgccctgggcggccagcacgctggcggcattcgcctggtcggtgaaaacggcccagagctggaggtcaccgggccggcacgttactggagctacgagcagacgcgccggctcatgggcggcgcattcgaggcgggggtacccgagc

SEQ ID NO: 617764 - DNA, 476 bp, Homo sapiens
cctttgtgaatatcgtgtttcgatcaccattgaagctatagggggcaccgagaggttgttatgcagcgataccatacctactcacttcaataggggattgtttttccagttagttatgacagagaactttcctctccttaatagaagcatcctttttaaagaaacacttgccttgtgccacacactacactgaaaaccaagttatctagacagagacattactcagtctacttctaatcaaggatgaaagtgagctgtatattctaaaagcagctaactatagttgtactacctactctttgggaggctagcttgctgatataaccttcttagttaacagaacggatgcaccaatggctcctagttcttgagacaggacccaaatcaaattgtcatgataaaagccgcttatagagcacttttgtcctatattgtaagaaagttcgcattatcgacacactgacggcggccgcaac

SEQ ID NO: 617765 - DNA, 102 bp, Homo sapiens
gatcacgtgcatggtgatgaacatgaggttggcatcatccttttggtcccattcgggtgtccaagaggtgggaacagcacaaacccaatctgccagaaccag

SEQ ID NO: 617766 - DNA, 310 bp, Homo sapiens
ccctgggcctcggttttttcattttgcataattggagatcatccctttttcctccctccctaggttatgaaaatctaattaaacaaccccggtggaaatatttcccaaattcctaagcattatgcaaatccatcagaaaatggaagcccaggatgaagtcatttcccccgcccccgcttcgctggtgtgggtggaggaagcctgtcatggaatcccccctgtgggcccccatgacaaattttaatctccaccagtattttccctgaaattccctttggtttatgttgtgcataaaatccctttggggtta

SEQ ID NO: 617767 - DNA, 367 bp, Homo sapiens
tgatcctctccttcaacggaatgcttgcacgcctggaagacgcgttcgtccggctatcaaacttctcagccgacatcgcacatgagctgcggactccggtaagtaatcttctgacgcataccgaagtcgttctgaccaaaaaacgcgacctcgatgcctacgaagacaacctctactccaatcttgaagacctcaagcgcatgtcgcgcatgatcgatgacatgctgttcctggcaaaagctgataacggcttgatcatccccgagcaggttgatatcgatctggtcgggctagtgtccagactgattgagtactaccagcttgcagccgaagaccgaagcattcggcttgcccttcaaggcgaagg

SEQ ID NO: 617768 - DNA, 410 bp, Homo sapiens
agaatcatatacagtcagagtagacgtgcaatgtctctaggatgcgaagaccacattgcggcgactgctgttggaaagtcagtatagcgtggtgccagcatatactgggcgaggtcacaactgacttcgtccctcgaagaacgttggcgggcccattgacttcattgacttcttggtcttccataactcatagagatgtacatttctgtagtcttaagccacccaggttgtggtcatttgtcggtggtagccaaggaaaaacttaacctgtccaccaatgaggcctctgggtctggttccaccaggagctccactcagatcccaagacagccagagactggctagccatggtggcgtgagcagaggagaggaacggaaggctttgtacgcacacaccaaaacagagagcc

SEQ ID NO: 617769 - DNA, 306 bp, Homo sapiens
  misc_feature (4)..(4): n is a, c, g, or t
  misc_feature (54)..(54): n is a, c, g, or t
  misc_feature (132)..(132): n is a, c, g, or t
  misc_feature (300)..(300): n is a, c, g, or t
agtnatttgtatatatcgttcaataaatattggttaatattaccccaggtgtgnttgtcacgccctgtaatccccaatactttgagagccccaggacaggcagattgcttgaacccaggagttcaagatcancctgggcaacatggcgaaaccctgtctctacaaaaaaaaattacaaaaattaggtgtggtggcacacccctgtagtcccagctactcgggggcagaggtgggaggattgcttgagtctggtgggagacccaggttgaagtgagccatgattgtgccactggactccancctggg

SEQ ID NO: 617770 - DNA, 976 bp, Homo sapiens
ggagtgagtctgggggtctgggtacaacacccgacacaataagagtgacatgaaaacgtgtacattgaaagagggaggtataggttcccctcgtggtatatatccacttgttatgtgtgcctctatacgctacgttgagaactagcgaatcgaggggacaaggggttgtcccccacaatgacaagagcaacattgttgttcgtgcattcccatactggtacggacaacattactaaggcttttgtcagggaatcgagttggactcaattgtcgtgataactctacgtgcttactctcagaacgtgtggagtcgcattcgatggtcgagtctacgcaactactggctgatcctatcctcgaggagatatatgagtgagtcctcatggacgaaaaattgtggatcctatataagttagataagtaatagcttggaaaaaaaggagatgtgaccacagcactgctccgagacaagatttcctttgaagacagttgctagtaactaacctaaaggggtgtgacttcagatagaaccatggtcttggaagtcagaatgaagttgatgaagtgtcaggacctgctggaaccgaggtgtactttcccatgtgcctcgacgacagataactctctggatgagtagctagtctttttgcccatagggttggtgaggctaccttgaagagtaggggctgtcactgagtgaaaagtgacattcctggccactcactgcatttgatcacagactgtagagtttttgacaaagtcactttttattcttttaagttaatttaacatatgcgagatgaagaaaaacgtgtgggagggtttaatgattgtaattaacaaacatcaatgatttaaaggagagggggattagattctttcaaaaatacatgtgggcccaggaggtaatactgaatattgttcagatccaagataaggttaaggaaagccccagttttgtgtaataaatgagtta

SEQ ID NO: 617771 - DNA, 380 bp, Homo sapiens
  misc_feature (380)..(380): n is a, c, g, or t
atacatacatacatacatacatacatacatacatacgacaggtgcagtggctcatgcctgtaatcccagcactttgggaagccaaggcgggtggatcacaaggtcaggagattgagatcatcctggctaacacggtgaaaccccgtctctactaaaaatacaaaaaattagtcgggtgtggtggcgggtgcctgtagtcccagctactcgggaggctgaggcaggagaatggcgtaaacacaggaggcggaacttgcagtgagccgagatcgcgccactgcactccagcctgggcgacagagcgagactccgtctcaaaaaaaaaaaggaaaggaaaaaaggaaaaaatttttcagaatgtttgcaacatgattctcaan

SEQ ID NO: 617772 - DNA, 1127 bp, Homo sapiens
gccatacaagcccaaccagaaggatcatgccacattgaatggtctgcacagtagtgaggcaggtgctgtggaatgacatctgccttccaacttcttacgtgagctaaggcaggctctcccctgcaatattcagatggcatgttcgagccaccaattctgttgcctatattatatagggtggggcaggcgcaagaacaaggtgggagccaggggcagttccgaagcatgtctctcagagaggagcagcacaggcaagtctcaacgaatgggtcaggtgccgagcttgtggttcctgcctgcacgttgccccgttcctctctgaagttgaagtcacgagggaccttgcgctatgggcctggacgatcagtttgcctgtcaacccagaaagtcggccacacaagccagctggtacggcacattctacacattgcacgcggcttgctattagcacgaaattaccgagatgcttcgtgcccttctgcaaacacccgcaatgttgctagtcgagaactctggcatccgcacgatggcgggaacctactatgacctactcctgtcaatgggcccatctggtacatgttcacggccatatctcactcgggatttgggtcaagtactacagagcacaggcaaaccatttgtgtccatggtccatcatttcccaaggcccttcccaccccactgctcaacgtgtttcacgcattagcatcgcaaggagtggccgctaatctaaccccaggcaaaacaggtgctgcatgtacttatccccatggaccgtgctgcccttactggcacccttccacttgcaacccacccgtacttccttgtatacggacctatgggcactccctacccaaatctctacgtaacaggttggactcccactaagtggatcaccgcgtaaggatttcaaccccgtttgctggttccccatccctgctgacaaccctgggacaaattctacgtgtaggacttattccacgccaatgggccatcacgcagaagcatctgctagggtccccttcccaccaggttaaccgaacaccctcctcctattgggaaggcagggtatggctacttgccacttaatctctccggtaaggcaggcgggctctctgcgcagaacg

SEQ ID NO: 617773 - DNA, 866 bp, Homo sapiens
  misc_feature (131)..(131): n is a, c, g, or t
  misc_feature (133)..(134): n is a, c, g, or t
  misc_feature (141)..(141): n is a, c, g, or t
  misc_feature (146)..(150): n is a, c, g, or t
  misc_feature (167)..(167): n is a, c, g, or t
  misc_feature (171)..(171): n is a, c, g, or t
  misc_feature (182)..(183): n is a, c, g, or t
  misc_feature (216)..(216): n is a, c, g, or t
  misc_feature (218)..(218): n is a, c, g, or t
  misc_feature (230)..(230): n is a, c, g, or t
  misc_feature (236)..(236): n is a, c, g, or t
  misc_feature (245)..(245): n is a, c, g, or t
  misc_feature (309)..(309): n is a, c, g, or t
  misc_feature (322)..(322): n is a, c, g, or t
  misc_feature (345)..(345): n is a, c, g, or t
  misc_feature (351)..(353): n is a, c, g, or t
  misc_feature (361)..(363): n is a, c, g, or t
  misc_feature (371)..(373): n is a, c, g, or t
  misc_feature (379)..(380): n is a, c, g, or t
  misc_feature (385)..(387): n is a, c, g, or t
  misc_feature (433)..(433): n is a, c, g, or t
  misc_feature (826)..(826): n is a, c, g, or t
tctgtctagctatctgttggtaatacagaaagtatactacttttttaaaaaagtgggcagaattcttgtgtatgtatatttgtgtgtacagtatgtgtatgtgtgtatatatatatattatatatatacanannatataancaaannnnntaaggaaaaacaaaaanatanaacaaaaaaannccacagcctcgccaaagaaatatttcaaaatgncnataacaggaggnaaaaangaaaaccanaacctaacttttatacaggctttatctttaatttaacgatgtgcggaggactttcttgcttgantctgttccgggcngcctcccccccccaccaaatgcntttttnnntttttttnnnttttttgnnnttcagnnggggnnngaacagaatgctggaacccaggctggactcggacacactaaggttntgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttngcagttcagaatccaagcacttgatttgctgggtttggaa

SEQ ID NO: 617774 - DNA, 427 bp, Homo sapiens
ccttgagactgatagaacagactctaagtctggtaaatatttacaagctatcctctctgaagcctgctaccctgaagcttcatctgcatggtaaaaccttggtcttcataatcccttaccttaacctaaacattcttttctattgattccgggtctgtagataataaccaatcgccaatcagaaaatcttcgaatgcatctatgacctggaagcccctgacttccagttgtcccacctttcctgaccaagccaatgtacatcttacatgtattgattgatgtcttatgtctctctaaaacatataaaaaacatataaatgcaagatgcagcctgacccccttgggcacatgtgtcatcaggacctcctgaggctgtgtcataggcatccccttaaccttggcaaaataaactttttatatgaaaaaa

SEQ ID NO: 617775 - DNA, 399 bp, Homo sapiens
aatattctattctgcatcctagactccacgccggctctcctcgccatccagcagcttcctgtaggtgcgatctcactgtccacgccagatatgacgtatcatcagactccgtggtactcacgcagactgccgcgccatgtcctgctaggcccgctgcagggcgggctccagctcggacaacttggcgttggcatccttgatggccagctctccacgctgctcggcatctgcaatggcggcctccagggaagccctctggcctttgaggccctcaatctcagcctgcagccggctgatgttccggttcatctcagagatctcagtctttgtgcgccgcaggtcatccccgtgcttcccagccaggctctgcaggtcctcatacttaatctggtacatgct

SEQ ID NO: 617776 - DNA, 644 bp, Homo sapiens
gctcgtagaaggcgcattgatcgtagagtcgacgtaatcaggaacgttcttggatgcgtcccctccggacgccctagttgccgggtgctcagactcactcggttgacatgtcgagggagccaagccccgaggcgtccctaacctaaacgctaaagtaacgtcagatcctccagatgagtttgaacaatggtgctccgagctactgtcggatcgtcccgagctgcatcgctgcacatgtatcacgctccatgtgcaaagcatgcagatgcaccggacctaggtaccttgctgtagagaaacatacaatgtcatggacttcttacagtaattaatattgatgcgccatcaatcggagaataatacatcctaaatattcattgaaatcactccctagtctagcaatggaacgccactagatcgatactagaatgcgaaggtagctcctagacattactggggagcaacatggagaaagcgagaccatagacaaagggggccgcacatctcgccaagggggaccgattcccgcgtaggacggtgtccagagatcgtttgagcgtggtcaggcaccggagggagtctttctgatgcatgacctggtgtggcctccaattctagtgtgggccaccggctgatactcagag

SEQ ID NO: 617777 - DNA, 657 bp, Homo sapiens
  misc_feature (126)..(126): n is a, c, g, or t
cgaaagtatcccctgtggggagagcatggagagaaaacaccccccccttcttgccagaaacatatttctctcctctcttgctctctggtgcgacacacgtgggacgacatcgtttttctcccgcgncgacatatgtgtattttctctcgccccccagcacagattcttttgtctctgtggcgggcgtgatactatgagtgtgcgtgagagaaagatatgcgacgcacagagagagagagagatatgtgtgcgagagtggctgtggtttacaggggaaagaggagcacacagttgtgtggtcactccctgacaagatgtcgtgacgagactcccctcgccagccgcggatctatgcaaaatacgcaccacactcactcgtgtcgtagacatacacatcacttcttgtaaaagcagagttgtgtgagacagataaatccactcaaaaatataaagagaggatcaccagtgttttacagaatactcgtgctatgatagggagggtgatgcagagctcgctgccactgttgaccaccacgtggttttgaataattacgacgcacgcgctggagcgtccggcactccaaatgattggtcaacacccacctcatcacactcaaataaaaaaagaaaaaataagggcgaaacaatagatcaaag

SEQ ID NO: 617778 - DNA, 273 bp, Homo sapiens
agatctcagaagtgcatggcctcttgctctatgtgtgaggtctgatccagggcacaatgtctgccatctctgactaacacggtcagtggagccttaaggtctgcccagagctctgtgagcaggctttcatatgtgtgcatatctacatgacacatggtgaagtacctgtgtattctagggaagttgcctaacaccagccttttccgaaggcactaccattaatcgggccccagccccctatctctattgcactatctacggatgctgactccc

SEQ ID NO: 617779 - DNA, 361 bp, Homo sapiens
cggcacgaggcaaaattattgctaaaaaatgctaaggattatctgagccttcagcgagttgtattctttttgctcatggagggtcttcctccatgtagttggctactgactgattagggtggttgttgctgaaggttggagtggctgtggcagtttcttaagacaagacaatgaagtttgccacattgagccttcctttcacaaaatatttctctgtaacatgcaatgcagttttgatgtgtgtgtgtgtgtgtgtgtgtgtgtgtgtgtgtgttttgagacaatctctcctgcaacctctgcctcccgggttcaagcggttctcctgcctcagcctcctgagtagctggaattgcgggtg

SEQ ID NO: 617780 - DNA, 152 bp, Homo sapiens
  misc_feature (24)..(24): n is a, c, g, or t
  misc_feature (32)..(32): n is a, c, g, or t
tccaagtgcattttttagaatatntgattttncttgattttattttattaaaaaagactggaactcagtcccattattcctattaatgtccattttcccaagagatgtcactggagataataatcttaaatattcttcgattgtggaggagc

SEQ ID NO: 617781 - DNA, 105 bp, Homo sapiens
ctctcgttggtttttgactaaaaacatttttctttttttttcccccatagacggagtttggctcttgtatacccaaggacagacatgcaataggcgccggtctcg

SEQ ID NO: 617782 - DNA, 1413 bp, Homo sapiens
acatactatctaccaccactgaacccactgctgccctgggcagtgagtggctagttttatctcctggacttgtaatttacactccagtatatttttacttctatcatactgggcatcattgtgcacacaagcggtcaacatcatcaggcattggtgcacccaattgggtccaggcaagtcccagtgttctggcactatggggctaagcagtggcggttgggcacctccagcatgggcaagggtggtgctcaagcatcctcctgcacctcaacagtgtcatttgccctttcaagcagaacacaatgctgcgggtccatcaggggcaccagctatgtccagcagggtcaggcccataagcagcacaggggcattcaccattgctacagcaccactcctgggcgccacgcgcaccctagtcacgacaccgtcggggtaacacaacactgctcgacagcaccgcctaagtgctccacaggcaagcactccgggcacacgacaaacagaacaatacaactgctaacatccagcactcaggccaccacgacagacacgcaacaacagctcctcaccgccccgccctgcacccacacgcaccagccactacttagacacaccccgtaacgggacactcacacacaaccacaccgacacaccaccacaccgcaaccacacgccccccaacgcacagaacacgtacgccccaaggtacccgccaaccgggcctcaaaggcataccacagcactcacaggactacccacagccaccctgcaccacagccaatcccacaagcaaacaccctacggcccacccggccacaaactgacaggacacccgggacaagccccgacatcaacaccccaccaggcaaccacgacccagtccacgcaccacacccactgaaccagcacgggaccatcagccctgcccgccaacacaccacgtggcccgcacctgggaccaacccctcaccccacaccggcaacaccaacaaaacaacaccacggcgcccaccaccaccgggccacggcccccacctcgcccccacacgcccccgcacccacgccaccggccacgccaagcgaaccaacagacacaaccagatgcacagcccaccatcatcccgcacacccacaacagaaaccaacaggcggacaccacacacgaccgaggagcacagccggccccacaaccgcaacagacacgaccggggccgacatacccaaaagggccgcccagcacacagaggggagccaactccagaccccacacacccccacaaccaaccccgacaggcaaagaaacaccccgccaaaccctaccacccacgacaccaagacgacaacacataaagaagcagcacacagcaaagacaccaaacaacaacaacatagacacgccgacagcgcaatcag

SEQ ID NO: 617783 - DNA, 211 bp, Homo sapiens
tgtagtagttgcaggggtactatataagggtatgaaatcagtaccaacaggtccttggacagctgcctgagcctgtccagcactggggaaaagagactaagtaactggaggctggggggcaggtacagttgctgttggtgcaggtggtctatgaagaattacctggcgctgaaacagcctgtgcatgagtcattggaggaattccaggacg

SEQ ID NO: 617784 - DNA, 889 bp, Homo sapiens
tggagtctgtggagagtcacgcgctgacacgatggaattcatgcgtttgtatcagcccagacattaaggccaaagggagaaggtatggatctgtagctagcaagtgtggtcacaaggaattacggacaaccttagtgcgcgagcctatgagtaagtggaatgtcaatgaggccattactcttactcatctgtcaccctagggagactcatggagttagtgaggaattgcaacgttcaagttccattgcatagaatcacaagaggccaagtcccgataagtatatcagcatagtctgcaacaagtaccaagagctggactgagttcgcttgaggaccatcatcatgttagcgtgccgatgctggaagtggaaggggggggtagtgttgattcgagtaggatgagggtagagcgtctgggagggtcagagtgatacctctcaatgtgaggactccgaattaagttgggagacaataggaacagagtactcgagtgattagttcagggtggttgggatgtgtgttcagatgaattacctgagtgaacataatgcagagatgtcctagtgataccatgatgggtagggtgatgcaaagttggagatcgactcctaggggagcaaggaattggttggcctataataaggcgacagagaattggaaggaatggcgtacccaaggtgaaatagtctaccgttgatccctggctcggtaatcccgaagtgaaaattgtgccgtccagaacggtgtcaggtgtgcatccaagcaccacgcacagagggggcgccaagtgcccatcaagggaaaggcaaaacccagattgaaggaatccccggtgccactggaacgttcgtaagggccgggcggaatggatactaagagcccgggcaaa

SEQ ID NO: 617785 - DNA, 991 bp, Homo sapiens
gagccccaacatagcagcaagtctgatcgatatcatgtacacatgaagcattgccgatcattgtgccgtctcgttcctcttgcgttgatctttgataaccaccgttaggtaagtagtgtgtttaagtagcttggttgaaagacgagagaagaaaggaacacaaaacatatgtaggaagattaacctgatatatcatatggaaggacctaaatgttagaatttgggctatctcatctttataactgtgtatgacggtaagatctatgatacactaaagtatgtggaggtactttctatgatctcctggattaatgatagaactcaaaaaaaggcatgagtacatatgagggtgaggaaccccaagatgcttttaagcttgcaaacatagtgacgtcgagtgatagtcatagtacatctgatggagacccatggagccagtaagtgttaggggcgaacagattgctccaatgctcgggtatagtgcaaatattgataatactggtagtgggcattagaatgtggaaaaggatccattaggaagtgttcgagtgaaacggaaagaaatgcttctaaggactgatcatgacgtgggtgttacgagagacagtgggtaattctagtgatattttgatatggtgtatgaatgttgtgagaatcaggataactttggttgggttccaaaagattaaagggtttaggatcagatatgacctgtgtcattgatcgtttcctgggggaaaggttatcgggagtctgggcgggaaagtggctgatgaggttagatggcatgagattgggctggtatgacgaagagtggcgcatgtcaggtcgggaagctgtggttgaaccttggatgtgaagttaaaacgttctgggggatttcacctttttgaggttggcggtaaaaaggaacgtgggaaaaggaaggaaggggaaggaggaaggaggattggggaagaaggaataaagcggggaaaaaaattttaaagca

SEQ ID NO: 617786 - DNA, 218 bp, Homo sapiens
gggaggaaatagccacctgacgccaaggaagggcgaaggagaaggctttgtgaaatcacctggactgcgaggtacacgcccgggctgctactttgctcaaaaacaagtaactgaacagacgtacgagcttcagcttccagaaggagaagaaatccgggcagcagtgacactggcctccagcctcaatctgttccgtagctcagagcctgcctgccagg

SEQ ID NO: 617787 - DNA, 558 bp, Homo sapiens
tgggcaggtgatcatttggtgtgacgatctcgattgaaaggaatcgggtcacgtctgatccagtctgtgtccttttacaggatgtgtgagggggcagctgggctgagcttggatggattgacctgctgcggaacctgctcacgccctgagttctccaaaagtctacagcttgagtaccgctgttgcgacattccagaagctacgcttgggaatctatgacatagacaacaagacgccagagctgagggatgatgacttcctagggggtgctgagtgtaccctaggacagattgtgtccagccaggtactgactctccccttgattgctgaagcctggaaaacctgcttgggcgggggaccatcacggtctcagctcaggacttacaggacaatcgtgtcgtaaccatggaggtagaggcagaaacctagataagaaggacttcctgggaaaatcagatccatttctggagttcttccgccagggtgatgggacctggcacctggtttacacctctgaggtcatcaagaacacctgaccctacttgaagcgttctcagt

SEQ ID NO: 617788 - DNA, 578 bp, Homo sapiens
agcggggctcttaggctaggtcagcaaggaggcggaactcggtgatctgactggcggtttcccggcggactgagaaggggagcgcgctgcgcgtcgaggagtaacctacttggtctcctgcttcgcgaatggcttcaatttggggctccctcgggcacctccggtaccgctgcagacaccggtgccccgcgggtgggttggaggatttgggacaacatctacaatgcaggttctgcattcagcttttctcccccaataaaacaggaactatggatctttggtggtactcagaacaaaggtttggattggtacatggtttggaaaacaaagggaactagtactggtttaggtactggtttgggaactgactgggattggaggattcaatacacagtagcagcggcaaactacataaggtggtctcttcaagtcagactacaaatgtactaccagtcaacagatgataaatactgcgagtgatcttactgtccaagctgtaggcagatgagagagctgctatttggaaaatgcaattacatgacgcattatgggaccaggaaaagggtatacaaaatcat

SEQ ID NO: 617789 - DNA, 90 bp, Homo sapiens
gcggccgcctactactactactgctcgaattcaagcttctaacgatgtacggggacatgttgaaaagaaagcccggaggagcgaacagaa

SEQ ID NO: 617790 - DNA, 256 bp, Homo sapiens
cgcttccccaccaagggtgacagcccatccatggcgatgaagcattcatagcagccgactagtgaaatcctggccatcctttctgagctctcaggcccaggcagcacgccagctcctggcacgcgtgagctcattactgtgcggcttagagtgttgcacgagcgaactggagctttgcacgggcttgcagcctctggctaaacggccaccccaagcctcgagctggccaggctcctgctgctgcacgacgccctag

SEQ ID NO: 617791 - DNA, 347 bp, Homo sapiens
tacaggatcccgtccggccacgctccgtgtcgggccaacgctaccgtgttgtgccaacgcaccgtgttgggcctacgcaccgtggtccagcagtacgccaaactcatcagtgggtgctcgtccttgcgcccgtatgctggggccgcccaataaagatgccgggggccttacaccgcatggcagtgtcgttgatcacttcgcatgttttggtggtctcaatgccgcgcgctacttgagcacgcaccccgggctcctgaaccgtcagcacgtgggtcccactcacagtgatggcagtgcttccattgatgatgctccaggtgggctcaaggcgggtgacggtgcgttgg

SEQ ID NO: 617792 - DNA, 339 bp, Homo sapiens
ttctctgactcgctcacgtaacgatcacgaacgattgaggacgtgctgccgaacgcagacggagagtttctacctgtggaacactgtgtggcaacagcacgaactgccagaggaacgagacggggcagctctgcggaactgaaagtaggttggtgtgactggatctaaataagaggtaggcagggcgagcgaggaaaccgtgtgaagctgtcgaactggcaactaattacaagggaggtggggcacaaccaggggcaacttggagctttcacttggtgcctggtccttatagcctccccagaattattcgttggatggctggtggagcggtgcgagggt

SEQ ID NO: 617793 - DNA, 182 bp, Homo sapiens
tggtctagaggatcccagtgatgctcaccgctcatctgcagctcactctctgagggtctgaggctgcatgcatcacataagtttatacaaaccagaggcaaacgacccagagatggtggctgctggccagcttagcttcttccatttaaacagagatgtgaggcctgctggttggagcggtg

SEQ ID NO: 617794 - DNA, 1002 bp, Homo sapiens
ttgtgcccgcccccccctgtgcaatacgacgggggggggaaaaaaccggtcgcttatcaaacagcacagctgtgttttcttcagcaggggcccccctactccagcgggtgttgtggttcgaagacaaaccgcgcgggtggttttggatttacccacaccgacgcgctggcgtcgtcaccccctccctcccatgaggggacaaggaaggcaggagattttctttgggtgggaccccacgccccccagtgggttatttcttccattggtgcgcgtgcgggtcgggcggcagcactgttacgcaggtacagtatagatagtgctgttgtgaaaaaacccagacagagccgtcgtgcttttcctaggtggggggagaaccacacaccttgctggcgcccacaccactgttgtcggcacacagcggattgtggagggagcgccctcctccaagaaaagaataagcagagaggagaataaaacaaatacaacatagaataaagaacgtgaatatgaacccacacaacccagcacacactgagcgggggagactctcccacgcgcgctgtcgcagaaaaaggagcaccacggatggggataaaaaatcgcgggggagacccagcgaggagtgaatcaccccccccggccggcccaagagagagaccccctgcgcccaccgcgagaagaacgagggagagaacatactctcatagaaaccctcggggagaggtattctctcccccccgtccttctgttgcgagcacaccccgctgcggatatatgggagaggaagaagacaccccccccccagaaggtggcaaggcgcgacaccacacaaactgcgtgtggaaacacgggcacactgccgcccggaggaccccccgcgcgggggggtttttataggggccccccccccatcgggggcccaaattttccggtttcccccgggttttttaaaaaaatttttgtttggaaaaagaaaataaacacccccctgggggtgggcca

SEQ ID NO: 617795 - DNA, 252 bp, Homo sapiens
cccatttcttctagttcgctgtctccatgccttttcttggcagttcaaacattcagagagggcatttattgcccttctttttgagacggagtcttgctctgttgccaggctggagtgcagtggcacgatcttggctcactgcagcctccaccttccaggttcaagcgattctcctgcctcagccttcccagcggctgggattacaggtgatagctaccacgcccgctaattctgtatttttgtagagatggg

SEQ ID NO: 617796 - DNA, 384 bp, Homo sapiens
gtcacgtgggagggataggaagtcatcggtactgatctggacgcagtgcgaacacagagccttggaggattccgaagcgtgaggaccaggaggtccccaccagaaacgagctgcttacaagtgggtggtggaggcagtaacctcctcatccccgctgtgggtactagcctctctgaaagccctggacttgatcgaggtcgggaacctgatgcttggtgtgaccgtgagtcaaatttgaactcacctgaggaaccatactgcagaggacagtatcacacaacaggctagatgcaagctgcaagcgtcacatcagcaagcaagtcctggcaccccgccagacttacagcctgggtgcccagtgtgaccgagtaccggcttcgcacg

SEQ ID NO: 617797 - DNA, 407 bp, Homo sapiens
  misc_feature (407)..(407): n is a, c, g, or t
acgcggttgtggggatgtcatagattggaaagtgggctgtgtcgcctccagcagaccctttccttactgagctgtgtggcctttactagtcactgcccctctctgggcgacaggggtctgtaagtccattgcgctcatcctgcacccaggaggctgatgtttccggagcacctgctgcgcagtgaggtgccttggggagggagcaggacaggccggcctcttatcttctcactgagcctggctgtggtttgtggggtaagcctcctttctcttctcacttttttctgctgagaacattgggcacattgagtcctgcacgcccgtcttgtacatcgggaaagggacatacagaacctctgacccacttggttagaggtgcagccatgcagtgctggaaccccttgccn

SEQ ID NO: 617798 - DNA, 239 bp, Homo sapiens
  misc_feature (13)..(13): n is a, c, g, or t
  misc_feature (132)..(132): n is a, c, g, or t
gtaggtatatatnatcgtgtaaaacaatgtatgcttttgtacaagagcgtcattaaaagacataggcatgaaagacaaggtccctctaggctgacatagtgccgtctgccaccaatcaggtacacaactttntgttaaatgttcagcaagccaagccactaccctgaagcttccatttattatttcagtttctcccacttaaatataaatagccatcaaaagattaccaaacatctgaa

SEQ ID NO: 617799 - DNA, 229 bp, Homo sapiens
ttcctctcacactgtatagggttttttttattttgtttgtgttgttttggtttttaactttttaataatctgagctggggctgggcatggtaatcccagtagtcccagcactttgggaggccaaggcaggaggatactttgaggtcaggagtttgagaccagcctgagcaacatagtgagaccccatctctacaaaaactaaaacattagctgggtgtggtggcatgca

SEQ ID NO: 617800 - DNA, 398 bp, Homo sapiens
cacgatacggcgactccaaacaggacggcctgtggtatccctcccctacgtctggagcttacggggactggtggagctgagaaccaaacgtagaggaaagaggagaagagcgatgtgggaactggctgggtagcgtgatcttcttgcccccatcttcctcagtgggttggggggtacaaagtcggtggtgtgcccatcccgccaggccccgctgtccctcagaagaggcctgagaccttcaggatgttcttgatgatgacatcggttgaacgcgtgtcaaatcacgatactgcacgttcttgtgtgtcggtggcgcatgtgaagtgcgtgtcgatctccttggtgtctttgcgcttattcaggtcctcaaacttactctggatgtatcttgctgtctc

SEQ ID NO: 617801 - DNA, 273 bp, Homo sapiens
gagggagagtgtcatgtggtagcaaatatatgctggatgctaaaaagggggtgttcgcttggagagagaaggctcagggattggggacagtgtcaccttccatgtgcagggctggtacctgggagaggaatttgggctccgtttcaccgctccagagggaagaactgatgcttttagctactgtaatgatgatgatgctaatgaaaaatgtatcatctactcttttttgaggggaccgtgcccgtggcttacaaaagttcctgggccagggat

SEQ ID NO: 617802 - DNA, 208 bp, Homo sapiens
attatacattttgcacttatttgaaatattatctcacggtacgaaataaagtgtctgtcacctccatgctgtgttgtcatctagcatgagctatctaagttctcatgttcttcagtatctgcatctgtaaaacgaagacaatgacagagccaacctcgcttagaggatcacatggcaaaagaaataaaagttaggcaaaaagaaataa

SEQ ID NO: 617803 - DNA, 590 bp, Homo sapiens
  misc_feature (58)..(58): n is a, c, g, or t
  misc_feature (65)..(65): n is a, c, g, or t
  misc_feature (67)..(67): n is a, c, g, or t
  misc_feature (130)..(130): n is a, c, g, or t
  misc_feature (250)..(250): n is a, c, g, or t
  misc_feature (266)..(266): n is a, c, g, or t
  misc_feature (272)..(272): n is a, c, g, or t
  misc_feature (398)..(398): n is a, c, g, or t
  misc_feature (486)..(486): n is a, c, g, or t
  misc_feature (506)..(506): n is a, c, g, or t
  misc_feature (509)..(509): n is a, c, g, or t
tggccaggtaacgtgcgcccctgcccccccccgctattagaagcccccaagtgtccgngcccgcntnaaccgggggttcagcgggcaattcagcaggggggtttcggagatccggcacactgcggaccgntggggggtgtccctggatgtcaaccacttcgccccggacgagctgacggtcaagaccaaggatggggtggtggagatcaccggcaagcacgaggagcggcaggacgagcatggttacatntcccggtgtttcacgnggaaanacacgttgccccccggtgtggaccccacccaagtttcctcctccctgtcccctgagggcacattgaccgtggaggcccccatgcccaaggtagccacgcagtccaaggagatccccatcccagtcncctttgagttgggggcccagtttgggggcccaaaagttgcaaaatccgatgagactgccgccaagtaaagccttagcccggatgcccncccctgctgccgccactggntgngcctcccccgccccctgggtgtttttttgaaacatttattttttgtttttttcaaataaagttcaaagcacccccctgtca

SEQ ID NO: 617804 - DNA, 263 bp, Homo sapiens
tttggttcctggggggccccagttgggaccccttccgcgattggtacccgaaaagccgccttttggaccaggccttggggttgccccggctgccggaggagtggtcccagtggttagggggcagcagctggccaggctaggtgggccccctgccccccgccgccatcgagagccccgcagtggccgcgcccgccccctgggtgtttttttgaaacatttattttttgtttttttcaaataaagttcaaagcacccccctgtca

SEQ ID NO: 617805 - DNA, 416 bp, Homo sapiens
tacttcacaggtggattccccttatcaaaccatcaaagtctcatgagacttattcactaccatgagaacagtataggagagaccgcccccatgattcaattatctccaagctgggtcccgtcccacaagcatgtgggaattatgggagtacaactcaggatgagagttgggtgggggacacagagccagaccatatcaaggagttagttggaagtgaatgagaggcatgggaatgtagtgatatagcgcctggtgatggattctatgctgagatatgtggaccaaaaggacatgaaaaggtaaggggtggtgaaagggtgatgggatcaatcgtgttgtaagtcttggtggacttaacctgattgatggagaaatgaatattggcgagagtaagctggaaactcagggggtggtcg

SEQ ID NO: 617806 - DNA, 107 bp, Homo sapiens
  misc_feature (107)..(107): n is a, c, g, or t
caagcagcccacgtggtcttcacgtctttcatgtttgaacagccagatacaggagttaaagaggcttagctgtatccaccagaatcttgatggcatatttgcaaggn

SEQ ID NO: 617807 - DNA, 1324 bp, Homo sapiens
  misc_feature (865)..(865): n is a, c, g, or t
  misc_feature (1324)..(1324): n is a, c, g, or t
ttaatcaaaatttaaatataaacaggtcataatcccatattgtacatgcagaacggatttcaataattccaaaaaacacaaggcggtcttctggtcaccatggtggctactgggctctggtcaggcaacaacattagaacaacatatcaatcaattggcagctggtgaggggggttttggtggtatctgcagttggttttcgtgacaaaacgcgtgacagcaacattgtggacctccgtggagtggccaaccgcacacaggggcacgagggccaccccagggcaccaccaaaggggaccagacggaaaaagcaaccatatacagggacacaagggtgagtaacaagaccatacacaacagagcgcgtgtgtctcacgtgaaatatatgtgtgtgacatgtgaggtgtgcacaacaacttaatatatatatgagcagaggactatctattcatcactatataccgatatctatcacacgagttgggaaacacaaaagaactgacccccgagacatcattgtgggtgatatcagtggggtattattatcacacacacgagggtatcatatcgcaaatgttgagtagcaaccgagaaacaccctcacacatataatacgacacactattttgagagaatgagagagagcgcatgagggtatccgtcggcgcacacgatttcgacatctatatgttctatccgacgacacgagtgtgcaaaacaatgtcaaaacgcttcgaaaacaacacacgcacacatctgtggtgatgataacaaccatccatcaccacacctcatgtacaacttatacgcacaattattatcacctaccaggggggaggaaacaccctatttacaaaaggggacnaaactttatttatcacgacactactattataacaccaattctgtgggagccaacctagccccctgtggaaacaggaatgttcgaccaccgacaaatgggtaacacctataatcaaggagccaatgaggtaaaccctaaaagaagaaaacaaaagacgatcacaacaagtaggttagtgaatcagaacaacacagtatgtagcgacagtatagacacaataggacccaccaaaaacagcagttaacaacgcatgtccgggaaagttaactaagaactaagagaataagttaccaggggaagaagaacaaacaatggggcagaagaccaaagaatataatcagcaggaaagagatgaacacaaacgaacacctcagtcagatgtgtgtggtacccaagggatgtagtaaatacacaaacgtcgcgcgaaatctacccacagagatgacccccacaacgcan

SEQ ID NO: 617808 - DNA, 315 bp, Homo sapiens
  misc_feature (27)..(27): n is a, c, g, or t
  misc_feature (43)..(43): n is a, c, g, or t
  misc_feature (163)..(163): n is a, c, g, or t
  misc_feature (179)..(179): n is a, c, g, or t
tgagttactttgccttagaataaatgnctctggctcccatcanagttgctgcaaaaagacattgtttctttttttatggctgaacagtattccgtggtgtgtatatataccacactttctttgtccactcattggtcagtgggcacttaggttggttccatanctttgcagttatgaantgtgctgcaataaatatacacatgcagattttttttgatatattgacttcctttgggtagatacccagtagtaggattgctggatcaaattctatccagtagcatttgaaactgctttaaattaacaatgagggac

SEQ ID NO: 617809 - DNA, 321 bp, Homo sapiens
cgaggttgcagatggccgctgtccttcgctcgagctgcgaccctggctcctgttgcagactgaacagaccacccagtgccgccgctgccaagccctctcctgccgaccagactgcgagacgactacatcattctgccgacagacctgcgctgccacaggcatcgccatccatcgcatcccagcgacagactgctgctcctagtgatctggactcacctgggaggaatctgggctggccacaggccctggacagggatccagacagctggccgccccccaagggatctgtcaccttgagcgagacctatttcctccccaccc

SEQ ID NO: 617810 - DNA, 309 bp, Homo sapiens
  misc_feature (153)..(153): n is a, c, g, or t
tcctgatggggcctgttaccagggtgggcactcatgctttctcttgagctcgatttaaagactcatcaaaactcttccccctaaagttttatattgaaccttagaactgaatcacctctaattgaattgaacaagcagccaataacttagccngttctttgaatccagtttcccaggtgttggaacagactgctgtcctgtgtgctgcagagtctgtcccttgttggcacttaggaagatccagtttctccctcactggaagtctgcacttctcaagcagaaggattaagcctctggggttgcttgcag

SEQ ID NO: 617811 - DNA, 250 bp, Homo sapiens
aagttatgtagtagaatgccttaagattctagactgaattctccgtaggggaatagcgactaacatcaacatgtataatacgccctctacgtagattccatggaaatcctgtataatgcgttaataatatgaatatactactgtctcccacttacagatcggattcatatgacacaatgaaggaacttttatctaagccctgcacaagtactattaatactgacatccaggaaagacctacaggtaccga

SEQ ID NO: 617812 - DNA, 795 bp, Homo sapiens
  misc_feature (760)..(760): n is a, c, g, or t
  misc_feature (786)..(786): n is a, c, g, or t
  misc_feature (793)..(793): n is a, c, g, or t
tacaattcaagatgagatttgggtggggacagagccaaaccatataattcttccccggcccctcccaaatctcatgtcctcatatttcaaaagcaatcgtgccttcccctaagtcccccaaactcttatttcagcattaactcaaaattccatagtccaaagtctcatctgagacaaggcaagtcccttccacctgtgagcctgtaaaaccaaaagcaagttagttattttctagatacacagggatacaggcattgggtaaatacactcgtttcaaatgggagaaattggccaaagcgaaagagctacaggccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattccggggtctggaggatggtggcccctttgtgacagctctgcttggcagtaccccagtggggactctgtgtgggggctccaaccccatatttccctttgacactgccctagcagaggttatccatgagggccccccgctcccgtgcacagcaaacttttgcctggatttccaggcattttcatacatcttctgaaatctaggcggaggttcatgaacgttaattcttcgngcatctgcaggcttaacaccacctanaacctgnaa

SEQ ID NO: 617813 - DNA, 1088 bp, Homo sapiens
agcgggagcgcgctccgcgctagccgcggagagcggccccggagggagccgtggagggcggggcgaggggctcacggccggcggcggtggccggggagctagcagcgcctcaaaaagagtgaatgaaccttgtagcgagtgcgtcagcagaatgtcgagtgttcatgaacggtcaggagatcgtctcgtctatgtgcagacagactccctcgatattgatgcctgtgcactgacgtcccggtgcatctgttgatgcaacgtttagtacctaaggtgattctaacgtttcggggcatgttcgaagcgtgagaacatagagcattcatgagtaagctggtgaagagtacccccagccggcctgaagataaacgatcatctcactgtcataatcacatagcgcctcttacggcatcgggccaggttgcaaggcgcgactctttggattgcatacgcaggtgctcttcagataggggtgcaaacggggtagtcaccgcgttgacctcaggacgaccggaaatttgtgatcgggggtcattgggattgcagtgctacgctcgccatatcctccagcgaggaaagccataagacgtataattggttccataggaatttgcgcatagtagtcgaaagagcatcaagtagagggcggtaatgatgtcggcctggcgacccctccctttgcgcactcaaggatgaaaaccaactaagacatgggaacacatcttttagtgaaaggcattactaccctattggagggaaatcggcactgacttgtgtagagaacagaaaagaacatgggttgtcccattcttagggaaatcgatccatgcctagtttccattggaccatagttcgcaacgaataggcgataatggacgatttagcaaatccaacacgggggcgcgttcggggaatagtcgagacggatggggcaaagggcaacgcggacattcacgcgaaacaggtaggcccaacaaggaaagacagccacccagggcggcaaggaaacccacaacagaaaatggaacgtagcacaagcagccacctagggagccacaccatccgtacaattgacggagaagcaacag

SEQ ID NO: 617814 - DNA, 1109 bp, Homo sapiens
ttgaatcatgtgtggcaccctaaacggatggtacattggcaagatttccgcgtaggtcacaataaaagcgctggtcgtgaacccggtggcccgtttgagcccctctctttctggataatggattgtcccagccgtaatccccgcacttcccggttctcgatgcatattcttccggggattgcacggatccctcacgctgtcatcattcacaagaaagagggcagggcctgtcattaatgtgctccggcggttccaacgagaccagtcccgctctatcgtgggccaatgtcaacgccatcttgcgcccctcgtagcgctcaccttgttgggaatactgcgatacttgtcacgactcgtgtacactacacaggccaacgcgactcacttagttcaggagcaacgacctgctggcacctggcggacaagcccaagattcaggaagtcaaggagcagcggttacggggatctgctggattgaccctgcttgattgggaccatcgtccatagtctatcgagggatcatgcctccaggcaagatccccctggccgtgctctcttgggaattcttcctgctacactgggagtcaccttccccttcacgggatccagtttcctatgagcggctgcatctgctgctcatgccgcccaaacaccacccagatgtcacttacgtcaagaaggtccggaccctccgtatgcacctgttcacggccctgcagctgctctgccttggcctctgcatcatgggccagtcatagtccacatgcatgcctcctggccttccccttcatcacgtcatcctcagcagtgccggctccgacatggtggtgctcacccgtatcttcaccgaccgagagatgagatgtctggatgctaacgaggcagagccggtgtttgatgagctggagggtgtggacgagtacaatgagatgcccatgcctgtgtacctgcctctcgagggacagccgagggaccgatggatgaggggacaggctggtgggatgggattccccctcccatgcccgtccctccttattatctaagtgaataacttataaacgtctgtcttcacataatcccccccctggctccctgcaggtaaagtgcca

SEQ ID NO: 617815 - DNA, 603 bp, Homo sapiens
  misc_feature (341)..(341): n is a, c, g, or t
  misc_feature (468)..(468): n is a, c, g, or t
  misc_feature (478)..(478): n is a, c, g, or t
  misc_feature (518)..(518): n is a, c, g, or t
  misc_feature (590)..(591): n is a, c, g, or t
atgatgtgtcttaagattgtggaattctaaaatattgaaataaaatcatgtttggcttacttttcaaggaaataaaactgctgtactttcattcacagctgatgaaagaattacagaagaatatgggcaacaacaattgtagtagatttttaagtacctagttaaaaagtgttctgggccatccagatatatggaaagcaatattccttaatcttctctcctggagctcatttgctcacgtaaaagttaattataaaacattgctatatgacttctactggaggagaattcaccatgctgggaatggcagcaggttgcagtggagaagggctctgaatcgnaccatgagggggctttgagagttcaagaggcaaattacccacaccactctctggtgccgtgttctcaaacacaagtcaaacaaataggggttggacaatgatgaacttaaaggggtcccttctcatntttgaaaaantgacacaaaaaaaggacaagaaagacaccattcagattcntactttgggttttctaaagataacacccaacacactttagaaacctcccccccttcatgttgttttcaagcnnaggaggaaagta

SEQ ID NO: 617816 - DNA, 889 bp, Homo sapiens
ggaggacttccggagtcctgcgcagggcgctcctcgaaatgaggtggtcggacagcatgtgtacaagaaagcgttcccaggtacaggccttgggtagagaaaacgcttggatgtaacactgttcgcaggcgtgtctgtgacccagggaggaggcgagagtgaactgctccagggtctcgtgcaaccgcgcatcacataggctggtgggattccgtgaccggtactctgccgaggcaatgctgggtcgtctctttccaagaaaattgccactcgaaaacctcaaaaacctgctgagaaaggatcatcgctagaacagtgtgtctacttggagaacgcgagatggccaggctaaagtcaagagatctcctcttgggcaacgtctctgtggctgagtcgtggagctggaggagtggatactcaagaacctcgctcagacacgcagtgcgagcacgacatggccgtccccacctgactggcgtgccgagatgaagatccaatgaagatcccagcctgatgcggagacaaaccctccatctcagcatgtgcaccgtggagctgagcaaagaaacactggacaccatgttagatggcctgggccgcatccgagaccaactctctgccgtggccagtaaatgatccagccagctgccagggccactgccatgacccagctggtcatgagtgataaatgtctccccagtatgcaggctgcccttgcagctgcagctgacaacaggcaggatggtggggacagcagcgcggctactgggcatccgggaagatgacagggggactgggaagaaggccgcggatcccccgttgttcgtcactcgatcttggtaacgtctttctgaaagctggagagcagaagcccccatctttgcaaagc

SEQ ID NO: 617817 - DNA, 1226 bp, Homo sapiens
ctagaagtagtacttgcatcggtcattttgaaaagcactgcaatcagtgaacttgtggcatctcaagaagaacattgaaaaattctatgaatttgttgtagccggtgaattgagtcgtattgctgtcacataatatttagaagaaacacttggatgtcgaacacattctcttctcgtctgcactgctgcgttgaatgtccttggaggctgtctctctatgtatgggttggtatcaatgtgagtcccttcattctagaatattaatggcttttgccattcaagaatcagagtattggggacaatgccgatcagatgtatgaagttcaggtatccacatcataaattcagatgtgatggtttcatgcatgtaagatcgaatattgttgaaggtggatacgagcagactgtcgtttccgtcccgcgagcaaagactttttgtaaatcgggaaaaacagagacctctttttgctttaggatggtgccaccgtatgctccacctacaagcagagattttaccatggaaatcggggctcacgtgaagaactgatttcctgcccaatacttggtcgttcggggctgtcgtctagtgagctacttattagagggaactcctagcgtgggttatacaaggttcaagggctttctaatgttagttccatcgaaccttcgaaaagtaggccgttgaagaatctgcacaatacaggcacgcaggttgaccaatgcgaaacacggtgaggttcgcatttaatgttaggacattcagaaaaggtgaggttgtggactttggggcgaacattttcaagggaattgtgaaaggattctgttgggtagctttaaaaaaattaaatacactgggtgacttagagaaaacaacaatgatggagaataacacagagaaaatcaaaaagaaaacaaagggagataaccagcccacacaacgagaaccaatgaatgaaccaaaagaagaggaaacaggcaaaacgggatacaaacagaacgggaacaaaagaaagagaagagggcgagcacaaaggcagagaacgaaggaaaacaaaaaacacgaacgacgcacgccgacacgacagagcacgacgcaaaggagaagtgagacgcagagaaagaaatagaaaggaaagaagaacgcaggggcaacgccagcgatagacgcaaccaccagacgaaatataaagaagaaagaagaaaagaataagcagacagagcaccgc

SEQ ID NO: 617818 - DNA, 916 bp, Homo sapiens
  misc_feature (22)..(22): n is a, c, g, or t
  misc_feature (154)..(154): n is a, c, g, or t
  misc_feature (333)..(333): n is a, c, g, or t
  misc_feature (339)..(339): n is a, c, g, or t
  misc_feature (602)..(602): n is a, c, g, or t
  misc_feature (606)..(606): n is a, c, g, or t
  misc_feature (617)..(617): n is a, c, g, or t
  misc_feature (635)..(636): n is a, c, g, or t
  misc_feature (646)..(646): n is a, c, g, or t
  misc_feature (651)..(651): n is a, c, g, or t
  misc_feature (654)..(654): n is a, c, g, or t
  misc_feature (740)..(740): n is a, c, g, or t
  misc_feature (749)..(749): n is a, c, g, or t
  misc_feature (762)..(762): n is a, c, g, or t
  misc_feature (772)..(772): n is a, c, g, or t
  misc_feature (789)..(789): n is a, c, g, or t
  misc_feature (792)..(792): n is a, c, g, or t
  misc_feature (826)..(826): n is a, c, g, or t
  misc_feature (890)..(890): n is a, c, g, or t
ggcgacccaaagagccagtggntctcgcaggctcaattccgttcgccggttcgccacctcaggggaacgaaggccatggagtccacagccacggccgccggcgccgcggaggcggggggcggccgacaaaaaagaagaagtacctgcacctacnacaactgcagaaaaagtggagagtctggatgtggaaagtgaagcaaagaaacaaagggggttaggacagaaacaactggggaggggggagaggccagcagctgtcaatgcattccaggaagcagccaggccttgagggaagaaggatggagagacagccaaagagggtggagaagcctncttttnctatgggaaaacacttctggagtaggcaagaatggagaatggggtgtagggaaacgccttggaaggtgtgcatggggaagaggaagaaggagaaaaaacagaagaagaatctctgggagaaaaaaaagataacatagatgaaactgaaggctcggaagaggaggagaaagaaaatgataagactgaagaaatgccaaatgtattcagtccttgaaaacaagtctcttcaagaaaatgaggaggaggagattgggaacctatancttncctgggatatnctggatttagcaaagatnntttttaaaangcaanaancaaaagaagcacagctttatgctgcccaggcacatcttaaactcggagaagttagtgttgaatctgaaaactatgtgcaagctgtngaggtgttncagtcctgccttnacctgcaggnacagtacctggaagccnctnccgtctccttgcagagacccactaccagctgggnttggcttatgggtacactctcagtatgatgaggcattgcacagttcagcaaatctattgaagtnattgagaacagaatggctgtactaac

SEQ ID NO: 617819 - DNA, 982 bp, Homo sapiens
atgctgcccccccgctgtgacgcgcctgagagtgtcctggggccagctccgacacgcggagcagctccccccctctcccgggctgggggcgcacgggttgcctggtgctcttgtggtgcgatggtgagaaaccctgtgtgaatgcccggtccaggaagtgggtcctgcgctgtgagtgttttttggtggcagccccctgcgcacgacagtcgcctccctgaggcgctgaggtgtagctgggtggcttcccctgggatggcttgagtgccgctggtcccggtgatggctcagcagcaacagctgcctgtgtgggcaattgaggggccgatggatggcctaaggcgcccccaggaggtatccatggggccacccgtgtcgccacacacctcctcctgtcaggggtccagggtcctgacaccccattgcgccccagtgcaagggctctgctggctggcaaggaatgtacagctgaccagagaacgagatccgcggtactgtgcctgaaatcccgggagattaatctgagccagcccattcttctggagctggaggcacccctcaagatctgcggtgacatacacggccagttactacgacctttctgcgactattttgagtatgggcggttatccctcccgagagcaactacctcttactgggggactactgtggacaggggcaaggcagtccttgtagaccatctgactgctgctggcctataagatcaagtaccccgagaacttcttactgactccggtgggaaccacgaagtgtggcagcatcaaaccggcatatatggtatctacgatgagttgcaagacaacgctagaaccatcaaactgtggaaaaacttcactgacctgacttcaactgcctgccaatcggtgacataagtggacgagaaagcatcatctgctgcacgagaggcatgaaccaggagctgcaggacaatgacaccagatacggcgcatcatcaggacaa

SEQ ID NO: 617820 - DNA, 192 bp, Homo sapiens
ttgtatataaaataaaccataccctagcaagcaaattattttaatgggtttcaagaattgaattaacttctgtaatggaaattaaaaacaaaggagaaaaaagcaacgtgcagaaaattaattaaaaagagttaggacacagaaacttcgaaatgtccataaaattacaaatcaaaagcaacaaattaaaaa

SEQ ID NO: 617821 - DNA, 425 bp, Homo sapiens
gtgcggtgagggagggccatagtgtgtgcccggtgagggagggcggcgtagtgggtgtgcaggagaggtgggtgactgtcctatgaaaggctcaggaggctcctcattccccgccttactggagaatgcactggacttcctttaatctttggcgcagaagtgcagagagacaaggcggcggtggctgttgtcgccgggtgcagtgaggaagaggccctcggtgggtgcccatggctggccaggaacctgcgctgagcacgagtcaaccggactacgacgtggccagacatggcctcctgcacgtggccgggcatgaccgctttgcaagaccggttgtcacgttcagctgctgccggaatgccaccctcccacgagctgcaccaacagcggctgctggactaatccgccgtacccactgcaccaat

SEQ ID NO: 617822 - DNA, 481 bp, Homo sapiens
agaaagccagatctctagtcttgccctgagtagggatgtgccagccatctctccagtgtgtccgtccacccatctctattccagtgtgcccgtccacccatcgtctatttcatgttcttgttcacccatctccccatgtgcctgtctcacccatctctattccatgtgcccttctatccatctctatttcatgtgcccatccatccatctctatctcatgtgcccatccaaccatcgtctccatgtgtctggtccacccatttctccatgttcccatccaccgatctctatctcatgtggccgttttcccatctctccgtggtgcccgtccacccatccctagttccatgtgcccatctatccatctctattccatgtgggcgtcccacccatctctattccatgtgcccatccacccatctctatttcatgtgcctgtccagccatctctattccatgtgcctgtccacccgtctctatt

SEQ ID NO: 617823 - DNA, 311 bp, Homo sapiens
tctggtggtctcctcccctgccgggcgacgctgcccggcccagtcggcggctggcatgtcgaacagccagttcaaaacgccggggcgcagcagcacggtggtgatggacgggtcgttggcgtagcggcgtcgggccggcgtcaatcgcgggccggccagttccagttcatgcagcgaacggtccgtgtcggcatccacccagtcgccgcggtgcagcaccgtcagcgcgccgagcaggttggcgggaaaacactgcacctcgggcagcgccgggccgcaggcgctcgggcggtgcacggcaatggcatgga

SEQ ID NO: 617824 - DNA, 421 bp, Homo sapiens
  misc_feature (1)..(1): n is a, c, g, or t
naaactcagcaaagatccaaatattgtcatagccaagatggatgccacagccaatgatgtgccttctccatatgaagtcaagggttttcctaccatctacttctcaccagccaacaagaagctaactccaaagaagtatgaaggtggccgtgaattaaatgattttattagctatctacaacgagaagctacaaacccccctataattcaagaagaaaaacctaagaagaagaagaaggcacaagaggacctctaaagcaacagccaaatgcaccactttataaaaggactcttacaccagagaaggcaaaaccagagaggacagaatggatatactctgaatcctgttaaattttctctaaactgtttcttagctgcactgtttgaaaatacaaggaccagtttatgtttgtggttaaaa

SEQ ID NO: 617825 - DNA, 295 bp, Homo sapiens
  misc_feature (1)..(1): n is a, c, g, or t
ntgtcaaggaagacttcttaaaagaggttacagaagatctgggcctacatctgtaatcccagcactttgggaggccaaggtgggtggatcatgaggtcaagaaatcaagaccatcctggccaacatggtgaaatcccgtctctagtaaaaatacaaaaattagctgggcttggtggtgcatgcctgtagttccagctacttgggagactgaggcaggagaattgcttgaacccgggaggtggaggaggttgccactgcactccagcctggtaacagagcaagactctgtctctat

SEQ ID NO: 617826 - DNA, 150 bp, Homo sapiens
cagttctagtctattcgtcggggtcacatgcagtctggccaaggtcgcttgcgtccaaatcagcgatgacagacatatattggaactcagtgggtctgaggttacaggtctccactaacccgtaggtctctttccgatcagtagcgtaga

SEQ ID NO: 617827 - DNA, 812 bp, Homo sapiens
gatcttcgaatgcaaccacgctgtgctcctgctggatgtgaactgccgaaatctgctgtctgtacagaatggtctcagggcaatggctgcagctctacctgtgacttgcggtgacatggtgctggggctgtgctggtccctgcagtgacatcccaccatggcacctttgtctgctgagtatgttgtgtggagctgatttcatgactcatgaatgccgactgttctgagatggaatgattcttacctctttgatctcgacaataaggacggggaggtttacttgcatcgacgctgctggttctacgggaactgtcagcctgttcatcaaccaccactgctgagcccaacctggtgccctgtgcgctgtgttcatggcccaccaggacctgcgggttccccctgtgatctgccttcttcagcaccctgcctgatctgaggcctggctgatgcatgctcgggtttgactatgtgagagcgcttctgggacatcaaaggcaatgctcttcagtctgcctgctgcgtgctccccccaatgtgcctggctactcgatgctgctggcctgtgcccagctgtcatggccagcgcgtgccaggaggcccaggaggacggcttgcctcgacaccagctccgcggctgctgctgacccctatgagacgccgcggcagcggggcgctcgggagccgggactgcggtcgcgattagagacacagaggaaaattcgtgcaccgaaggtctcgggtggccgcgtctggagggagaaaaaggacccggggggtgggcccacacatacaatgggcccggccaccgtgca

SEQ ID NO: 617828 - DNA, 1007 bp, Homo sapiens
gaagtgccgacgggactcttggctgtggtgaagtgtgttgtgtcagcttttgcgtcactcgagtccctgtgtcgctgcttgctaatgtagcccgagtcacgctggtctgtcatctattgtcgcgttacggcggtcggtacggaggcagacaaccaagcgtgtattgtgtgtgtaacctgggacactggcgctggtctagaggagagttagacagtggctttcaagttattcatgtgtcctttatagaagctgtatggattgcgacgaaatcctccaggatttgcctttgtgtaattcgaagatcctagagatgcttgacctatgcagtaccgaggcctggatgtgaaaaggtcattttgttggctccctgagttgagtggttgaactatcgatcgagtgccatgcctcggagatcacgttttgatagaccagtctggccctgatgtccctttgatccaagatgatagattgctatgagttgttggcgacagacagggacgatttattgcttattgattgtctatcgttgaccagccggtcgaagaaggaaggcaggtcacggtctaagatcacattctcgatccttgagtgaatggcgactactgctcgcttccggtggcgtgcatgggaaccaggggaacgaaggttcacacgtcggcattttccttcggaacgatcaagatctatctctctttcgttgatcaagatcagatttgttcagaaagatctaggtctggctctatcacacgggattgcggtatttcaatccccgttgagggtcgaagattcaagaccagtcctttttgaggaacgaagaggaggcggacaaggtcagtattccgttccaataaaacgttccccacagagtccccgaagtgagtgtgtagaggtggtggatccgacacttgggagagattgtgaccacacagagagtgggtgttgaggatagagagaaaacaaagggcgcgactgagagaacaacgcttattggggggagggattacaac

SEQ ID NO: 617829 - DNA, 603 bp, Homo sapiens
gtacgttgacaccagacctcttacttgttccctgtttgatgccatatttctcacactctttccttatacgatgcctcatagccccacccccatatctaggctgagaccttatagccaaagtcaaagcttctatcaccttttctagcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccgagccatcagtcaagctgtcctccctattcatcccatagtccataacccctatccacttctctctctcgtcgctacaaacacacctctaaactgattgactgaaggtgcttcttacattccctaacctgatccaaac

SEQ ID NO: 617830 - DNA, 316 bp, Homo sapiens
tacttggttgggtgaaaccttctatctttactaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagccagttttggtgtttgtgtacaattaaagtaaaaagcagtccacaataatgttttgtaatactg

SEQ ID NO: 617831 - DNA, 304 bp, Homo sapiens
gaccggccagcccactttaaggcgcgcgcaccccaatgctccatcttcactacatgcagccgctacgtttctgccgcattctacacacgcttgtgttttacttccccaaagagagggtgggaagaggaacatttggctatagaaaagttgtctttttctttagaatctgccacggtgatctcatgtatgtgctgccagtgcctagtagtcccgcgttcacaagtactaccagttaaacccacatcggtgaggctgtcgtgtcatatttcatttctcgtcccctctcctctctcagtttcttttt

SEQ ID NO: 617832 - DNA, 343 bp, Homo sapiens
tataaaggatgttgggagcaagtgagaggctccctgtgttctattttattttcatcccagcaggagctacagtatatagtcctattgcaaagagtatggttagtatgctgcttaataacatgatgaaatagtaaaaggattccattaaaggggcaaggagaggtgttaaagattatgtagggtttcacttatcttttttaaaggaggaaggggtttttcttcaggatcagtggtaggagcctttttaatctgggatgattccttccaaaataggagatgcaagtcctccaatggttcacaggtatcaaggctggtctgggtgatcttgggactcctgagctga

SEQ ID NO: 617833 - DNA, 842 bp, Homo sapiens
  misc_feature (160)..(160): n is a, c, g, or t
  misc_feature (311)..(311): n is a, c, g, or t
agcgggggggcgggacaggcgaactcgcgatgagtggtctcggtcaggctctgcggagaagtgggaataacggagaaagggccaagccctgaagaaacaatacagaaactgaaggagactcgagtaagatacttgatcgaaggaataccaggaattttcnggagccagaagattccaaccagcgagctgacaacactacgcccacacgtaatgtcatcggcgagccaacgatatcaatgacgagcgtgctccttcgcagtggctattggcggatgcgaaggaacataggattccgacactagctaggttgnggctacaaatacggtgacaggtgacacttgattcctacacctagggaggtttcatgctgtcgacgagcacattggaagaattgcccactgacctaacgtcctgcaattgtcaacttcggtacgcaataggaatgctgtagcgttggtcaaaagagccatagaacgaaaggcgctcaccgatgaccactgttgggtggaccatctcgacaacggtaagattgaacctagatagacatgataatcacaggaaacatagcagcggaggtggcggaacgacagatcgtctagtatgaccttagttatctagtgcatatgaggcgtttggagatgatgtaggattgaggatagagacttgctgtgagagagctaagaggaaggctggaagcgagtgaggaaattgggccacaggagttgtttaaatggttgggcctgatcataggtagagaagaaccctcaagtcaatttttgtctctaatgtaactttctacgtctatcttggcggcagggacagttcccaatagtggtcgaaga

SEQ ID NO: 617834 - DNA, 265 bp, Homo sapiens
aagggaagggaatggggagaagggaaaagcaaccagtgtttgagcctcaggaggttccccctccccctttgcctatcccctcccctttggttgagccttgagccttgattgggaactgaaaggagttgcagctgttggcatgaaacctccttttccccgttttggggaggtggggaccagcaaataaatcccccccttccttgagctgttggtggactttgaagttcagccaggtcagattttataaaaattaattaaaatttca

SEQ ID NO: 617835 - DNA, 375 bp, Homo sapiens
gcccgaggtttttactaatagtagtgaagttagatgggccaacccatcaaacttatttttatagaagttattgagaataatcttttttaaaaaatatatgccctttagatattgatatagtttgagaaattttattaaagttagccaagggcctaagtttttaatattggccttgagtatttatatattgggcatcaactttgtgggatacgagacccctgtaaaagtggccgatttgttttagcccctttgagaatttcctttatggagggtatgtaagttatttatatccaaggaaatttattttaggtcgttgtttaaaaaaattgtgtgaaatcaggtagttgcaaataaaaaatagtttggggcatgcca

SEQ ID NO: 617836 - DNA, 332 bp, Homo sapiens
atagatgatgatggagacttagagcaaaggaaagttgggaaaaacaggtagcaggtgaggtcagtaacaggcagaagagctgggaacggagacacaaatacagcctcagagagaaagtcatggattactgtatgaatcccacaaccgagttagccacttctctactgatgggttcatatgcagactatctttttaactatgagctatggaatgagatttcagtctatctgcctatgcccgatactagaatcctagttttccctgcctccactcaaaaactgggaagcagaaaatatggggtgagcatttaacccaggaatatctagaaattc

SEQ ID NO: 617837 - DNA, 216 bp, Homo sapiens
ttgctgctgaggtgatctagaggaccccgagtacccactgctgagattacatgcagataccagataccttaacttgtattctttatcatctttggcttggaagtttcctctgttgtcttgctgaatccttcgctttacctccccttcttcaggaggaatctgtgcggatagattggctggacttttcaatggttctgggttgcaggtgggctacgt

SEQ ID NO: 617838 - DNA, 111 bp, Homo sapiens
ctgaaagaaagtttattgggccctagttaaagttttctgaggcagcttgggccaaggtttcccttgcaattttaggccgcccttttgttggggaacaattttttttttaaa

SEQ ID NO: 617839 - DNA, 719 bp, Homo sapiens
agcggggtctgtgctcaggccccggtctttctcagcgtgcgacgtccctacctcggtcgctccgccgcggtggtacgcatccaggccgagaggcccgaccgtagcggacgccgagtggagtgacccgcggcgggggaggaggagatagcaatcgaggaacaatgccagacgtcgagggaaggagtgtgacccagaaatatcctggcgactcagagggcaggtcctgataaagcatcgaaatctcaggaacccgcaccgacgaagacgagaggcggctctcgaggaccggccgcttcctcctgttctattctggtacgaccacgggtctgaactaggaacatcccggttgacagtcgacagggtttgtcccaatgcgtgacgcgaatcaagcactgtggcggaatagaaatctgtcgatttacctagggactggaaaagagaaagcgggttgttaacccatccctgaggccagtcttggcaaaggccaacgggtcaaaggggacacgagtggagctagatagccttgtgggcgggacctagtctgtagaaggaagccagacgttgatcgagcaaaacttgctcgcaccctggaactgtcaggggttgtttgcctactttggaacctttcttgaaccatgacattgtgagcgcggaaatgcttgtgcctatgcatctgggttaattaacccacgctcaagaaaacccgacctggaggaaat

SEQ ID NO: 617840 - DNA, 261 bp, Homo sapiens
gaccttcatcgcttatacttctcaactctttatacttctcaccgcttatacttctcaacgctattatactatactcacatcgctttatatcttactcaaacgtctatactacgtcgtcaatcgcttaatacttctcaacgtctttatacttctcaacgctttatacttcctcctcgcgctatagttcctcgacgctttatacttcctcaactctaaatacttcctcaactcttaatccttcgtgcgctcgctctctactca

SEQ ID NO: 617841 - DNA, 144 bp, Homo sapiens
tggccctgagctcaaagcaaggtctaactccgaaggctccctgatcagcgaccatcttccttctgggccttttatctacacaaaaccaccggttacaggaatagagaaatttggcagcttggctccagagagggtagagaattc

SEQ ID NO: 617842 - DNA, 510 bp, Homo sapiens
aatcctcacatatcatgatggggacccagggagaggtaattgaatcatggaggcagttacccccatgctcttctcatgatagtgagtgagttctcacaagatctgatggttttataaggagcttttccccctttgcttgcgcttctccttcctgccacctcgtgaagaaggtgacttgcttccccttcacattctaccatgcttgaaagtttcctgaggcctccccagctatgatgaactgtgagtcaattaaacctctttcctttataaattacccaagcttggttatgtctttattagcagcatgagaatggactgatacagtaaattggaactgaggtagtggggcgttgctataaggatatctaaaaatgtggaagtgaatttggaactgggtaacaggcagaggttgaacagtttgcagggttcggaagaagacagaaaaatgtgagggaggttgggactttcctagagatttgcagaatggtttttgaggaaaatgcctaatag

SEQ ID NO: 617843 - DNA, 130 bp, Homo sapiens
cttatgcacgcttactcacttcaaccaagctttgcagtgccagagattgaagagttcaaatctgaccaagatgttgatgttggataagagaattctctgctccccacctctaagttgcccgccaatcgaa

SEQ ID NO: 617844 - DNA, 841 bp, Homo sapiens
gaagcacggcgtgagttcgtccctctgcgcactgccccggttttcctcgtcggtccgtgggctgatcacgctcgacacatccgagatgactcgtccagtggaagtttgtgaaacgtggctcagtctccaaccagagaccatttcctcgttccccagggaggagtgcatagcgcggatgcttgatagctgtgtctagccaggactccgagcgtaccgtacttccatgagccagtcgcacacgcgacggtctggatgactgcataggtccagtgcatagcgcgggggaggacgcgcctggcagcggcaggaagtgacgcgctcacttaccccgtcccgcggccgccagccaatctctccccgcgagggcggaggcgccgaaatcaaagcgagagcgcctcggcctctccagctgtccgcgggtcttgctctgttgcctaggctggagtgcagtggttacaagcacggtcactgcagccttgacctcctggggatccaaggtctggctggaggtggtaacattcattaatctttttcaaaaaccagatccttggctggggtgtggttgcccacacctgtcatcccagcacttggggagactgaggcaggaggatcgcttgaacccacgagttgggagaccaggcctgggcaacatagagagattctgtcccctaaaaaacataaatttacacaaaatcaaccaagccctggtgacaccacatctgtggtcccaaaattactccagaaggctgaggtggggccgaaatcccttgagcatgggaaggtgaaggctgcagtgagctgtgatcgcgtcactgcaactccagcctgggtgaacagacca

SEQ ID NO: 617845 - DNA, 682 bp, Homo sapiens
gaagcacggcgtgagttcgtccctctgcgcactgccccggttttcctcgtcggtccgtgggctgatcacgctcgacacatccgagatgactcgtccagtggaagtttgtgaaacgtggctcagtctccaaccagagaccatttcctcgttccccagggaggagtgcatagcgcggatgcttgatagctgtgtctagccaggactccgagcgtaccgtacttccatgagccagtcgcacacgcgacggtctggatgactgcataggtccagtgcatagcgcgggggaggacgcgcctggcagcggcaggaagtgacgcgctcacttaccccgtcccgcggccgccagccaatctctccccgcgagggcggaggcgccgaaatcaaagcgagagcgcctcggcctctccagctgtccgcggcctctgagcccaagtctgcacgtattcatccagatggcctgaagtaactgaagattcacaaaagaagtgaaaatggcctgttcctgccttaactgatgacattccaccattgtgatttgttcctgccccaccttaactgagcgattaaccttgtgaaattccttctcctggctcagaacctcccccactgagcaccttgtgacccccaccccagcctgccagagaacaaccccctttgactgtaattttgctttacctaccca

SEQ ID NO: 617846 - DNA, 734 bp, Homo sapiens
gattggtggaggaggggtggggggccctaatggagaggtgtgggtttggcaatgaaagaagcaacacagatgtcgtccccaaaatgccagttcaagacaccttctccctgcccccctggtagtaacagtcagggcctggtctgtgctcaggtactgggtcccaagtctgggactctgcgtgctgaatgttgccacagtagaggtccctggcttatgtccttatctccctacggggcttgccttggttttcagtcttctctctctttctctcttttttttttttttggccattttggcccttccttgaccccatggtaataaccaattccatatccaaggggaggggggttgctctcagcccattgtgtagaacgatggtggcttataacctgacgtgtctaaaaatttcccagcttaagccttttcctctacatctcattcccttgtcgtgaatcattgtcttcttctcaggccaaagttagccatggtaaggaggctccagggggcagaccctgaaagatcaaaaacggctttctgcaaaagaccctccccgtgttcccaggacaagagttgacgacttgcacggggtgatgtggctcaataggctccagatctgagtaaagaccttgggcttggaagagcgtcccttctcaagtcaaccagagtgaaccttctgaagcttgtgcccagaatattaccgccaagaccaagggaaccctttaaagaagctccca

SEQ ID NO: 617847 - DNA, 301 bp, Homo sapiens
tcgctattcatcggcacctcgcttatcatcggctcctcgctattcttcggcgcctcgcttttcatcggcaccgtcgctattcatcgccctgccgactggtagtcaccggtcctaccatggctgaccacgtggtcacggtgaatcatggttcgtttctgtagacggagcctgcgaaacggctcacacatccctcgtgagcctgagtgcgcgcacattaccctctcccgcacccgagaaggtcgtgacaatgcaatgtgaatatccgactcattccgagagccctattaggtatccatgaagc

SEQ ID NO: 617848 - DNA, 97 bp, Homo sapiens
gctttcctcccccccttaccccgctttttgaaagcctttattttggtgggggttttttcataaaacatttgaaaataaaaggtcttttttcccccca

SEQ ID NO: 617849 - DNA, 390 bp, Homo sapiens
  misc_feature (28)..(28): n is a, c, g, or t
ggcctgaggccaggaggattgccttgtnccccccgaagtttgaagtcccagtcctgagtaaccataacaagacccctgtcctcttaaaaaaaaaaaatggcctgggccgtgggttgtcacgccctgtaatccccagtagtttgggaggcccgaggtgggtggatcacgaggtcaggagtttgagacccagcctgacccaacatggtgaaaccctgtctttactaaaaatacaaaaattagcccaggtgtggtggcgtgtgtctgtaatcccagctactcaggaggctaaggcaggaaaatctcttgaacccaggaggcgaaggttgcagtgagccaagatcatgccactgcactccagcctgggcaacagagcaagactccatctcaaag

SEQ ID NO: 617850 - DNA, 955 bp, Homo sapiens
  misc_feature (522)..(522): n is a, c, g, or t
  misc_feature (532)..(532): n is a, c, g, or t
  misc_feature (647)..(647): n is a, c, g, or t
  misc_feature (650)..(653): n is a, c, g, or t
  misc_feature (656)..(656): n is a, c, g, or t
  misc_feature (659)..(661): n is a, c, g, or t
  misc_feature (664)..(664): n is a, c, g, or t
  misc_feature (668)..(669): n is a, c, g, or t
  misc_feature (677)..(677): n is a, c, g, or t
  misc_feature (679)..(679): n is a, c, g, or t
  misc_feature (687)..(687): n is a, c, g, or t
  misc_feature (689)..(689): n is a, c, g, or t
  misc_feature (726)..(726): n is a, c, g, or t
  misc_feature (729)..(729): n is a, c, g, or t
  misc_feature (739)..(739): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (831)..(831): n is a, c, g, or t
  misc_feature (877)..(877): n is a, c, g, or t
  misc_feature (946)..(946): n is a, c, g, or t
tgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcganttcgcctgcngcctggtccgcttcctcttctatgccaacctgaacggcagcatcctcttcctcacctgcatcagcttccagcgctacctgggcatctgcgacccgctggcaccctggcacaaacntgnnnnccnccnnnctncctnnctagtgtntntagccctntncctccccctcacaaaccactccctccccacacccatnttncctcccacanccatncacccnaancccactctctcctatcaactcaccccccctcccctccccacccactatatcccctatcccatccctctcactctcatnccctttctcctcccctttcctcccctcctcccctcctaatctctcntcccctccaccctctcccccaccatcccacccacacctctcccaaaccacccccctccaaccccccacnatcccctcc

SEQ ID NO: 617851 - DNA, 735 bp, Homo sapiens
tattattcggcgcatgagctggagtcctaggcacagctctaagcctccttattcgagccgagctaggccagccaggcaaccttctaggtaacgaccacatctacaacgttatcgtcacagcccatgcatttgtaataagtcttcttcaggtagtaatacccatcatatatcggaggctttggcaaactgactagttcccctaataatcggtgcccccgatatggcagtttccccgactatagaactagactataaagctgtctgactcattacctcacctctctccgtacgtccttgctctgcatctgcttatagatggaggccggagcgaggaacaggttgaacagtgctacccgtcccttagcagggaactactcccaccctggagacctccgtagaccctaatccatacttctccttagcatccgtagcaggtgtctcctctatcttaggggccatcaattttcatcatcaagcaattatgcaagtataaaactcccctgactcagtaacccaagtatccaaacgccgcctcgtttcgtgctgatccgatccctaatcacagacagtcctagccttctcctatctctcccagatcctagctgctggcatcactatactactaacagaccgaagctcgaacacaccttcttcgaacccgccggaggaggagaccccattctataccaaatctaaaaattaacaaccgggggggcgtggaaagtttccctcgag

SEQ ID NO: 617852 - DNA, 387 bp, Homo sapiens
cccttttcccttttttgccccttccccccaaaggtgccctttagggcgggaaaaggttaatccccccgcctaatccattactcgcctattaaggaaaaaaggaaactgtgaaagggggggacttttgggcagcccggttttttttgccaaaaattatgccctttttccattttttatttaaccggggttttccaaccaaagggaacctttttttttttttttttccggttagggggtttgggttttaccagggaaacttaaccccaggtttttggtaaaagggggttttgcccccttaaatttaaaagccgcccttttaaaattttcctaaccatggtttttccggattggttggttaatttttaaaaaagtcctggtccgggtgga

SEQ ID NO: 617853 - DNA, 1070 bp, Homo sapiens
gatgcagctgacctgtagcacgcctagaggtggcccgaatgcttactcgtagatgcggctggccctatccgctgatgatgtctagagattcccaggtcccgcgttaaggaaggaacggcaaaaacacaggcagctctaagtgtacgacgagggaggtctcatacggcgtgagagtgaagcccaggacggagatactccgctataccgcatgctcgaagatgggagtaacgacaatatatcacatctagtcgcccaaggtctaggaaactgtcatgatagtggcgaattctctggtcattcactagataaccctccagcctgccctgtacgtacacattatagattgcatcctcatgctcttctgagcccatcctctgatgctaccgcatacggggactaacacgtgatagaagtgcctaccaaactacatcaccaagtcataaatgtcaagggtaacttagtattactgatgaagaagcaccaagaggatttacaacctaagtgatctagcggcacaaagaggcctggacatacatctaactctggcttcccgtggaaacccgtgcgcatgggattcctaataaccttggatccatccgttgggcaccgtttacgcgacataagcctggccatggtggagaaagtatgagcacggtggccagttgaaatgagcctaaccacgtgctagagcccacaaggtggaacccatatatatggagccttgataaagaggaatccctgtataaacaatagttaaggtgacgatccataatcacctctgaccccttaggtacgataaaagatcccgtaccgcaaagcactatatgtgctgactaagcgggacataccactaacattcagcactgaaacgtccacatgacacccaagatcgtagcaagtgcattgcacaactatcaagcggcacaagggaccacacaacgagttctacgcataccgcatatgatagacgaaacaaaactcaaatacgcgcagacgacaaagtatacatctgatgtgcgttcagacatcgcaggcatgagacatgcccatcacagcgaacgaacaaacac

SEQ ID NO: 617854 - DNA, 227 bp, Homo sapiens
attagcaagatggaaaatggcacactcatatgtggaaaataatatgggagctcctcgaaaagttaaacatgaagcccccatatgacccagcaataccactcctaggtatatatccaagaagaaagaaaaacgtgctcccacataaaaacgtgtatatgaatctacacaggcagcataattttgtaacatgccaacagggtgaacacaacccttgtcgaacgttctca

SEQ ID NO: 617855 - DNA, 1053 bp, Homo sapiens
ggagaaatcaagaggacaggtgcctccgggtggagagtggtctattaacgagggttacatgatatccacttgccttccagcaatacatggtagtgccaagttctttagcagaccaagatctaaagatcttgacccatgctttatcgttgggagaaggatgccacgtctggtgctggagccgactctaacggcatgtgcctcttgtgcgaatggccctcatcgaagagacgatgcatgctagcgagagcgaagattgaccacgaggatcttggtagtcgcaatcacactaaaagtcacccacgagagaagtgatgtttacaaatcagatttggataagagcttgccggtacatattcaagaagtacaggcagaatgtcgtaagagacttgaagcagccttcatgtggtcagagtgaggccctttccgatggaacatcgtgataggaagaagactgggttgatacttcaccgtggagaaaatccgctcgattgtgtctcgtagactactcgtatggaggccattgccatgcaagccagtacacgctggaaccttcgtcactagcgatagctactacagacgcgacccattgtgcctcataatacttcgtaacagaagcagcgaggaacgtgacagaccatgttagcaagactaggggtgaaatgcctcgcagcgcggaagcgaaagccacacctgcgtgcgaaccaggtagaccaacacggcgcccaattccctggaacatgaaccacgacgtgcgatagagcaccaagagcacgcatgtgggaaggagcacgggacaacccagctgtcaccatagaagtgccgagactcatagagtgagagcccaatcgacacaggaaccctcactacagatactactactcacgaagcacctgacactacccagacacaaagtcagacgctaccaaacactgcctactgcaagggaccggcacgaagggctcagagaaaacgactacgccctccatacacagacacacaaaattccgccgatctcatcttagccccgcaccacaggaacccaacactgccaaa

SEQ ID NO: 617856 - DNA, 178 bp, Homo sapiens
gtagatttcataagagatgcagtctcctcttgccacccggaaccgcacatcagtggatttcaaagacgactgactacaagcggcaccagctgacacggacaattagtgagattaaacctcccaacctcttcccactggccccccaggaaattacacactgccggaagaagaaaatgat

SEQ ID NO: 617857 - DNA, 752 bp, Homo sapiens
cgtctatgggacggttccctggttacgcccgggttttagacccattagtgtgctctctccacagacggcccgatctttgtcggacccgcccaatctgggtccgcacactaacgaggttccattgcggtcccgacatatcccgcggctctgcctatatcagcgcggggggccccgcgcggatgtgtttctccacccatcaccggggttcctctggtgcctttctcccaaatatgccgaaggttcttcgggaacaaccaagtgccacccgcgcgctcctcccagagggtttacttccaggggacaacccaccacaaggggcaatgcccccgcccaaggccccccaccaaaaatatcggggcacaatggtgtcccgaacacacacataggctcctttcggcggtccccagaacacgcgtggcgttgcaagccgccgcaccagcactcgcccaaaatttggcgggggctcgaacacgcccgcttacaagcagaactgctcggctggcccctgtccgccgagccacctgcgtcgattccacccccgacaagcggttaccactcaactgtcgagccaatggacgccgccccaattggggtggagagcaagaaccccccgtcgccgtaaagagagccgcgcggggcggcaccccgcgggtcacagcctggtgctccaccaggggacaccccccccccgtttttttggccccccccccccccaccttttgggggggaaaaaaaacgggtttaaaaaccca

SEQ ID NO: 617858 - DNA, 729 bp, Homo sapiens
  misc_feature (76)..(76): n is a, c, g, or t
  misc_feature (84)..(85): n is a, c, g, or t
  misc_feature (121)..(121): n is a, c, g, or t
  misc_feature (157)..(157): n is a, c, g, or t
  misc_feature (184)..(184): n is a, c, g, or t
  misc_feature (228)..(228): n is a, c, g, or t
  misc_feature (232)..(232): n is a, c, g, or t
tggtcttggtacaaaattttattaaagggtctttagaagagcaacatccagactccaaaatacagctgccaagganacccgttnntatgctggggggacgggcgggggcatggcaggcggntctggtttcccacccttctgttctgaaagtgggggntggggggcagtatctcatcttggggtnccacaaggctcacggtggtcaggcaggggcttctaagggccaantctntaccagtggggctcccagggcagcagtgatcttcaccttgagtgcccagaacacccgtgtctgagcaacacggtggcgcacagcagttgtcaacgtagtgagtaaacaggggtcctccgcgggggactcatcagggcgcatccagcaaactctcagggattatagcccgtcggtcctcgggagttcccagacaccaaaacctcgcagcctggggccccactctccatggatgaaccggagcacaccatagcagggccctccggacagaaagccctcctaggagttggtaccgcagagactctgccggggccaagggcacacagacctctaggggccaccttttcagcataaagctctacatggccctctggaaagccaaacctcttcttgaactacagcagtcagttcccgaatccgcgggccttctcaccaagacacatctgtgttctggtggtacgataaggatctggactggtggttgtaatcgaacctcagtc

SEQ ID NO: 617859 - DNA, 113 bp, Homo sapiens
cagccagtcgcagggggctctgctgagggggcaggcggaaggtggaggaaaccgcagataagttggggcctcttggaaagatagagattaatacaactacttaaaaatatata

SEQ ID NO: 617860 - DNA, 295 bp, Homo sapiens
  misc_feature (64)..(65): n is a, c, g, or t
ggggggggccccccctttgttttggggggggaggagggaggccccccccccccccccccgtttnnaggggggtttttcccccccccggggtttttttaaaaaaggcccccccccggggggggggcccccccccacgggtttggtttttaacccaagtgggcccccccggggctggtggggggtttccccccccctccccccttttttttggccccggggtttccttggccccccctggcccccccccctttttggggggggggccggggttttttttttgggggttttggttggc

SEQ ID NO: 617861 - DNA, 269 bp, Homo sapiens
tgacccacacagggctctccagtgatgggaaccagtggttagtggtttcaaaggcccaggtgacaccctccacagacctaatggggtgtcctaaatgtgcgctcccccctgtattccccttcccagggcagcccctgcccagcacaaaagcccaggaccggctgtgctctgccacgcctggggcagtgacttctgagtttaggatctgtatattctaagtccccagttctccgtggctctcctttctgaaataaaggattgaaaacggt

SEQ ID NO: 617862 - DNA, 260 bp, Homo sapiens
cggaccatttgggtgagcatcgggatcggcatgggcgatgcggtgatgccggcaacggcgagaacggtgagtgcacggaggctgaagcgaacggcttgaagcaccctgacctcgattcatcttgaaacggaaaatgcgatcttgagcgtggtagccccacgctcccggtttgagaagggggaaacagttctttgcccgcctcatacggttcaaggccattgaaatgtgtcaatccttgggcttagggatggctcaccgca

SEQ ID NO: 617863 - DNA, 328 bp, Homo sapiens
tccccgcctcacccggaaatttgcccacagaaccctttaaatccccttgtaaatttaactcgaagtccaaagaggaacggctctttggacactaggaaaaaaccttgcagagagagtaaaaaatttaacaccctagcgataacagcgcactcctattctagaggccatatcaacaataggacttacgacctcaatgttggattaggacatcccgatgctgcagccgctattaaaggttcgcttgttcaacgattaaagtcctacgttatctgagttcagaccgaagtaatccaggtcggattctatctactaaaaattcctccctgta

SEQ ID NO: 617864 - DNA, 929 bp, Homo sapiens
tgctgctatcgtttaatatagtttaacggatgatgaacagtgactcgacggctgcttcatcgtcagtatgtgagctctaatctggttccgagttacgagaatgaccattgtaggcttaccatgtgcgaagacggggagagtgagcctgagagtatgtgagccagtcgtccaggatggcgtgcgagtggagacagtacgtacatagcctgctctgcagacttagtctcgtgtgctcgttctagttcgaatacctgaggttgctcagtcgctgcatgcggggtttccctagcggcgaatccgtgttaccctacatagcaccgaggtccacctgatccactcctgttcagcgcgagtacgagagatgcgaatgaggtggccagcgcagatggatacaaggaagcacataaactgacgtatgagcgcggtagcgtacgggagggggcttaagattcgtatacgaacgtgccggtgactatactatacacgctcgctataatattttttcctaagcataatcagggacgatccctcgaagcacctcccttgtagtaaggatttgaactaaatctggaggatgaggtgaaatcactctgatctgaggcaccgcacaagttgccgtgtcattgagttacatcgacatatacgtcgttgttagatcgatgatgcgtagtgggccacgaattgagaagttttgaaaaaatagatggggaatgaccacttggagtgtcttgaaacctagaacacaatattatacactgttacgaactgaaacgggtgggtataatctggcagggtctagatgcgtcatggaagattttgttgaggacgaaaggccaagcaagtggtcaatagcgggatctgtccttacgaattaagttgtgacgtagcaccatgatttaggtttataagggcccagtatttgaactcta

SEQ ID NO: 617865 - DNA, 301 bp, Homo sapiens
tgaccctaaatatgctgtctcaccatggtgcgctgggatatgtctgaattttgtctacgatggcctctggtatgacttttgtcttacccgaccagataactcccaagaatttggcagacaacccaggcccttgcaaccttgtgattcatttgacagcccaacctacatgctgccaacatgttgttgcaaagaggggcaccacatgcttctaaaatactgcagtgagaatacagaggttaacataattatcatcacatgtaattggaatatggctggatcccacttatggaaaatttccatg

SEQ ID NO: 617866 - DNA, 866 bp, Homo sapiens
gcacctggcaatgcctagctaatttttaaattttatgtagagacagggtcttcctatgttgcccaggtgtcttgaaactcctgagctcaagcgatccttctgcttggcctcccaaagtgtcgagattacaggcatgagttctcattctttagaaccattgtgatgtagtgtgtacagtccacagacatttatcgagtgaggtcttgctcttgttgccccatctgagttgcagggtgtacaatcaatagctctctgcagtttgaacctcctgggctcaaggtatcctcccgtctcagcctcccaagtagctgggatggagggtacaccatcacgctgaccatttgatgtcagttttatcttgtgccatccagatatgggacgcagtttgacagttactctcaggcttcatctctcttcactcatgtaagctttttttctttccaaacaatttctactgggaattcacaccatcacctaaccactagagaatacgttacttcatgattccaacacctagtttcaacaaagtctcctcccatttctctgtgtcatacacgtcgctccttccctccatagtcaatgtattcactccatccatttatcacttgttgaacaaagtttgctttggtagcaagtactgtttgacggggagctcagtaactggattttggctccgggttcagcaatatcctagccagttcccgcttggtggatatgaggtttgaatatgctggtcattggggtgggaccgatacacatgcatggtcacttgacagttggctgacaatgatgggatgatagcagtactgtagggcattaaagaaagcggagtaataaagagaaaggaggcccgacaaaacctcgtg

SEQ ID NO: 617867 - DNA, 124 bp, Homo sapiens
tccagtcagccacacagcagcctgtaactgctgacaagcagcaagctcatgaacctgtctctcctcgaagtcttcagcgcggaggagcgggagaagtccatcacccgggcccgcccttgacttg

SEQ ID NO: 617868 - DNA, 432 bp, Homo sapiens
  misc_feature (188)..(188): n is a, c, g, or t
  misc_feature (191)..(191): n is a, c, g, or t
  misc_feature (196)..(196): n is a, c, g, or t
  misc_feature (200)..(200): n is a, c, g, or t
  misc_feature (324)..(324): n is a, c, g, or t
  misc_feature (337)..(337): n is a, c, g, or t
  misc_feature (387)..(387): n is a, c, g, or t
  misc_feature (408)..(408): n is a, c, g, or t
  misc_feature (429)..(429): n is a, c, g, or t
ctgtctcagggtatgtatctgcctctgcctgcatcagcactaactatacatagtttatttcattgtggctgtattttataatgtccagtggttctaggctttgggatagaggctcagccgaactgagaggagaatgactgtgattagcttgatggaatcttccttggcccttgtgaaccttgagcagnacngggtnaccnactaagaatttcaggcttttaccagggctcaggagactaattcattgtttcctaatcttctcacttctcttaagccttaagtgaagaattgaaaaatgcattatccagatttccctgatgtgangttctggggggtntatgtatgtaaagtggttgaaggaacaagctggctcaaagctctggattngaggagattcacgatggtaanttgtccaacataaattggggnaac

SEQ ID NO: 617869 - DNA, 232 bp, Homo sapiens
ttcaaatttgtctggttaaaaaataggtggtatatatttaggccaagaatattgccaaatacattaagcttcatgcacttaaagaagtatttttagaataacaatttgcatccttacctagtgaaacttttttagaaatatttttcactttaagtcatgtatgtttctctttgattatctgcatgttatgtttaataagctactagcaaaattttccatagcaaatggccca

SEQ ID NO: 617870 - DNA, 172 bp, Homo sapiens
agaaaaatttttttcccatgcaagggaagggggggcatggtctttttataaaacctttcagaatgtaaggaataaaccatttttaccccccttaataaaaccttttttaataaatgtttttggacctttgaatgaatttgaattaataaatgtaattgaaggtcctgggcca

SEQ ID NO: 617871 - DNA, 355 bp, Homo sapiens
  misc_feature (28)..(28): n is a, c, g, or t
  misc_feature (91)..(91): n is a, c, g, or t
  misc_feature (164)..(164): n is a, c, g, or t
ttttctatttgattggttagagctcttngtatattaataacatacgtttattttttcatataagtacaaagtatttttttatcccagtgtntcactgttcttctgtttatcagatcctggctccaaagcagtgcaacatccttctcagggacacagcattttanatcttacaaagcccctcatttcccatctgtcatttatgtctcaggacatccacatgaggcaagctgatgtatttttcagtaaagaaggagactttattgaccaggcagtgcaacatccttctcagggacacagcatttcagtctgtacaaaccactaattccttctgtgcccttaggcaagtcactcgccc

SEQ ID NO: 617872 - DNA, 875 bp, Homo sapiens
  misc_feature (1)..(1): n is a, c, g, or t
  misc_feature (41)..(41): n is a, c, g, or t
ncaacagagagttattaaaggcatggtcgatgtgtgttgtncgcgtccgactcattcaatagttggcactgcttgcctgtgccctagtgaaacgggtgcccttttatcattacaacaagggtgtttttccttcataggaaaactgtgtgtcccggtccctcttcacgtgggggtgcccccccccgcgtttgtatgtgcaaggctacccccttggatcttggcagcctgcagcagtctttaacggggcgggcaaatgagtttccgaaccggggtcgggcatctgagcaaggcccgtttcttggtagacgcgtttattttctccagatgccaaagggttctggatcaaatgctctctatgaaatagtgtttttacccctcgcagcgcgaaacaatgggaaaaatttaggcttcagatgccatcaataatgtcccgccactcttcccgttcggttcaaatctccaaccgtcacccattatgggcagattacgccatagacgctctgtgctagaccctagtgcggagaatgctcccataatctgctacccgctggcgatccccaaaaggtgtgcaccaaagcgtccggtcaccaggttgtgcaatagccgaccttcgtgactacaccctttcgctcggtgcatcgaaccccctgcagaaggggtgtccgggcactctttcagcccccgcccccccatagtttagttttagctccaacgacctagaccgcgccactgtcaccttgtaggggctgttcgccgtgatcacccaggcaaggctgaacttcccagcaggattggcatgtacagtagacatgtggaacccatctgcccccggcggttctaaaaccaaaggcaaaaacggatttcccaacaaaaca

SEQ ID NO: 617873 - DNA, 694 bp, Homo sapiens
  misc_feature (161)..(161): n is a, c, g, or t
gtctgtctacacgaatatcgtatatgtgcaacagagatcacaatactgcaatacttgtagtctttagtgagtgcatacagatcagcacggaagcggctgcatgacagacactagccagaaaggacgacaccattgcagtctaagtagagtgaggcttagantagctctggcgtatgccagtcgtgactgcaatatagtggctgacatcgatcggtgcttggcaataccgttcacgattgagagctcaacacgttgactctatcgagagcaccaccatgtgaaaaggtatacgtcacaagtagagccattacagagcttggagaaagatatcctatagtatagattacccacaaaggatactatactacgggaaatcaattcgtcgataaccagccgattcgagaggattcagatagctaatatataatagggaaacttatccaaatcaaggtaggacaaaaattggctcgaggtttgtcacaggcgctttgtgtacgccacgtcaacatgaccaacgcaaaatgtggcgacctctttctccgttcacacagcggaggactgactggccccacgccagcgggcgatagacacttgtaccaatgaccacgaagggacacagcgtgccagaaacgaacatgtaaagcctcaaaccatggcgaaaagccctgtacaacacattgaagtggatactgta

SEQ ID NO: 617874 - DNA, 130 bp, Homo sapiens
tgatatctctgcttccaaggggggatagtgggcatgacactggccattgctcggagatctggctcccatagtgtatccgggtgatgaccattgcgcccaggtctgtttggcaccgccacatgactgagca

SEQ ID NO: 617875 - DNA, 328 bp, Homo sapiens
ctcggcccggtcagtacggatgtgggtgagattcccaggtcactggagttgtgtacctaggaggattatggctgcctctgctgagtcatgcaggttgtcagggaagtgggggaaaaccggcagtcacaggtctcatccagatcccatgcaaacggaagggctggtctcactctaatcatgcctcctctaaccgccccaagtctgtttccaggcaaagggcaagactggcttgaaaacttgcctgaggctttctgcctcccagctgtgaaagaaaagggctttagtttttcccctgcatgtgaaatctgcatgctggattcacggcccg

SEQ ID NO: 617876 - DNA, 115 bp, Homo sapiens
ctcaaatggggagatagttggtattaggattagggagatagttggtattaggattaggattgttgtgaagtatagtaccaactatctccctaattgaaaacaaaatactcaaatg

SEQ ID NO: 617877 - DNA, 84 bp, Homo sapiens
tttcaggagtactcacataattacccgccggagtctgtaaatacacatttattttatttctttttttattccatatattaatga

SEQ ID NO: 617878 - DNA, 309 bp, Homo sapiens
atgagatattgtgtgggtgtgccagttgcaggtaggcacatggattggacttagtttccttaaacatctaacaagtaggccgtttttgagcagcatgtccatgtttaagatgcttcctcatgcttattaaaagcattctctgtgacttagtctcacctctatataaatctgaccaaagagaaattcatgtaaccatcccacatactcgttttgggtttgcacaaccaaattattattttttttttaaaattttaaggcaaaaggtttatttaaaccaggaatatgttgaggagcaaatgtatctaggga

SEQ ID NO: 617879 - DNA, 152 bp, Homo sapiens
tgatttaatctggtgcaaaccacctcttgtggttttcatctggatatgtgtgtcaaccgttacaactagtaagttttaaaccatctgttaaaattagcactttatgtaacatttggctgtaagcacaccattaaaaaggatgtaggtattta

SEQ ID NO: 617880 - DNA, 1471 bp, Homo sapiens
gcccctccccccgtgcgccgttccgcctgcgccgcgctcgctcccagtttcacgctcgtgctaggcttgcgccgccgtcgtctctcttcagtcgccatcatgattatctaccggggacctcgaagttcagccaccatgcaacatgttctcgcggaccatctaccaagatccgtcgagatcagcggacgcgcgtatgtacctggagtgtgagtagcgcgaagaatggatctatgtagcgcacatgtaagtgtaacgattgtatagacatcgactctatcgtgtggaaaatgcttatccgtctgtaatggctgccgcacagtgacgagagtacccagaaaatgcactcaggataattcatctgtggtgtcgcactactccgttcactgaatccaatgcatctctgacggagtataatcaacgtttgcaacaaaagacgaaaagcccctatgaccgaaagctagccagttcacccagagtttacccatggacacattcagattcgacatagagtgcgagaaagctatgtaaacgaaaagcgagacaaaccccaggaaaccgtagcttatgataccctgttgtcatggcacaagggggaggcttggcccaccgacaccaaccattccagctcacgattccctatgcccttcaactggtccaaaagaacttaccaagttctttcttctcccacttgggtgcaaagaaagcgacttggactgttcccagggacttgcgaccagttgtgctgttgccctaccttacttctcgagcacttagctccgctctgtatgcgcaacttgggcttggtagcacccgccccagattattacttggacttttcttgccttgtctagaggtgacctgcgcttccaatacacacccttgtgggcaccccccaacgttggtttccaccctgggatattttgggtcctatcctgactttactctttggggtagtccctttataccgaaaactgtcggtttcgcttcccattggcaatcgtagcatcggggtcattgccgtattgggtacccttgcgctatacacacacatttcaaagcacgcggagattgtcattggcagccatagtcggggccacctttgggttcgttaccctttctttcgcaagaacgtgcttctcccccttttgtgtgtttgcgccacttggtcctaaaatgaacctccttaagcaagggttgagacctttggacacttccccctgggaaccgaatctcatagagaaaccaaattggatcctatgtggaatacgaaccagaagttatctccccttattcaatggcaagtttttcaccttggacctatctctggtagatagaaaatgaaccccttatcaacgcataaagtttcacaagttttaaagcagggaacattaccatggagattcccaggaacattgttggtggcctagagacacacaaaagggggttatagtcacttttaccttggataatc

SEQ ID NO: 617881 - DNA, 1311 bp, Homo sapiens
gaggagtcgtagcggtcgaggcttttgcggctccggcgtgccggacaagtatgttatgcataaaagtggaataatttacatgataaatgaaactggccaacttctttcacgaggacgaacgtactaaaacctttataaaaatctgctgtatcttggacgagactatccaacaaggagcagactattttaaacacagccgtctcgcagcacccattttccttcaacaccacacacaggatgtcgaagcaatcgcagaagacagatcaacagaacttcatccgcaaccagggctgcacatctgtcatgcacagacggccatacgaaaggcctactgataacacttcgccattagcgacacacttccacgacgcctactgcaaccacccaaccggcctactagagtcccacgaattagccacacccacacacaccctcacactctgactcccacttaacataccttcacactatacaaccccgtactacaccgctgcgccacgtctgcgacccactgggtacttaccccaagaactagtcccggacaacacttaccctatgctacaccgttctacccaccattggggaacctgacttattccacccttgctcaggcggctacacacaaaaataccccccaatgccagcgccatcggccccccgataccagtgcaagcaccatcagacgcacatagcggttatccccacaagagcgtatccttgtgtcccccaaccacccgacggcacagcaacaaagcgcacctctatgcgtcagaacaccgttataacaactcggactacaacagtacgtactggaacgccacaccagacaacacatatcgcccacaccctctccacacgctatagcttcgacgacaacaccgacatgccacacctaataccacctatactcatcaaacgcccacctcccaacactctatctacttgtcgaacacaaactttacaacaacaactatactattataataatctcataagcagatattactaaaattccagcttccacatataacaaactcttaaaaacactaacgacaacaccataacatgacgacgacacacaatcatatcaatatcgaaatacacatcaacccatctcaacgattaatcccccatcacccaacttatcttacataataacactggcgaacaaacatgatgaaacacacacacacttgacacacatatcttcaccaaccaagaaccaactacatgatattaataataataaagcaccaagaaaccacactctacacagatcacctctctctcaccacgaaaccgatcgaacat

SEQ ID NO: 617882 - DNA, 1046 bp, Homo sapiens
tatagcaccatatcgtcaggcgcgcggggcccaggtaggctaagtgaacatggtcataggctgttatcctaggagcatcacgtggtccatggactcagtgacttggagtctctgcgacctacatcaacacaaatgccacaggacggccagagcggagcgtcgtgagacacatagtcccagatggcagtacgtgagggtcctagagagtggtatctagtcatctaggtagtccgaggacgcagctcggaagatcagaattacgccctcggcggccgagcgcacggacggagaaaccgaagaaagacacccaaggaaaccaaaaaagcaaaagaaaaaagagaacaaaaaagggagaaaaagagaagaaaagaagacaaaagcgaaagaagaacaaaacgacaaagaacgacggagaggggagggaaaaacgacaggagacaagagaaaaacggcagaggggaggcaaaagaggacgaggagagcagacgacagggacacacgacggcaagcagaaagggcaggacggaagaacagaggaccacgacagacgacgacgggacaagagcagaccgaagcaggaaggcacaagcggcgagacaaaaggcaacaggcacgacaaagacaagacccaaggcacaggcaaaagagaagaggcaagagaaagcagagtgacacacgagggggaagcagatacgccggacacacaacggagacagaggacgacgggacgacgagtagagaagaggcgcgcaccgacagcgcaagcacaagaaaagagcgagaagaagaagcaaagcacggagcagcagacagcgagcaacggagaagaaagcagaggaagacagagatacgaagtacgagagacgaagagaagaggcgaaaagggagaagcagacgcgggaggcacgcgacaacacagagaaacagggaagacgagaacattgagcacagagagaacgagaaggaaggacagacaaagagcaacgagcagaagggccggacagccacgacgagcgacagggtcaagcgccgacgacacagacagc

SEQ ID NO: 617883 - DNA, 229 bp, Homo sapiens
ggttttgggctccctgcccaaaaacctggggggttttttgggccccccctaaaaaaaaaccaagggcccgggtcccagggccctgggtttgcttaaccccccccccccccaggggggggggggtggggccaagcacccgctccccttctttggccccccccccaggtggggggcccccctttttgccccccccttttttccccggtaaaggggccttttgggcccccca

SEQ ID NO: 617884 - DNA, 209 bp, Homo sapiens
  misc_feature (77)..(77): n is a, c, g, or t
gaaagcgcggggcagctttcagagctgggtgtgattttaatagcttctttctggcttcaaatttttattaaccctantttctttctttttttcttaagggtttatgccctttttataaagctccttttctgttgttctagtgaaagtttaggagagattagaagatactagtgttcaagccaccatcttttaccagagtggctgtcttg

SEQ ID NO: 617885 - DNA, 107 bp, Homo sapiens
gcccagtcagtttctttggttctcatgcagtgcagtgcctcagacctaaccatttgttccgtgctggcttgaaagggtctgcctccctcccagtgcttcaagtcctc

SEQ ID NO: 617886 - DNA, 316 bp, Homo sapiens
ctgtggtttagagccctctcgggggaggtgactcctttttattttattttttttgagatggaatctagctctgacgcccagcctgaagtgcagtcgtgtgtttcatgcgcgcccgtgtgaagagaccaccaaacaggctttgtgtgagcaacatggctgtttatttcacctgggtgcaggcgggctgagtccgaaaagagagtcagcaaagggtggtggattatcattagttcttacaggttttgggatagggggtgaagagccatgttttgcaggcaggggtgtatctcacaaagtacattctcaagggtgggga

SEQ ID NO: 617887 - DNA, 473 bp, Homo sapiens
  misc_feature (402)..(402): n is a, c, g, or t
  misc_feature (435)..(435): n is a, c, g, or t
  misc_feature (465)..(465): n is a, c, g, or t
acaactgtcttgttacaaatgtttggtccttgcttctttaacctcttagtaaagtttgtgtattctagattaccacagttccagagacaatgctggcacaaggcttccagccattcctgtccactgacacggagaatgaaatcgtcctgcctctgggctccttagatcaggtatccagagatttttactcctccagtgccaggcagggctacgtccataaactcagcaggaagtagttacggaaaacagatctccgcccttctgcagcccccttaagattaaggaggagtatctaatctctggaagggggaatgaggtagggaggtggggactcaacttctgggaagtgggggctcagggcacttcaggaccaaacttgaggcactagcttaaattagggtnccgggggcagatgcttagttttcccttaggggncacaccgacccgttgttcaagttcagtttnaccttggg

SEQ ID NO: 617888 - DNA, 964 bp, Homo sapiens
gatcgcctacttggagaccactcgcgaatgaagttggcattttcctctgtgtcttgagcccagtcttcttctcgtctccgcatgcccaggacttcccgggcactagtgatacgcaagggagccgctcctcgttccttgttcttggagcagcccaagatcctggatactcgcaagagggctttgacacggtgaccgtgaagtgtgcaggcactcgtaacgggttcccgcagcttaactcgaacgaccggtagagtacgcaagttaactagcacacagcattccgaccgccggcattgtcgctatggcggcgaagttcccccaggattcctggccgaggccatccaagcgtttactttgggattacccagcgatgggtaatcattgtgcttggagctgtactggaatgcattgctccaccagacctgtcatgaaccttcgtctgagtgtgcgatgcgtcgagggtttacctagcaatgcgcactgagaaattccgaccacgaaatttattcagaggaacctatcattgtattccacacggaggtgacccccaacgagggacaaggtcgaaggttggtcgcagtctagtctatgagcagacaagtttgcaaggatgacccttcattccagatcttgagaattccatcggaggggctggaagtatctcgtcaatggcgcaatgcggggccaagatagccaattggtcagagcagttctatttgtgacccttcgtccccatccagtggctttgcaccggcaaaaccaccatcgcgatctattggggtccggagttgttgttcatgggccataggcactgggtggaattcgacagtttgcgaatgtggtagcaaaccgaactacccagggacccgtccctgttggaacacaccgtgaacgattcattacggcataacccttctgaggtacactttgcatacctctgagagcagtcttctggggatgcccc

SEQ ID NO: 617889 - DNA, 1089 bp, Homo sapiens
  misc_feature (583)..(583): n is a, c, g, or t
gtgagaacccacggcaggggaggaacgaaactccgatgaagtcagagccccttacccggcgcgacggacaggtccccccaacatggactgtctctgtatagtgacaaccaagaagataccgcataccaatgagtgaaagacatcggccccgctcgtggtagtcagcagcccgggcacctaccgtcccacaaccagagccatattcatccccacaggtgcattgtcgaatcatcaggattacgcgcgtagaagtccccaaggactaatgatgattgcaagtgtgacccgggacctgaagtggtgagtagtggaatatcgaggagaacatcaacatttagtgaacaagggagtaagctgctagcgtcttggaggcgttgcaggcaatcggctaagtgtggtcatctagtagcaaatcccagcagcatccggatggagcgagccccatgccatgtttcagtcaccagagatcgattcctggctgtggctagcggcccagggtatgtgggccggcgtcatggggtcatgcggacttagtgcatccgtgctttgctagaattgacatgtggaccagtgcgctgacggntgatgccatgtccagcgggcggctgtgtaaaggccctcagagagagggcagggcttccactcgttcggtgctcctatgtcgagtgcggccgagaaggccctccggctgaatgaagggtcattgggaaggatcaaagctcatcaagggggcctaacacggtcgtctgggctttgagcactctgcacgggggggcgctagcggaaaccagtcacaatcccaaggagtactacactagcatcgtatgttgtacaccaagatcatcgaaagggggtgcctgcccaccacggatggggacgtttgcatgagttggagacaatagagtccatggggggattcaaacagatgctggagggctaagaaggagcgataatgcatgtgaaccaatggctggtgggtaagccgccttgaacgaaccgccgttaatgaatggtagtctagccgtaaaagggtgtgccaaaggccagaaaattgaccatacctgcattgacaggattatgtctccacca

SEQ ID NO: 617890 - DNA, 244 bp, Homo sapiens
aaggagtctggagatacatctctctccaagttactatcttgtgttcttctaactcatagatctgtaccaaggttgattaatagtaacggtgcagggatattgatgagatcagtgatggtcagcatgcccacaatactttgcttcttacgtatcccataaaggggcagctcgtacaccgttagttcaccaaagcaataaaagctttcttcacctgcaggcacgtatcagatccgagctaatttgg

SEQ ID NO: 617891 - DNA, 718 bp, Homo sapiens
gcctattcctgcgacgattgtctggggagttcgttgtcaggctgtcctgggctgctctggggaatgctcagagcgtgacatgcgactaacatccccttggcgacatcataggtctggactggcaccatctgcgaactgctggacttcgatgtgtgttttgcctcttccttggctatgaatcgtgtgagcttcacccagaggcctgctctcctcacacattgtcgctggtttgggcgcttaatgatcggagggagacacctctctcatagacggcacggtgcccacctttcaagggaagtctcccatgcatgggctggatgccgggcatgagctgctgtaaactatcttgtggctgtgctgcttgagtgacgtctgcctgtctgtgtgggttgccaagtggcttgtgtagaaactgtagttctgagcccccttttctggactaccaactgatgtcctgtgaatgtatcgctacattgtgagccagttccctgcctagcacagggccatgtcttaggtgcagctgtgccacgggtcagcagagccacagtcgccagaacacaagctctcggtgtctcagggccaccatccgcaccacctcgggctgaccccaccgtcctccatggacagtgtgagccaccgggccgtgcatcctgctcagtgtggcgtcaggtgtcggggctgagccccttgagctgaaaaccgcgaaggacagtgaccc

SEQ ID NO: 617892 - DNA, 112 bp, Homo sapiens
caggatacctgggcaagctgggtcttactctataatttcagctggtcgtcccaccccacttcttccaccccactttcttccttcaccaacattgcaagttctttcctatccc

SEQ ID NO: 617893 - DNA, 329 bp, Homo sapiens
ctggtgtgtatgattgtcttaaaattttttaatagatatggccgagcgtgatggctcacccctgtaatcccagcactttgtggggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtagaggctgcggtgagccaggattgtaccactgtactccagcctgggctggacagtgagacttttgacagtgagactgtcaaaaa

SEQ ID NO: 617894 - DNA, 138 bp, Homo sapiens
  misc_feature (33)..(33): n is a, c, g, or t
  misc_feature (98)..(98): n is a, c, g, or t
gactggcagggaagggctgcagcagcctagggnctggcaatccagagcctgccccagagcccaaggtcctggcgacctccctgctgcagggggccctnccagcgggccaatgcttctacaaccctgctcagtggcaca

SEQ ID NO: 617895 - DNA, 933 bp, Homo sapiens
  misc_feature (39)..(39): n is a, c, g, or t
  misc_feature (81)..(81): n is a, c, g, or t
  misc_feature (111)..(111): n is a, c, g, or t
  misc_feature (206)..(206): n is a, c, g, or t
  misc_feature (209)..(209): n is a, c, g, or t
  misc_feature (239)..(239): n is a, c, g, or t
  misc_feature (241)..(241): n is a, c, g, or t
  misc_feature (243)..(243): n is a, c, g, or t
  misc_feature (256)..(256): n is a, c, g, or t
  misc_feature (258)..(258): n is a, c, g, or t
  misc_feature (261)..(261): n is a, c, g, or t
  misc_feature (283)..(283): n is a, c, g, or t
  misc_feature (334)..(334): n is a, c, g, or t
  misc_feature (356)..(356): n is a, c, g, or t
  misc_feature (378)..(378): n is a, c, g, or t
  misc_feature (396)..(396): n is a, c, g, or t
  misc_feature (420)..(421): n is a, c, g, or t
  misc_feature (425)..(425): n is a, c, g, or t
  misc_feature (429)..(429): n is a, c, g, or t
  misc_feature (469)..(469): n is a, c, g, or t
  misc_feature (483)..(483): n is a, c, g, or t
  misc_feature (510)..(510): n is a, c, g, or t
  misc_feature (523)..(523): n is a, c, g, or t
  misc_feature (543)..(543): n is a, c, g, or t
  misc_feature (667)..(667): n is a, c, g, or t
  misc_feature (800)..(800): n is a, c, g, or t
  misc_feature (833)..(833): n is a, c, g, or t
  misc_feature (859)..(859): n is a, c, g, or t
  misc_feature (867)..(867): n is a, c, g, or t
  misc_feature (870)..(870): n is a, c, g, or t
  misc_feature (905)..(905): n is a, c, g, or t
caccctgatacctgcactggggggtgggtcacgtgatcnttctcatttcacagatgagggctctgtatgtggtggggtganaatggaacccaatctctggttggcgtgagntgagtgaaggtgtaaagacatgaacctggcagggaaagggaggggaaccgtctcgttattggttgggcatggccatctacacaggctcctgtagngcncgggtaaagtggggaatctgatcagggcangnanaagaagagtaaanantgnaaacagccttcagccacagcanacggccacgctgtccactacggccacggctacctagagcctctgccatgcnaggcccttgaagtcacccaaancgcctccacacactaattgganaaaaggcaactccattcnaagagtatttaactaaaggggctnnatgnaggnacaatttctaaagcgaggaaatttccacaataaagagacncttgccggttgccntaagatagctgattgaattctagctcnccaagaactgganaaaatcagaggagcagaaanaactggatctccaggaagaaaaacagcaaaaccaggctggaagcaatggagataacgccatagaggagaggaggcagcaggggcagggcttggcggctcatcaggatcaggggacccatcatancccccagccggcccactgtatgcagaatgccatctgctgtcatccgcactggcgttggaaagagttcagccttgtagatggtgaggcaggttaggcttatcccaaaacatccctttcccagcacagcaaagancacacgcagggtctgcaaatcttgcggcaccancatgttggctagaatggcgaggcggncatggctnggnaaccgcctggatggtgcggcggccaaggaactgancaagaaggcattgtggcccgcccaggaa

SEQ ID NO: 617896 - DNA, 288 bp, Homo sapiens
ttgaaatgatgttagctcctgctagacagctcttgcttctcctccagggtttatgacaacagcacacggttaagaagggaccctgaggtcgcgcacggtggctcacgcctgtgaatcccagcaccctggacagctgaggcgggaggatcacttgaggtcaggagttcacgaccactatggccaacatggtgaaatcccgtctctactaaaaatacaaaaaattagccaggcgtggtggtaggtgcctgtagttccagctacttgggaggccgaggaggagaagcagca

SEQ ID NO: 617897 - DNA, 918 bp, Homo sapiens
ggggggagacataagaatttcaactatttaatgtccatttctgttgtttgtaccctttcttatccaatagatggaatgcacatgacaatgcaccgatattaacggcctcgtctctagtttacatcccaggctcacttgggatgctcggtctacctgcagtttcacgaacttgtctctctgataaccggatttactggtattagcacccttagaggacaagtgagtaaacgagctcagtcttactgtctaacagttctacattatgtagctcagttttcagggaacggcatgttcgacggacttgctaactcccgttttacaagtttcgttgcatccagactgtgcaaaccacacgtaacacgacaaacactattaagagctcagcctgtcggtctctatactcagtctctctgctgctttcgcgtattgaccgaacagattttatcctacttcttcaccgatcgaacgacataggagcaatggcttgtgcgaattaggaatcggcaaaatactacggacaatggatagaacatatcatccgaacactatcaacgcttagggaacagacacaaactactgccttgacctatcgcacgaaattactgcaccatcgacgtatcacgggctgaattgtatccccaaggcacttacatcttgtgcgcaatacgcgctggccacctgcaacgggtctgcccacgcgattcatttgggggcataagcgtgatagaacgacggcacgcacgatttacgccccgaattcacagtcaagaaaaccctattgtgcaagtacctaacatcctcctaagttgctcgaacggacacacagtggtatgtgtcaagccagtcacccagctagcactttggtacactacggagctccaactgcttttacgcaggcccccccccacggactcgcaa

SEQ ID NO: 617898 - DNA, 200 bp, Homo sapiens
ggatcccgtttatgtggtgtggtgatgtagtatgtgatgtataagatgtgatgtgatgcatgatgatggtgatgatggtgatggtggtgctgatgttgatggtgatgaccctatgatggtgataatgactgtgatgacgttgatggtggtgatggtgtgatgacagtggtgatggtgatggtgatgatggtgatggggag

SEQ ID NO: 617899 - DNA, 765 bp, Homo sapiens
ctacatctaaagaagcacagggtatatgatgatatgagggatcatgagggccaagttgtatctgtgagtgtctttgataatgttgtgatgtagaataatcctttacgatagtggacgattgctatagaatatcagtagttaaatgttagtattaatacaagatcggaccttctttgtggcattgcagaatgtatctggtacgacacacaagttgcatgctaagtataatagggtggaggaggaaatggtcgtagtgccggtatgaaaatgtgtctgactagaacagttcattcaggagtgtaattattttcccgttatcccaatccctgtgtacagtggtgggtatagttacgacagttgatcgcggattagcgaagtagacaccaacttttcagtcttaccctgtgatgtttaagagtgatagactgttgtcctcttgctggtggaaaagttctaaggtggagcccactcttctatgctgaagtgcacaggcagagcagttttcttacaagtcagctactctgcttggttaatatgaggttcggtacttcacgtaagcactgttacaaggtacaagtgtattaatatcactagtttgaggcgctgggtacatctgttttaatatattagaatgtgcagaaacttttactcatgacttcttttagcaactgttatgtacgtccattatgagtggacagtcaatgggagatgaaggatttctggaaatgcacatgatgatgtattgaacctaacacgggttccatt

SEQ ID NO: 617900 - DNA, 111 bp, Homo sapiens
tccctcttgcttatttcttccattgtgagtgaatgacacaggtgacagctcttattctggaccactcaccatgattctgtggctgggaacagatggccagagctgcctggc

SEQ ID NO: 617901 - DNA, 211 bp, Homo sapiens
cagttctctcctgatgtgccctctgcgactgtgcctgtcttagtttgttccttccctgaggaatcttacctgtctctgtgtaacatgcatccaccggggccaaacagggatgacgtgcagtgtgtgagtgagggcgaggcagcgcccccagagggggtcagttctctgtctccttggtagcctatgcccccgtggcctccacgcccagcac

SEQ ID NO: 617902 - DNA, 286 bp, Homo sapiens
atgacaaactgttgtacaaaatacgaaagttaggcatatgtggtggcatgcccctgtagtcccagctactcgggaggctgaagtggatcaccgtgagacccaggaggttggggctgtggtgagccgtgattatgcctacttactccagcctggcgtcacacgagtgacccgtgtctccagtgagaaaaatagaaaacttccccagtagagccggacagtcccgcagatagccggaaattcgggggatccctgctagagatcgaccgtgcacggcatggcgagtctt

SEQ ID NO: 617903 - DNA, 172 bp, Homo sapiens
gtaattaaaatagtcagaaaacggagaaaacgtatttatggtcagttcttgtttttgttagtaaatggactcttgctctgtcacccaggctggaatgcagtggtgtgatctcggctcgctgcaacctccgtctcccgggctcaagcaattatcctgcctcagccctcagagt

SEQ ID NO: 617904 - DNA, 199 bp, Homo sapiens
  misc_feature (43)..(43): n is a, c, g, or t
gatctacagagcttagctcccacttggttgccaggtgaggtangaggatcatctgaggccaagagttcaagatcagcctgggcaacgtggtgaaattccgtctctgctaaaatacaaaaaattagccgggtgtagtggtgcatgcctgtaatcccagctactcaagaggctgaggcagagaattgcttgaacccggaaa

SEQ ID NO: 617905 - DNA, 445 bp, Homo sapiens
gctcgacaaagcgcttgaaatctacacttgcaaattgcacaaatagagtgtttcaaatctgctctgtctaagggaacgttcaactctgtgagttgagtgcacacaacacaaggaagttactgggaattcttctgtctagccttacatgaaaaaaaccaattctggccgggcgcggtactccatgcctgtaatcccagcgctttgggagaccgaggtgggcagatcacgaggtcaggagatcgagaccatcctggataacatggtgaaaccccgtctctactgaaaatacaaaaaaattagccaagcgtggcgacgggcacctgtagtcccagctacaaaggaggctgaggcaggagaatggcatgaacctgggaggtggagcttgcagtgaactgagatcatgccactgcactacagcctgggtgacaaagcaagactccctctc

SEQ ID NO: 617906 - DNA, 443 bp, Homo sapiens
cacgaggagtagtagtagtagtagtagagagagagtagtagagagagagagagagagagtgagtgagatcgagagcgtgttgctggccagtccggtgccctctgctgccccttctgttgccattgccccatgttaattctcttgtccatcccatatcactggtctctgtcccctcatcacctcctttttccactctttatgcttcaccacttctctctccatgtgcaccatttgtatcctgcttcattttcctctgttcacttctgtacacttagtgtcacccatcttcgcctctcttcttcctgctcatcatcttccccttctccttttggctgctcattcttcattttttcttctatgtccttatctactacctctctctgcttgatctctcccgcctctctcttccttctctcttccttccttttcctcctctcctcccc

SEQ ID NO: 617907 - DNA, 633 bp, Homo sapiens
  misc_feature (11)..(11): n is a, c, g, or t
  misc_feature (69)..(69): n is a, c, g, or t
  misc_feature (86)..(86): n is a, c, g, or t
  misc_feature (89)..(89): n is a, c, g, or t
  misc_feature (161)..(161): n is a, c, g, or t
  misc_feature (166)..(166): n is a, c, g, or t
  misc_feature (294)..(294): n is a, c, g, or t
  misc_feature (303)..(303): n is a, c, g, or t
  misc_feature (350)..(350): n is a, c, g, or t
  misc_feature (381)..(381): n is a, c, g, or t
  misc_feature (439)..(439): n is a, c, g, or t
  misc_feature (487)..(487): n is a, c, g, or t
  misc_feature (501)..(501): n is a, c, g, or t
  misc_feature (535)..(535): n is a, c, g, or t
  misc_feature (563)..(563): n is a, c, g, or t
  misc_feature (617)..(617): n is a, c, g, or t
attccacagtnttctttaaaagagtatctttcaaacacaactttgctagaaactggtccaaagatcganagcgcgtgggaatgctnaanaggggtggtgatcagggacacgtattcctgggtgccgctattgatgatgtggtccacacgcagaatacaccnctgcngcttcagctgccctcagaagaacctgtcgcttcacttgaaaactttctgtgatacccaggatagccatatctccaatggtgccttcccatcatatccaatccagtcagtggtatatgccttcactgtnagcggcccngagctgtgccaccaggtctgcactgtcatagcctgcaattgtcagcnatgatggattgagcaacattctcagtgcttnagcataagactccattgcaacagcttctttgcctggggttcaattggcaagctgtgtnaaagcatgagccatcaacaactcagaacagcctcctccataaactgtnctagagttctttanagtttgcgcaagaacacaaagagcatcatgcaangaactttcagcttcaactaaaatatgangagtagcaccacgcaaaacaatggtacaagcgctcaccaagggcaaccccaganaagtgaattagtgtgt

SEQ ID NO: 617908 - DNA, 395 bp, Homo sapiens
cacgaggggcagtgtcgtgggggggaccctgctttcacattgacaaatgcccatctgcacgtatctgaggagttcatagactatgacccatcagacatctccttctttgctgggggctctgaggcgttattttttccttatggctctgtacacccacaagaatctcaggcctctgcccagcctctggtggcccctcctttgtgtgagcttccagggtctgtctcggtccagcccagacaggtactccatggaagcagttgatatgaacacataagacggttttgcatttgatgaggaaagtgacttcaatggaaactcacacccctcacacacctcagaactattttcggtgaatgcgcaagccacacgaattcatagcctgctgggtccttctg

SEQ ID NO: 617909 - DNA, 87 bp, Homo sapiens
gtgatagagtcttgccctgttgctcagactggagtgcaatggcaccatctcagctcaccgcaacccccacccttctgtcgtcttctc

SEQ ID NO: 617910 - DNA, 277 bp, Homo sapiens
cagagatgatgccactgcactccagcctgggcgacagagcaagactccatctcaaaaaaaaaaaaaaaaaaagctgctgaaatcgggcagcgcttttaaaattccgggcccaggtgatttcgtaactcgggggcacccgggttagggcccttcttagggcccggcaataaccctcttcctccatttagcattgggcccaggtctctaacattctccttacccagttttaccaggggccgtgtgagagccttcacccatgggaacagtacaaccggcg

SEQ ID NO: 617911 - DNA, 1156 bp, Homo sapiens
ccgttgtttttggcttttttttgtccctttttctgttgtttctgttttcgtgcttttcctttttcgtttcttttgcctttgtttgatcctccgttcctccttgcgttttgttccttttgttttttttgtgctttttgctcgttctgcttgtttcgggcctctcttgtggggtcctttcgatgtccttccttctgtcctcgttggtgctctgctttattgattgtgctctgtcgtttcttttctttcgccttgttgttcttcctctttcctggtggtgcccctcatgccgtgcgccttcgttgatgctctgtcccttgctatctcctgttgtctctgcttgcgtagtttcttggtactgcttggacctgcttgtcaagtgcatgcgctcctgtgccagccatcccttgattagtgggctacatctcgtgtttcctgttgcccgatccccaagtagttttggtacgttctagttctcttcttccttgtgcacttgtggggccttccaaggttcgtctcggtccatggaccttgtagacttgtaaggcttcgacttttacccattttgcggtgtggatgtttgagtcatctgtccccctttagatctgctgatgctcactaaataggatgtcttgggaagactcctagctgtccttttgcctctccacacagtgctcaaggccagcttatagtcatatatatcacccagacatcaaggtacaatgacacattttcttaggaaatgtttgttaatatacagcaaaattacaccacagaaattttaaagacccctaaccctttgtgtgctctccattctgctccttcacccatcagttgcccccatttctgaggtgcactgggaggctccccttctatttggggcttgatgactttcgttctgtagctggggctttcgatgttccttccagtcgtcatttctcatcctacactatcccgtgatcctggccccctcagtgttgtcaccacgagtctgatttgtaacccactgagaggacagagagaaataagtgccctctcccaccctctctcctacgtggtctctctatgcctctctacagtctcgtctcttttacctggcccctctcccttgggctctgatgataaaattgctgactgtaaacctttggaagtttagcta

SEQ ID NO: 617912 - DNA, 154 bp, Homo sapiens
tgggtggcggaagagggctggctgggacagagggagccggggaatggcagcaggcaggtttggctggcaagggggcctcctacccggagtgttggagaggagagtggctgggtccctggctcgctcgcatgcacgtttctccccttcttcccca

SEQ ID NO: 617913 - DNA, 903 bp, Homo sapiens
aggtctccctggcgtaggggtatattctcggtggtgtccttccgttgcgctatgtccgcggcgccgggttcgcgcccgtgttggtggggttcccaccgggtcacgactagtaggccgatttgcctgtcggtgttgaagcaatgtttgtctgccgcctgttttgctggtaaacacctggggaagggcgcgccccaacttgttcgagaaattgtccgctaagtgcccgccctcttggggttaagtgggcgctccggcgagaaaccccacggtggtgctgggagaggcctttttctgcgccgatgcacgcccacctgagggaggcgccattcccggtgtctgtggaatagatagggcaccacacacggaaccagcgggggggggggattccacaacagaccacaggggcccaaaagagacgaggcgcgctctcgagaaggtcgaccaaaggggcgcgcccccaagggggtgcgcccccgagaatcacctccaaagggagggcttagccagcgagtgatgtatacgccgccgatagctaccgccgccaccccgccccgggttgtactcccgtgggcggcgaaagacaccgcgcgcttccacaggacgcctcgtgtgtggctaaccaatcggggcgccgccttcaagtctcaagatgtgaaccaacggggtgcttaattgagtgaccacacgcgtggcggtgttatccgcctccacgaagggaacaagtagataattttctcggcgccgcacttgagcgttttctattgtgcgagcgagggccgatagtaattatatatgcgtgtgttcaagacccggacatcttttggtgatgaggaccaccaccgggacccccaaattgtgcccgccaaagttcgtggagcgcccaaaaaaacaacaaacaaaaca

SEQ ID NO: 617914 - DNA, 378 bp, Homo sapiens
tatctgctgtctcacgctagcagatcgacctcaccgggctgcactcataggaggtcagggagaaccccgaatagatcagtcatcataaagaatgaaacatggaccgggtgcagtggctcacacctgtaatcccagcacttagggaggccgagccaggtggatcacttaaggccaagagttcgagaccaacctggggaacgtgacaaaaactttatctctactaaaaatacaaaaattagctgggtgtgctggcacacacctgtaatccctgctactcaggaggccgaggcatgcgaatcacttgaacttgggaagcggggattgcagtgggccaaaattgtgccactgcactccagcctgggcaacagagtgagacag

SEQ ID NO: 617915 - DNA, 590 bp, Homo sapiens
  misc_feature (90)..(90): n is a, c, g, or t
  misc_feature (100)..(100): n is a, c, g, or t
  misc_feature (116)..(116): n is a, c, g, or t
  misc_feature (136)..(136): n is a, c, g, or t
  misc_feature (201)..(201): n is a, c, g, or t
  misc_feature (207)..(207): n is a, c, g, or t
  misc_feature (229)..(229): n is a, c, g, or t
ccgtcctctctgctcaagttatagcatacatgtatcgggattgtctttggagcatgagattttcctccctcaggagcttttttttttctnctcatgtctnactgcctactctaacnttctcccctcaacagattgngaccctaaaaatctttgagtttaggggcactgtgggtcttccgtaactgcttcctgctgacatgngataangaactcatcagtgtctcattgntttgtcctttgtcagggaaagatatcctccatgttctctcaggtttgacttgcagtctccagagaaaatgtgtagggacacagttttccagcagggaaaaaagtaggttaatattcctgttagaggaccatttgaactctgagagtttctaggtgagaaggacacaaatctggttagtagatttagtgagcaaggcccaaaaaggagaaaaaggaagacaaaggccagggatcccaacaaaatgagatgtcatgaggtctgggaccaggtggcccccaggagactagacctaagtggctgtttctgaagggaagaggctggtgtataaatcttcactgatctggattgcttattgtaacca

SEQ ID NO: 617916 - DNA, 523 bp, Homo sapiens
  misc_feature (4)..(4): n is a, c, g, or t
  misc_feature (212)..(212): n is a, c, g, or t
  misc_feature (286)..(286): n is a, c, g, or t
  misc_feature (358)..(358): n is a, c, g, or t
  misc_feature (362)..(362): n is a, c, g, or t
ttanttcccttctctctactcatccccctccaacctcccccttggccgctgtggttaatctccctccacacacacatgcacacacaggtactaatgaagtcctagtttgtgaagtgagcagggaccttggaataagtcctttcctaaggtagggtcttaagttgctatccccctaggagcctgagtgccttagagggagggcgaggagaacnaccacaggcaagttgcaatattttctctacatattctgcctggaatcaagatgctcaggaaacggccgggcgcnggttgtcacgcctgtggtcctggcactttgggaggccaaggtgggcggatcaggaggccgggaattcggagnacgnctggccggcatggtgaagccccgtctctactgatagcgcagaaattagccgggcgtggtggcacatgcatatagtcccggctactcgggaggctgaggcaggagaatcgcttaaaccagggaggtggaggttgcagtgggccaggatggcgccactgaggg

SEQ ID NO: 617917 - DNA, 673 bp, Homo sapiens
  misc_feature (615)..(615): n is a, c, g, or t
  misc_feature (639)..(639): n is a, c, g, or t
tgaaagcagctggttgcctgtagctgtccataagagcagcattgatgtagttactgctctccccatcaattgtaattaaaaaaggcagacatctgtcaggtggcagcatgtccatgaaacggttcttgtcatggttccttggcaggcacgctatactgcagtcttcagcttgtagtcgaggggtgactgaattcagagtctgaaattcatccttgagatgtgaagagttagtctgggagtctattctaatcatatcaaaatatgcagctttaaattcacagacaggtatggcagtttctccacataagcaggcttctaaaatggcatcatgaataaaaatgtactgttcctctgtctggaccatattaatacgccgagatcttaaggctttgacacaattgtaaatatcaacaacaccctctctttcagccatgtctagcatgatgtcaatcacaatgtagcagccagttcgtccagcaccagcactgcaatgtacaacgatggggccagcactgggagggtttgataacttgactcgccggataaaggaaagcagccctgtagcatggtagggcactccatggtcaggccagcccgtgaaatggaactgtttancttcacggatttcattgtaccccntcctttccagggtgaatgtcctaactctcgtgcc

SEQ ID NO: 617918 - DNA, 486 bp, Homo sapiens
ggagttgagcatgcacccggccggccctgggggctgacagtcggcaaatgtttggcccgaagaggaagtggtctcaaaccccgtgcaggtggcgaccagtgcccgtaccaggggctgctcgctgcctgcgggcgggctgtaggctgagggcgcgccccagtgcctgagaccctggggcttcagtgagccggcctctgggagagaagatgtgcggcggcggacggagaaatacaactccaaagttggcgaaaggcacctgctcctactccctgggctgccgtcggcactgtccacgaaatccacagaagccttggcaagtccaggaggtactgggtcggagccacgtggccattgggtagcccccaccatgtggtgaagtgcgtgcacacatggggagccctgggtcagcacaggaatcatcccgaaagagaatactccagttctggtaacacaagcagaaagcatcgcggtggaagcgaacgttta

SEQ ID NO: 617919 - DNA, 225 bp, Homo sapiens
agccgccccccgttggcttctcaatggggcagctcagaacaaggtaagtcaatttccattttaacgttatgaaaaagctatcagggacaggagccaagatggccgaataggaacagctccggtctacagctcccagcgtgagccaaggccaggttcctgacccataggaactgtgagataataaaattttttttttttttttttttttttttttttttttttttt

SEQ ID NO: 617920 - DNA, 204 bp, Homo sapiens
agaagtgaatgctgggactcagccttcagacagagaggactgtagggagggcggcaggggccttggaggatcctcctgccagaaccacggcccgttcctgtcctgttggcgtccgttcttccagggggctgctttcctccttggaaaatttgacggaggggttgttttttgggccagatccttggctttttagccgccgttcca

SEQ ID NO: 617921 - DNA, 102 bp, Homo sapiens
ggtggtgtcctccccccactggctgctctgaaaaggtatctttgcattgttcctcatcctgcctccttgctctgcctgagcctgctccgctgtgcgcctcct

SEQ ID NO: 617922 - DNA, 151 bp, Homo sapiens
tgaatcgaaacctgcggtactatatctattgcgcagggttcaatttctatcgcctatacttatttgggtaaatggtttgtctaaggttgtctggtagtaaggtggagtgagtacagggttcgatgaccatggttgatgagggtatcgatga

SEQ ID NO: 617923 - DNA, 1021 bp, Homo sapiens
taaatttctggtcattcttggccctgtttcaaaaaaaaaaccccattttcccaaccaaaaagccacaaaaggtgactttgggccttcaagagaagtttgttaccctcgaaaatcttacgcgcctacgcaagaagaatctccccaaactcttactgcagcagatgtcacacaggggtgttcaccacagagaaggagaatctgcctctatataacagtccctcacccgccatcacggcctgcacgcgaccgacacgctaactctcacaggagcccgctctcctctcgagcgagaacaggttagacccccttctcgcggggtgtgccattgttccctctccaggggaaatatacccacacctttaaaacaccaacttgatttctcgacacaatatacgccaccagtacgcccccgtgcgccgccccttgcacaccccctttgctgcccccctttgtttgtctcaaccctgtgttgccccttgggttcggtcacaacctagggagaagcaccgcacacaactcttttgtgttccccctacgtgctgggcctacacagcagaacgcctctccaaacgtgcgctctcagatcccctgtccttccacccctagtagacaaccgctcctcgttgatcaacaaccccgtcgctctccacagaccgtcccacacaaactctcagctccttccccgacatccatcttttgccccccaccttctctgtagcggcagacgcatctaccctgaggtccacgctgtcttgccgacaaccccccccccaccgacgctgttcaaagctgacacgctttgtacgaaaatcacctcccccgctcattatagacgacactgtgtttcccccacgcccacacgcgactttttggaacagcgccccctcaccgatacaatcttgcttgcgacgcggacattattcgcgaggccccctcctcacacatgagtatttgagagcgctcgcccctgacaaaccttcgccccgccccctataacaagaaggcgctccccccaacacat

SEQ ID NO: 617924 - DNA, 904 bp, Homo sapiens
  misc_feature (385)..(386): n is a, c, g, or t
  misc_feature (440)..(440): n is a, c, g, or t
gtaaatctagcacttgggggaggctaagccaaaaaattgctcgagccaggatttcgggacccaggcctaagcaaatgaacccctgtttttaccaaaaaaaacaaaaaaggccttagtcatttatatgacctccttagaattatagaaagttagctggaagaaaaatttgtctaacagatgtaaagatagaagtatacatagattatgacttgtcctaggttacctaatcagtgagggacagaactagaactgagatccagaccaccgtccccactccagtggatgcatcctggaaccaggaatggggaaggtggagccactagcaaatacagccctcatttgggccagtggtatgaatttgctgatatagtatttgatttcacanntctaacaagttttattaagattgctatggtttcttaattttgataatatttganatctcatttttctcagacctataaattataaagcaaaattagaaccattttagcagttcattcaaatcattaacagcctgcatatgtatatagatagcaacattttcatttgaaaccacagatttgcaaattacttcctgtttcatttatccaccccagtgctacgaggtgttctgttcagaagtccaaaagggtagaggaaagatgactaatattgagcaatggtcttagtattttggcttttcaactactttctattcgtcattctcacatttggatttggtttacagttgtcaagggtacactctcagcgctgatcagtggaatttgtgagagcagaattctcaaccttgacactgttgacagttttgggcaggataattttttgtcatagggagctattctgggcgttgtagagcgtttagcaacatcctctaccagctagatgtcagtagcatcctcca

SEQ ID NO: 617925 - DNA, 288 bp, Homo sapiens
atgatttactgactgaagtatgggcctgtgactatagattgaaaaataaaatagaaatgctaaaaaaaaaaaacttagctacatatgtttaatatctaaactcaccagacaatccaatttttaaaggaaactgactggaacaaatgcttccccttaacgtgaactataggttagcatagcattgtctagtcaggaaaattcaccaatttcagtagctgatctttattgtggaaaccaaaaatagcggctttgtcctatattcataagttacagtagatcgacacaacg

SEQ ID NO: 617926 - DNA, 525 bp, Homo sapiens
gccacccggtccagtccccttccatgctgtggaagcttggttctttcgctcttcacagtaaatcttgctgctgcacactctttgagtctgtgccacctttaagagctgtaacactcgcagcaaaggtctgcagcttcattcttgacgtcagcaagaccaagaacccaccggaaggaaccaactctggacacattacacactacatgtaactccagttatctcacaaagtttacgacctggctggatctgataaaccaaaagataacgagctgtataaatataccccagtgtgcttataagagtttgcactcttgtaacatggaccaatcagaactcttgtcaaattggcccaaatcagcgggctgtgggtggggtcaagtaaggggactcaaacagctggccactgcagctagcagttgcaaaccgggtccagtccccttcccatgctgtggaagctttggttctttcgctcttcacagtaaatcttgctgctgccactctttgagtctgtgccacctttaggag

SEQ ID NO: 617927 - DNA, 485 bp, Homo sapiens
accagcttcatagatcagctgtgtggttgggtacatttccaccttgattgcttgtgtctccaaagcctggaggctggaacagctaagttgcccaaacagcaaagatggcagcccacctctccctctgggagctctgtcccaggaagttttcaaatctctgtcagccagagaacatcggtatgtgtggctggaggccccagttgtgagattctgcccagtgaaaaggaacgggatcagggacttgtttaaaggaagcagtctggccatgctttcatggagcaactgtgctgtgctggggtactgcttctgtcctcgttggcttgggctctccaaagcccacagactggagtggctgagtcacccaaacagcaaagatggtgtgctgcccttccctgttctctgtcccagggagaattcaaatctctgtcggctggtgaacactggcagggatggctgaaggcccagttgaaatggtcgccaatccg

SEQ ID NO: 617928 - DNA, 696 bp, Homo sapiens
cgccgggttccaccccggggtgttcttccggggggtgtttttttggcagttcgctttttctttgttgttttcatgtgccttctttgtcgttatggggggtcatattatgtggggtcgcctcttcgccgctgttctaacatttccctttatgtctcgtcgggcgtttcaggtgaagattctggtcctcgagcgggtattttgcggcgtcttctctggtggggtggcggcgctcctttttagaggtgcgcggtcacactcgtagtggtaccctcctcatggttgtcgccggggttggtttgggcgcccggtgggtacctactcggggcgcccaccacgcctgtttggtctcgcccccgcacgctttttttctcatgctctctttccttgtcgggtactctcacacgagtcgtttgtaacacataactcgctaatattgctctccctggcatctctcttcacagaaggttccaggaggagcgtccactgagtcgcattaagccagatgtagctccgcgcgtggttaggggaaccagatattcgtttctaacctccgcctttggtggaggaaaataattagcgttcctcctgcgcgtgtttaatatgttttatggtgggccacctatggatattttttatgcttctgttccctgtactgaggacaactggtaaccgcgccatcaatagaacaagaaatat

SEQ ID NO: 617929 - DNA, 264 bp, Homo sapiens
gttttttttttttaaaaaaaaaaaaacccaaggggggggtttttgaaggccggggcttaaatttccttggaaaacatggggccccccataagcggggttcccaatccgggccttaggtttggggccaaagggaattatgttcctgggggaaaaattaacccaagggccccgggaagggattaaggggcccctccttttgtttaaaggcaaaggttcaaatccccttttttttttttcccggttaaaaaaaggggggggttttta

SEQ ID NO: 617930 - DNA, 1258 bp, Homo sapiens
taaatttattcacaaaaagcagtcgggaaatcagaaaggcagcggccgctccagggtctcaaatccattaaaaccaccacagaaacaattaaaacaatcagagaagagaaaaggaaaaggaaacaaggtccaacattgggcattgggtttaatccacgaggttttccccagaagctcctctgggaatgtgaaagcaaaattattttgtgggcaaacacgtggccttctcaaatacacaggaaaggggagccctcaggtgccctccgtggccaacagaagggcggcctcttggtgccagctcagaacgtggtggggtgtgtccacaaggcgagctcctctctcagagcgtgggggttccgtgggccctcttgtctcccactccacattcaccccttctccaggcaaatttcagccagccatatccagaacagcgtggggccttcgtgccgtgggagtgccccttattccccccgaggacagaagggggcccttggggcattatatgttaccgaggcgacaccgtggccgagtcccccgagagagcgagaaataccgcgtgggtggggaatcccctttcgctttcatatacaagcgcttttggggtggttgcgagagagaggtgcgctcaaaataggcggcgattcccaaaagctttccccccgtattccccaaagtgccccataagggcgtacccaattttgcttcacccaaccctataccgcgatggaacaagtccttaaattttccccaaggtgtgcacaccacacgccagcaccaggagaaggcttttaaagctcacgggggaggggggaaccctaactcaattcaaggattccgtatacccgcccgtggtgttaacccctttttttgccgcttcgcaacaaagaaatttcacacgccgtgtggggttctcctgtatactacattacaaatattattcaccaccctatctcaaatcctcaaaaattttcccatagcgcaacaaaagtttctctccaagaagacccccttgtatgggtctggagaatgagggccccacaaaacaaagacaagcagaggagctaacagagctagccccctacaaggggaaaacaccaaaaacaagcttgtggcgtttctgccctttcggcccccccaggtgacaacgcgtacacgcaatatatcgcgtataaggtcgcccgcacggcttggtgcacacactcttggcgagacaacctggacgaatatgggggctgtagaacatatacgagaaaaggcg

SEQ ID NO: 617931 - DNA, 415 bp, Homo sapiens
ataccaacctgacactgctgttctctttcgcccaggctcgtgcctgcgccgaagccggcgtcttcttgatctctccgttcgtcggccgcatctatgactggtatcaggccaaacagcctgccgctgactatgatgccgaccaagatccgggtgtgaaatcagtacgcaacatttacgaatactacaaacagcaccgttatcagacggtgatcatgggagccagcttccgcaaggtagagcagatcctggcattggccggttgcgatcgtctgaccattgcaccgaatctgctggaacaacttaagcacagcgaccagccggtcgaacgtaagctgacgccatccactgaagccttccaccaacctgccccgctggctgaagccgaattccgctggcagcataaccaagacgcgat

SEQ ID NO: 617932 - DNA, 848 bp, Homo sapiens
ggaaaacaaggaggggagtgaagcagggagcatcagcgagtgaagcagggggcatcagctcacctctgaggagagctgaaatagaaacaggattttcagctctccccctccccctctccctctccccacggtctccctctccctctctttccagcggtctccctctgatgccgagccgaagctggacggtactgctgccatctcggcgtcactgcaacctccctgcctgattctcctgacctcagcctgcctactgcctgcgattgcaggcgcgcgccgccacgcctgactggttttcgtatttagttggtggagacggggtttcgctgtgttggccgggctggatctccagctcctaaccgcgagtgatccgccagacctcggtctccctgaggtgccgggattgcacgacggagtctcgtacactcagtgctcaatggtgcccaggctggagtgcagtggcgtgatctcggctcgctacaacctccacctcccagccgcctgcttgtgcctcccaaagtgccgagattgcagcctctgtccggacgccaccccgatctgggaagtagaggcaccagtccatccgagctggaccaaccacatcgtccagggacctagtgaacggacacaccgtcaggccatgggaaagccccggagacaaggaagaagcggaggaagccgacgcacagggcccggaccgacggaccacaggttctcaagccaaccagacgcgaacacacactccacaccacgacgcaccacaaccacggggaggaaaataacagagaccagtcccgagacaagacccccatgacccgacaaacagaaggagacacccagcgcaacgc

SEQ ID NO: 617933 - DNA, 280 bp, Homo sapiens
cacagattcgtctggtcggtacagacccagaatctgcaaggtctgcccaccacctccatatctctgccccttgataatactagatacagaggattagggtgaaactaatggaaccccatattataccacgctgttctcatcagaatgaaactacaaaattcactaacatctctcttgtgtataatatataatatatacatagtactatttacaatcacaaaagaaatggaatacacccaaatgcccctcagtggtagactaggacccagcaaacattgta

SEQ ID NO: 617934 - DNA, 728 bp, Homo sapiens
  misc_feature (11)..(11): n is a, c, g, or t
  misc_feature (76)..(76): n is a, c, g, or t
  misc_feature (126)..(126): n is a, c, g, or t
  misc_feature (137)..(138): n is a, c, g, or t
  misc_feature (141)..(141): n is a, c, g, or t
  misc_feature (165)..(165): n is a, c, g, or t
  misc_feature (169)..(169): n is a, c, g, or t
  misc_feature (232)..(232): n is a, c, g, or t
  misc_feature (235)..(235): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (272)..(273): n is a, c, g, or t
  misc_feature (287)..(287): n is a, c, g, or t
  misc_feature (390)..(390): n is a, c, g, or t
  misc_feature (414)..(414): n is a, c, g, or t
  misc_feature (470)..(470): n is a, c, g, or t
  misc_feature (495)..(495): n is a, c, g, or t
  misc_feature (517)..(517): n is a, c, g, or t
  misc_feature (529)..(529): n is a, c, g, or t
  misc_feature (559)..(559): n is a, c, g, or t
  misc_feature (561)..(561): n is a, c, g, or t
  misc_feature (567)..(567): n is a, c, g, or t
  misc_feature (570)..(570): n is a, c, g, or t
  misc_feature (642)..(642): n is a, c, g, or t
  misc_feature (717)..(717): n is a, c, g, or t
cgacaaatccnctctaccctataaaacacagatcatcacattgacagacgaaaaacaaaaacaaacagcacaagcnaacagaaatgataatcatactctatcacttcatgcaacagcctggaaaangatcagaattnnggnctacgtgagactgtgtagactgtntatngtgacacccaggttttcagtcccttttagtggcttacactgattctttgaagcctacagggcngcnttgcctcagccccaccatangtnagngcacctgaggnnctgggttctctacnaggctttgccgcacctttacaatggttccaactcaacactccacccaggaagcattctttgtaattgtgggagccctccacactctttcagacttattattcncccagtgtactttgtaggaatganctggaaaacttggtgaggactgactcaccactgaagactgtgatcatcaatcaggntcccattgagaggactctatgaccngccaaggctcccattccacccnttatatgcctcncccacgatgcctatctgaaacaagtggccngnaaaacnctnaatactaagatgtgttattacctattgtcactgtttcctcaaacaatggcttagaaaatgctgacttaaganaactgattgataaactgggctaagatattagacaaaaattaaatagaaaaaaaaatccaggttaaacagtaaggngggtggcaggg

SEQ ID NO: 617935 - DNA, 388 bp, Homo sapiens
gctggaagtaccttaggacacatggggttggggtcaggactgctagttctcacgcgaccagctggatgagccctggaccagatgaactggacgtctactggcctcatactcagtgacatggcgaacttgctcgtgagacagtggagaggctcctgtgaatgatcctatggacttaaatgattgatgcatgtttgctacatgggcagaatactgtaagtaaggtaaagtgggatcctcaggtaaagcgggatccatgaactaaagactgtgctatttcctgatgggcagatgtgtggtttctacctcatcttggacagtatctggatatgctgggcggctggttcatcactggagggagtcctctggtattttgagcacctcgggacat

SEQ ID NO: 617936 - DNA, 821 bp, Homo sapiens
  misc_feature (1)..(3): n is a, c, g, or t
  misc_feature (26)..(26): n is a, c, g, or t
nnnggaaagcaatggcagtgtcgcanaagtttgtagctaaacttcctgggccagcgagaccacgaacccaccgggagaaacgaacaacttcagacgcatcactttaagaactgtgacgctcaccgcgaaggtttgcaacttcactcctgagccaccgagaccacgaacccaccggaaggaagaaactccgaacacatccgaacatcagaaggaacaaactccagacacgccgcctttaagaactgtaacactcaccgcgagggtccgcggtttattcttgaggtcagtgagaccaagaacccaccaattctggacacaccaccttgcccttctacttttcacaggtactaaggtctcaaactaataagtttttacagggttttctgcattgaacaacttttagtttgtttggcggaggtatagaggaatagaccttgcccctttgaaagcttgcattggttattttaggcagactatccaccacgcacttaagattctgcttactcgcctctagaagtgactcctgttaaagactatacaattgattcttcaatgccgtggtgctcctggaggcccccggtgtgttctggcgagggaagaagaagaggtgcaatatcgcggcgtgtattattcgagccggatacaagcgataagagcccttgttggccgacgggggggggggtcttatgttccacccaatgtggcgtgcgacgaacaattcggccgctgtgcttaattaaataagaacagtatatataagatcttcaaagggtgacgtgcgtagtgaggtagataccggatgatgaaaaatatggtgtgga

SEQ ID NO: 617937 - DNA, 300 bp, Homo sapiens
tatcgagttgtctcttgtaaaagtctgaatattacaattgcactaaaaggctgggcacagtggctcatgcctgtaatccccacactttgggaggccgaggcgggtggatcacctcaggtcgggagctcgagaccagtctgaccaacatggagaaaccccgtccctactaaaaatacaaaaattaactgagtgtggtggtgtgcaccgtagtcccagctactcgggaggctgaagcaggagaatcgcttgaacctggaggcagagattgcagtgagccaagactgcaccactgcactccag

SEQ ID NO: 617938 - DNA, 1494 bp, Homo sapiens
accccagagagccctgagcagccccaccgccgcctgcctgtgcctagttaccatcacacccctgtgtgatggatgcctgcatgctgcctgcatgcctgtgccccatgtcaccatcacctgcaacccatgatgcatgctgatgtgcctgatgacccatgcatgcctgccctgctgaacaccacaacagcgaacagacccacacagacccctaccacgacaacacgcaacgaccaacccaacaacccctgagcacctaaccgagcgacaagacgagccgccacacggacagcaaggatgaaaacacagagaggacggacactccaacactccaggacaggacagaaaatgcaccccggccgccagggcacccagccaccacgcggtccactacccgaccacacccgaccacccctctcacccgggcgcccaccccgcctcacccccccccgcctccccaacaccaggtcaccccaggacaaccgcgccccctccaccccccacacaccccaacgaccccgcgaagcccgcacgacccaccggcgcaacacacctgtcacataaccggccaacgcaccacaccaccaactcggcccacccgcaccaccgacaccagcacacccccacgaccgcgcgaggcgccacacgaccccaccacccgcccccaccgcacaacgacgcgcccaccggcgcatccaacggaacactggatgacgcccgcccccgccgccacgcgccacgcgacgcaccacgcccacgaacacacgagcgaccaccccgcgaaagcgagcacagcacctcccacaccgctcgagacggcagacccccaggggcctgcaacaaccaccccacagaccgcacagacccggaccgcaccacagccgcctcccaactccgatcgatcaccaacacgcccgaaaccaccgcaccccaaccgccacccagcgcgacgcgacgaacacgccacccacagcggggagcggcggctggacgggcagcggctacggagacgcagacggcacgagagcctgaggctgaggcaggaggtgaggagagcgagcgcacgagagcccccccaggacgccccgtgcagcgcaaggccagggaccagagacacagcgctacagcgccgccaccgtgcagcgcgccgcaggcaccccgcggacgaaggcgcgactgaagaacgccgccgccgaacccgggcacacgcgcaaacacagggcgcagagagacaagaccggcgaaggagtcgaaaggccgacagccaggacacaacacaagacaaatcccacaaaccaacaaaactacaatataaaacaatcccaaaccaacctcaccacacaacacgaccaacccaccatcactcacccacaacacacaagtaaaaaaacaaccctacacacaccacagataccacaacacaaacacacgcagcacaccacgacatccaaccaacccacaccactacaagacactaccccccacaccgaccaaccg

SEQ ID NO: 617939 - DNA, 422 bp, Homo sapiens
  misc_feature (58)..(58): n is a, c, g, or t
tcatagccgatatctagagtataaccgtcgcatattctgaactgtccattcacatagnacaataccttgcggctacattcatggaacttagccacgaggtcctaccaactcctatgtgcttatccaaggtgcccatttcatgcctaggtgctggtcacgcctgtgccatacacctctaaaacatccttcattgtcctcatagactcatcatactatggctgcaagaccaaggaagttataggagcccatgtagatgacatctttgatgactctatccagtaaacctaaacgtccagttatagtcgtccgataccctctccatacacatcaaacagaggccctggggcactgcagatgggccggttccagtagtctctgattcgcatgtagaggtttcttgtataaaaattttcaaagtcttg

SEQ ID NO: 617940 - DNA, 231 bp, Homo sapiens
aagttatttttgtaataaggaaaaagacctaaggctgggcacagtggctcatgcctgtaatcccaacactgggaggccaaggtgggaggattgcttgtacctaggagttcaagaccagcttggtctgtaatgggagaccctgtctctacaaaagcgaaacaaagtgaaacaaaattagctgggcatggtgatgtgtgcctgtggtcctagctgctcgggaggctgagacag

SEQ ID NO: 617941 - DNA, 794 bp, Homo sapiens
tggtgcggcgacttgaaattgtttacccaaaatctgttgagctcgcttgtgcggggggtggggtcccggtgggctttccccctgtgcgccttccaggccaccgaggttccgatatctgccctgttggtggaatttcaaccccaactttcggtggcgcgtatatgataccataaaggtggaggtggctcggcagtccgttggaggcggccgaataactggcgttctgactccaggtgccgaaagggccggtttgagggatatgaaggagaaagtggaggcagtttctcgtggaaggcacccagtgcaccaaccgtgcgtgctgtggcagggtggccaagtctgcactagagaggggccacccgtgcaagtttgccccggaaaactcgggggcacgttttttgttccccccaaaatccaaggcgcggcgggatactcccccaaaaacagtggcgttgcttgaaagggtggcaagagagcgaaacacgtggagcaagtcttgcatgtggtgccccgaggggcgccccagattttccctggggtaatagtgaaccgtggggatactttggcggggtgagaattcctaaataccgcgtggtttctcccgaaaatttcgtggcgcgtgtgggtgttttattccccaaaaccctcgtttggaaccccaatagtgtagaccacgcaaaaaccacgcaggtgttttttgtgggaaagaccttcgggatatataaataattattgattgttttcctcaatctacaaggggctttttaaaaacacctttaaaaaaaataaatata

SEQ ID NO: 617942 - DNA, 156 bp, Homo sapiens
gtcagggaatgcatgttgtgtgcgttgagccatggtctgcctgtggtgagagtggtggacttcttcactgactgccatgagcttcgtcgtgctggcagagtaaacagtgttgatggctaggtgatactaggggctactgctggaacacgacaggcg

SEQ ID NO: 617943 - DNA, 139 bp, Homo sapiens
ggtagttattcgtcagacgtgacattaatgtcgtgactggtgaatacctgtggcgcattacaggtgtagttgttgtacagccccgttcacgtcctctcttcctccctttctcctttcatgaggctgatgtatattagtc

SEQ ID NO: 617944 - DNA, 173 bp, Homo sapiens
atctcaatcctccactccactctgccgctccactctcgctcgcttcccaacccgccggcggcatggcgtcctccgcgcctccctcctgctcgctgccgtgatgtgcgcgctcgcggcgtcgtccgcctccgcctcccgcgacctccgctcgcgccccacccagttcgtcgtgc

SEQ ID NO: 617945 - DNA, 253 bp, Homo sapiens
agtaggtcagatgatgactggttgaagaagtttactgggaagacgcttgaagagaataaagaggaagaagggtcaaagcctcccaaagcagagaaccaggagggagagcccattgctaaaaaggcccggtcaaatcctcaggtgtacattgacatcaagattgggaacaagccggctggacgcatccagatactcctgcgttctgatgtcgtgcccattacagcagagaatttccgctgcctgtgcactcatg

SEQ ID NO: 617946 - DNA, 1344 bp, Homo sapiens
cacctcttccccatctttatctctgcctcattacttaattcttgtccttatttgacattgggatttctaaaataacctcttactggtgttcctgcctccagttccttccttttactgttagcagtgtagtctttgttaaaccccaaatttagcacgtcaccctaacttaaactcctgactgcatacaggtagaaatcaaaattccccactaaagcccatagggcctttaatgatgtggtctgggcctacctctccagcctggttctctaaccactgtcccaccctatatctttctgttcagtcttacaaaactatttcataaaaattttctcacttctctgcctttgcacaggctgtttgatatacctggagtaatccccaccattgattcttttcttggcaaaaatctatgtaaaacttatcatctgtggcctggaaacaatccataacttctactgttctggattacgtgacttttagatgttctgtagttctttgtatagacctctctcaaaactggtcatatgacatttaaatgtctatttcatttgtgttgttttgccccttttacactgtgaactctctaatgggcgggcccctttttcatctatttctgttgtgttcaaacctgggaacataaagtcttaaagagtgtcacttctcaagggtatttaacctcccgaggttcacatccatgtgcggacaaggtccgcgacagcgcgcggtcggggaggaagtcgtccgccaaacaggttattctgcagaaccacacacaacagcaccttcgtcctgggggacacacaccaacaacaacaaaagacaagaacgacacaaagaacgcacgcacaaggacaaactggagacaacgccgcggcggcgcgacgacgaaaaaggaagaatgagtgcaaaacgaagagcacaagcgacagcaaagacaacaaggaagcacacgaagaacgagcacaggaggagaagcgcagagcgctaaagaagcggcatgccacggagcgcagcggagaaggggaagacgagcgacgacagagcaagaaagcgcagaaaggagaaggcggacgggcgagaggacgcaaaaagaaacacgaaagaagagacacaaagcgaaagaaagaaaagagggaggatgacgacagagagggacaagacagacgagcgaaggagaagagaaagaagaggaacgagaagaagcacaagagagggcgaaacaaagaagcagcgagcgagaaggaaagagagagcgaggacacggcgaggagaagaagagagaggcagaagagagaaagacaggagagagaagacataggaggacgagagcgaggaaagacagac

SEQ ID NO: 617947 - DNA, 350 bp, Homo sapiens
tcgtcgaatgcagattctagcccttcacaactcacttctcctcaccaagggcttcacttgcaccactgcagtctgcctttcaacagtcgtgggagacacagaccagtccccattttacagatggggaaaaaggaggcttggggaactccttggccagaggccacagaggcctcccagtgggactctgtgctcggcaaagaagggaatctggggagcaggcaccctttagagaaataatctgcatcgaacatccacaaaatccagcaggaggccaccaggagctgacccccatgcagagaggaagcaccagcactctgggtgagtgaggccaaggtcacggtcagtcccca

SEQ ID NO: 617948 - DNA, 279 bp, Homo sapiens
  misc_feature (28)..(28): n is a, c, g, or t
aaggggccccttttcccccctagaacantaattccccagcccccctgccagcagcagcaggtgattggaccaggccatttttccgccccctccttaaccgcacaggtcaggaggggcccttgggttttgtgataagctgatttgcggatttcagcttttaaaagcctttagctccagggaatccaagcctccccagcgagggcaggtggtattttttttcctaaaaagaggatttttataccaccccccccaaatggaataaaagggttgaagctgtga

SEQ ID NO: 617949 - DNA, 831 bp, Homo sapiens
  misc_feature (769)..(769): n is a, c, g, or t
  misc_feature (776)..(776): n is a, c, g, or t
ataattgctagtagagcctggtttaaatcggccgatggttggacgatggcggcggcagctgccgccgggcctagcccggggtctggacctgggtgactccccagaatgggcccgatgggggaggctccggagcgtcggctggaatggctgcactgggatgctgaatgctttactactgtgcctctcgtgaagtgggaggcggcgtggacgcccctgctggtggccctgaccccctggacccgactgatctgaactggggctgcacttcgacccggaagtttacctagacaagctgcgtagagagtgccctctggcccagttgatggacagtgagactggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccactgctgcaggaccgccacgagctgcatcaccaagctggcaggggtccactgcgctgctgcgggaagctgcagttcctctttgagctgccctcgcggcctcaccaagtgcgttggaacttgggctgcctatgggcaggcgggtgcgctaccagtggccgcgcgcaggccgtgcttgcaggcagtaccaacacctgccctcgttccgcggccatccaggacgactgccaggtcagtcacntggccgnctggcccagtcttgtggcagcgctttcgggggtggcggtcgtgggcccggacagg

SEQ ID NO: 617950 - DNA, 535 bp, Homo sapiens
  misc_feature (33)..(33): n is a, c, g, or t
  misc_feature (83)..(83): n is a, c, g, or t
  misc_feature (94)..(94): n is a, c, g, or t
  misc_feature (96)..(96): n is a, c, g, or t
  misc_feature (159)..(159): n is a, c, g, or t
  misc_feature (164)..(164): n is a, c, g, or t
  misc_feature (167)..(167): n is a, c, g, or t
  misc_feature (170)..(170): n is a, c, g, or t
  misc_feature (203)..(203): n is a, c, g, or t
  misc_feature (206)..(206): n is a, c, g, or t
  misc_feature (247)..(247): n is a, c, g, or t
  misc_feature (250)..(251): n is a, c, g, or t
  misc_feature (259)..(259): n is a, c, g, or t
  misc_feature (293)..(293): n is a, c, g, or t
  misc_feature (302)..(302): n is a, c, g, or t
  misc_feature (304)..(304): n is a, c, g, or t
  misc_feature (324)..(324): n is a, c, g, or t
  misc_feature (326)..(326): n is a, c, g, or t
  misc_feature (338)..(338): n is a, c, g, or t
  misc_feature (410)..(410): n is a, c, g, or t
  misc_feature (413)..(413): n is a, c, g, or t
  misc_feature (417)..(417): n is a, c, g, or t
  misc_feature (428)..(428): n is a, c, g, or t
  misc_feature (468)..(468): n is a, c, g, or t
  misc_feature (525)..(525): n is a, c, g, or t
tctatttattttctgtttttttcctcttctggnagctgattaatctagttatatactcggatgatgtacctatggtgctagtnggaaacaagtntnatttgccaacaaggacagttgaaacaaaacaagcccacgaactggccaagagttacgggattncattnatnganacctcagccaagaccagacagggtgttgaagangcnttttacacactggtaagagaaatacgccagttccgaatganaannctcaacancagtaatgatgggactcagggttgtatgggattnccatgtgtngngatgtaacaagatacttttnangttttgtcaganaagagccactttcaagctgcactgacaccctggtcctgacttccctggaggagaagtattactgttgctgtnttnagtntaaaagagaanctcctgctacttccccagctctcagtagtttagtacaatnatctctattttgagaagttctcagaataactacctcctcacttggctgtttgaacanagaatgcacc

SEQ ID NO: 617951 - DNA, 166 bp, Homo sapiens
ttaatctattgtagagacgagtctgtttggtgcctaggtttgttcagactcctggctcaagtgatcctcctgtcttggctcccaaagtgctcgattataggtgtgagccgtggtgcccagccgacaaccagaactttccgcagaccttgtgcctttgtcgtcggct

SEQ ID NO: 617952 - DNA, 985 bp, Homo sapiens
caagattgtgccactgcactccagcctgggcaacacagcaagactcccgtcaccaaaaaaaaaaaaaaaaaattaattttctttcttactatatttggcaggaatcgatattattatcttgttttttcaaagtttttttttttttggaagatgggagtcgtgggctcttttcacccagggctgggagtgcagtgggcctgatctcgtgctcactggcaaggcttctgcctcccggggttcatggccattctccgtgcctcagtttgccgagtacgctgggactacggggtgcccaccaccacacacagcttaattttttgtggatatttttcaaggtagagatagggtttccaccggtgttaagccaggagtggccataatatcctccgtgacctgtggtgtggttcttgcccaccttcggccttcccaaaggtgctgggagaatatatagggcgtagacgccaattggcgcccgggcccgaatatttatacatccttataaagcgcaaacctgtgaggcgaattcgcctatggtccctccagatattcggagatattctgggacaccctcccagtgtctcggcgctctgttatagagacaaacaccattttattataaagtctggggtccccctttataccgtgctaacaccatttaaagcaaggctaacggaaacgggggcttaatattctgccgtcgagcaaatgtgccgagccccaagacaagaggttcttacagacgcatcatgtatgctccgagccctcttcaacttcaaacatgggggagtctcgacgtgtgtcacttttgcgaaaggcgccccttttctgaatccgttaacaccctgggtgtcatagcccaaaggaaatgtctctaagaaaccgcccaagggggtgttgtacatttcttgaaattgcagtgtggtgggcaccccaagagggttcagctatttatacgagaaagccaacccccttgaagaccccccaa

SEQ ID NO: 617953 - DNA, 304 bp, Homo sapiens
gtgactctgaggatcgcctttagctctctctgacggggggcgggagagacgctcctacctcccagacggggttacggccgggcagaggtgctcctcacatcccagacgggcggcgggcagaggtgctcccacatctcagacaatgggcggccgggcagagacgctcctcacttcctagatgggatggcggccgggcagagacgctcgtcactttccagactgggcagccaggcagaggggctcctcacgtcccagacgatgggcggccaggcagaggacgctcctcacttcccaaatggggtgg

SEQ ID NO: 617954 - DNA, 121 bp, Homo sapiens
ggattcaggagactacgcgcctgttcaggtgtgatgtgcagcaggtccagtgctggtgtgtggatgtgagagcagaatgtgtgtgagcatttgagtgtgcaagtaggtgtctgagtggttg

SEQ ID NO: 617955 - DNA, 337 bp, Homo sapiens
  misc_feature (32)..(32): n is a, c, g, or t
  misc_feature (71)..(72): n is a, c, g, or t
gaaaatccgtctcaaccaggaaaaaggaaaanaagaaaaggaaaacttgactggcctttggggacatgctnntagtcccggcttcttgggaggctgaggcatgagaaaaaaaataagcctgggaggtggaggttgcagtgagttgagattgtgccactgcactccagcttgggcgataaaacaagactgtctcaaaaaaaaaaaaaaaaaaacttattgagagaataatataccactaatatttaaagaaatttttggctggtgccgtggctcgcacctgtagtcccagcactttgggacgtccaaagtgggcgtataacttgaaggtcaggaagtt

SEQ ID NO: 617956 - DNA, 321 bp, Homo sapiens
  misc_feature (283)..(283): n is a, c, g, or t
cttcatggagggtcggggttaaaataaggcattgtggccaaatcagcggtttaaatatgaggcacgcagtcggggtttacccatgctgggggctgggtgggggtcataaggctacaggcacaaatggtccccaggtggacaaaatttggagcagaaaaaggagaagaaagggtgccgcaaagcagttgggttcaaaggccgggggggccagcccagggtgaactaggcagaaagctcggggggggggttccagcagggaggggaccaggatctctgtgctctnccctttgaatctctgggtcgccagctctcccagggcct

SEQ ID NO: 617957 - DNA, 326 bp, Homo sapiens
  misc_feature (166)..(166): n is a, c, g, or t
gttttaaaaaaaaccccccccccaagtttttttttggcaggggcccccccaagagtttaaaggttcccgtattttaaatgggcccccgggtttttttggcccaaagccctttttttcccttttttaaaaaacccagggggcccacccattccccccttttttaaancccggggggggggaaaaaccccccttctttttttcccaaaaccgggcccccttttttgggtggttaattgggttgggggttttcccctttttttcaaagaaccttttttgggaatttttttccctttcccccccccgtttattaaaaaaaaagggtttga

SEQ ID NO: 617958 - DNA, 961 bp, Homo sapiens
cgtgacgcgtgggcaaacccactcctaccgttactaccagacaaccttagccaaaccatttacccaatataaagtataggcgatagaaattgataatcctggcgcaatagagtatagtaccgcaacgggaaagatgcaaaacattataaccaagcataacatagcaaggactaagccctataccttctgcataatgagattaagctagaagataagctttgcaaggagagccaaagctaagatcccccgaaaccagacgagctacctaagaacagtttaaagagcacacccgtctatgtagcataaagtagtgggaacgatttatacggtatgatggcgacaaaagctaccgagcctggtgatagctggttgtccaagatagaatcgttagttcaagcttgtaaagtttgcgccacagaaccctctaaatccgccttgtaaatttaactgttagtccaaagaggaacagctctttggacactaggaaaaaaccttgtaggagagagtacaagaaattgtaacacccatagtaggcctaaaagcagtcaccgaattacagaacagcgttcaagctcaacagccgactacctaaaaaatcccaaacatataactgaactcctcagacccaattggaccaatctatcaccctattagaagaactaatgtgagtataagtaacatgaaaacattctcctccgcatagcctgcgtcagattaaaacactgaactgacaattaacagcccaatatctaccaatcaacaaacagtccttattaccctcaacttgtcaacccaaaaacaaggcatttgctcaatagcggacaggtgaaaaaccacttcacagggaactcggacaaatcttaccccggactggttaccaggaaaacattcacctctaagataaccaggacttcaaggacacggtgaccaatgaacaatgtcaaacggcggagaaccaaag

SEQ ID NO: 617959 - DNA, 359 bp, Homo sapiens
atcgggtacatcgacagttgtgggtgttgcggttggttggggagaggatcgagctcagatttcccgtggcgcttgtcgacggcgagcattgatccttggtcggagaagctcggggtgcgtccccggccgatgcgccttcatcgacgtcttcatcccgtcctcagggacgggtgactattgcggctcgtttgaaagcaatcttgcgatggggcttctccagatctgcggcggccatgatgtcttcttcgacggcggcgaccggcgacggatcgacgatggcggtcgttggaggcttctggcgatttggggaatcacagggtccagggtcctcaatgaaatttatgtttttcttaggggcc

SEQ ID NO: 617960 - DNA, 481 bp, Homo sapiens
aggagataggccgcgtaccctagcgctaatagtagcggcgcctggactatcatacgagaagcccgactatagactacctagcggaaagttactatacaccgacctactatcgaccgcagtgggctaacgtagtatcgactaatagagtaacgactagggcccgggaagcccttgccggacccccaatcggcaccgtccacaccgacctagccctacccagcctacagctccgggacaaaacccagccgcacagcaaaaaccaggcgttgaactaccaccaacggggagctagaatagcggacgaccccacggcccggccaataccaacgccccgatcacagcgcctagcagaggtaggaggtaggccgatgaaaccaaatgctgctagtaccttcaagaggagaaagagaaaatcgctagcagcaacacaagtaaccctgggcgcgtagaagccccttgaatctaataccgtgcagcccct

SEQ ID NO: 617961 - DNA, 364 bp, Homo sapiens
aaaaatgaaagatttttcttttttccactgtgaaggccagtaacacattcttccccatgggtgcaactgaatgatttatttagtacattaatgtacttaattataagtgtttctggaaagctgaatttgcacataaccttattttgaaaaacgcggtttatgaaatttggcactaaaattattaatacacattaagtttcatataatcaaatgtgaatatcggttgtcacagttttaaacgtcacagaaaacacctttgaaaattaatatagtgataatagatatgtcctgtgttcgctgttaaatttaagcccaagcacaccacatagagtgatcccatgagtactcatattgtgatgtgtgc

SEQ ID NO: 617962 - DNA, 749 bp, Homo sapiens
gcttgatgatgcggttgagggagaggagcatgtctgcaagttcgagtcaagaaagtgaagagatggacagccaatatctagtgctcctgagtagtacctagagaggttccgtcgtgcgatgtaaagtccatgtcggttgtggtgcgatcatgaactaagctacgaaatagttttaatgtgcgacaatactcggagtcaaatcaccacgcgttctacagaaaacatcgcatgaggcctaagaggaggggaatgagagagagtaaggagaagagaagataaattctacagtaaataaagatttagaaagacagaaagaggtctcgaagtaacacgccattcagatcatatcagacgaggaagaggaagacctaaaagtgcatctgcaaaaaacatgaggacagaaagagagaaaccaggcaaccaggcaaacttgaccatctatgctaacctgtcttgattgacaaaggcttcggtggttgcagtcggccttggcaagaatgtaaatgcaaaaacttatccaatcaaagacttattctctgatacttgttttgcaaaatctggtgaaacgttcttgtcaggataacatcagcaaaattctcaaacagttatggactctccaggagcatttcttgactgcatcaaatacgggccatcgattggtttctttctcgccttgtcgtttagcctgtgccacacttcgggagccaagctgtgtaagctggcacctgtccgggaattccttgtttacc

SEQ ID NO: 617963 - DNA, 223 bp, Homo sapiens
acggcagagctgagagacaacatggtatattaaaacacacacacacacacacacacacacatatcagcagtcagatctggctgaagactaaaggtggtgtgcaggaaaacacaggtgacgcaagaaagataggcagaggctatacgtggacggtcctatagtgataagaaattaacgactttttctcatttaacgctctccggacacccactcagaatgtatg

SEQ ID NO: 617964 - DNA, 145 bp, Homo sapiens
  misc_feature (136)..(136): n is a, c, g, or t
tccgtggcggtcaaccagcgggcatttaacgaggtatgtaacccgactcatattggcatgactatgacccgaatgatactataatactatgatgcggaaatcgttatcacgatcaggttaccgaggaagactgtgncaaagcccc

SEQ ID NO: 617965 - DNA, 97 bp, Homo sapiens
catggatttgctggtgcagtacaactaggcttaatagggactcgaattcaaaaaaaaacgttagaagttgaattcgagcctagaattcgaaaaaaaa

SEQ ID NO: 617966 - DNA, 979 bp, Homo sapiens
ggtgccactgaagatcctggtgtcgccatgggccgccgcggccgcccgttgttaccggtattgtaatgaacaagcgctgtatccaggagagtctcgctctcgtgacctggaggtagtccctgcatgccgaagatacggcattttatgaccgtggggcggaaaacaggcaacaagtggatgagttgtccgctttgtggccacatgtgtgtcatgatgactatgagcagctgtcctctgaagtccctggaggcagcccgaatttgtgccaataacgtacatggtaaaaagttgtggcaaaagatgcgcttccataatccgggtgcggctccaacccattccaacgtcgatccgcatcagacaagtatgtccgtcctagtgctgggagctgactaggctccaacacaggcatgctgaaggtgccttttgtgaaagccacctagagtcacatgtggccagtggttcacagttgtgccaaagttatcatgtccatccgcaccagatgctgcgagtaacaaggaggcatgtgagttgaaggccctgcgcaggggcagagttcaaagttgtcctggccgaccagcaagatccacatctcaaggaagtggggcttcaccaagttcaatgcgtgattgactttgactgacatggtggctgaaaagcggtcatcccagatgggctgtggggtcaagtacatccccagtcgtggccctctggaccaagtggcgggcctgcattcatgagggcttcccaatgtgctgccccctcttaatactcaccagtgaattctacttcctgtccatatccacatgtgcaacgacaaatcgcgcggaccggtgactgcagattggcctgcaaaagagtatgtccagtcgccaggggcctcagggtcgtgactggaccatcgttttgtgcacccagcgtgaaactgttccggaccccttgaggaggtcgaagagtccggaaacgccggttccctcttagg

SEQ ID NO: 617967 - DNA, 431 bp, Homo sapiens
ttgaacagatatttgtacactgatgttcacagcagcattactcacaatagccaaaaggtggaaacaactgaaaagtccattgaaagataagtggatagaaaaatgaggtgtatccatacaatggaatgttcttcagccttaacaaggaagaaattgtgatacatggtgcaaaatggatgaaccttgaagacattatgctaagtgaaatagggcagacacaaaaggacaactattatataattccatttttgtaagatcgttagaatagttgattacctagagacagaaagtagaatggaggttaccagagtttaggggagagaaggagttactgtttattgggtacagaggtttagtatggtaagatgaaaaagttctggaaatggatagtgtgatgtgatggttagacatgagtataaaaagacttgatt

SEQ ID NO: 617968 - DNA, 122 bp, Homo sapiens
gtgactgcaacacctggttcacgaattaacgcgtccaggtggaaaatattccgttggatcagtcttgcattggagagtggccaaggctattgctagtcgatcattcagtagcacagtcctgg

SEQ ID NO: 617969 - DNA, 155 bp, Homo sapiens
acacgcgcatcagcagggctgggatgtagtacagtctccatcagcagtatctggatgatgactaggacgacaagaagaaaccgagcaaaaatataaagtgattcccagcgattctgttcttctgcactgtcagactttgtccccatgttgggaca

SEQ ID NO: 617970 - DNA, 172 bp, Homo sapiens
tcctgcgggtctagtctctgttcctttgcctggtccacccttgccctccctgggtcgcagccgaggtcgtgctcgtgataccccggagacagcgcgcgtccctcttgtgcggttcaccacagtatgtatttaatgtgatcgtagtgagtcgtcgttaaatgcctgtatcccc

SEQ ID NO: 617971 - DNA, 274 bp, Homo sapiens
  misc_feature (274)..(274): n is a, c, g, or t
aaagcataaagaagaaaagcacaaagaagaaaaacataaagagaagaagtcaaaagacttgaacagcagctgattttgttaaacagttgaaggaaaagaaggaaaagaaaaagccaattcagagagccagaggtgtcctctagattttatgtttcccaatctctaaaccccatttttttgggatttccctttgctctattcagtgagagagggaccccatatgtatgatgtcatattggcctttccaaacccttttccgcgttatgtatatagn

SEQ ID NO: 617972 - DNA, 177 bp, Homo sapiens
  misc_feature (10)..(10): n is a, c, g, or t
cctggggggnaatgttttcccctccccccccccgtgggggagaaaaaaaaaggggggggccccggggttttttttttttttttaacccccccgggggggggggggggggggggccccccttttttcccgggaaattttttttttttttttttccccaaaacccccccctttttggga

SEQ ID NO: 617973 - DNA, 685 bp, Homo sapiens
aagtggctggctcatttaagatgaggcttctgctgctgtctcctagtggcggcgtctgcgatggtccggagcgaggcctcggcaatctgggcgggtgcccagcaagagattacagatgcgggtacgccacggggccgcgtgtctcagatgttccagatttgtgttgtcctgaggttataggcgggtgtagagggagtacatgcgggttattggagccagcgtgtacccagacatccgctattgaaggagagaattacctccctcaaaccaatatatagaccacataggcagtctttgccttgtcaggtcttcaaactagtattagatagggcttacctaactgtgtttggcaagggatcctttgtgctgtcttgtggcatgcagagctccttaagcatcctggcagtggggccaaggaaaataaggttgatggcagtggtatgattggttttcttcctgtgagcaagcatgattgtgaagaaccacgtgtttggtcaacaggtgcatttgagataactttgaatgatgtacctgtgtggtctaagctggaatctggtccacctttccatccatgcaaaactgtgtgcaattctgtgacagtgaaatgagctcaagtgcgtatgggattcaatcccgacatcgatcataggggcaactatgagactgaaaactctttgccgtaagg

SEQ ID NO: 617974 - DNA, 171 bp, Homo sapiens
tcatagcattttctggacaaactcagacctaacggtggtggagaaccaaaggggagttgctggaagacatcaaacgtgactttggttcctttgaccagtttaaggagaagctgacgagtgcatctgttggtgtccaaggctcaggttggggttggcttgggcgtacgggga

SEQ ID NO: 617975 - DNA, 900 bp, Homo sapiens
tgttgtagatagccagtcaaccagcagtattggtgctgtggccaagagatttaagctctatccgatggggaaattatctaacatcatttgccctaagcattgacacatagtcttcatcctgatggtgcagatagtggtgcaagcatgtatagtagtctgcacgtgtgtcttgtctacagaaaagtgaataatacaggtgtttacattgaagaattttatagctttgagtaactagcgaggaattccgagtgcagccgggcgaggatgagtcatatattctataactctccgtgaagattgatccagtaccaccgagaagttgttgggcattttttcgtattccttcttcacataggcagggttatcaacagagtgtgctattcattttgtacagtgtcatattacagtgaccaaggtagaatgcctcaaatgctatttattgtattccagcccagtacgttatagaagaacgtttcaccagaatgagcctccagagctgggaatcctaccacaagatctaaagttctggcgtgtccattaacctccaactatgggcttcatttctggtggtaatatgatgtgccttatactgtggcataaatccgttcctggttgtgtgtcagcgttatgtagatgtcttctagatgcagacataagttgtaagtatgtctagtaacatgaactttgaaaacttattgattattccactaatgtgagcatggcagattaaaatgtacattcataattcttaacatacccaaaaaaaaaagaaagaacaaaatttgggcccgggcccaaaattttaaacaggtctggggggccctgtaaaaagggccgggcaaaaacggagaaaggggggtcacaaacaggggcaggctaaaacagggggggtgttacagc

SEQ ID NO: 617976 - DNA, 263 bp, Homo sapiens
  misc_feature (1)..(1): n is a, c, g, or t
  misc_feature (44)..(44): n is a, c, g, or t
  misc_feature (72)..(72): n is a, c, g, or t
  misc_feature (83)..(83): n is a, c, g, or t
  misc_feature (156)..(156): n is a, c, g, or t
nttcttttttacagccccttggttgtccggaatcgcatatgcgngatcaacctgaaatcgggagcataccanttgccttgcanactcaatactatttattttggggagggggagaaatttggaaaatttgtttttggaccacccgggggccaccantttaaccaagcggtggggggaaaaaaaaatctttctttgaaaaaacccctttggagggggggtttttttcccccgcctttaaaatttttttcaaacaaatttttttg

SEQ ID NO: 617977 - DNA, 553 bp, Homo sapiens
  misc_feature (33)..(33): n is a, c, g, or t
agctcggtacccttcctaccagcaaagacaggngtttgacatgcaagcgtatccattcttcaagatcccattatatcattcaataatacctcagcttgtgggctgtatggcacatggaatccccactttatgtccatttgctgtgcccatcattgtacctgttgtccagtgaaatgtgttcctaaaagggcacaggtggctccttgggcagcagttatgtctaaggccacttggttttgcaacaccactttttgatctgatcaacctcattcattaacaggaggagggacactcaggtgtaattcagagcctgagcggtgtgctccgcaagagcagtaaattgtgcttctacagttttgacacctgctccagggatagtcattgccaaagggtagaaacaccagggggctcatcacattcgcaaaaactgagagcacagtgcctcccagttatacaggcatctgggcaatgtggggagaacagtagcaggtacataaggccacccccagataaaacatccactccagtttgctgataggaaaggctactgtgt

SEQ ID NO: 617978 - DNA, 345 bp, Homo sapiens
tttccaaaattttttggcccccccctttttaaaatttaaaagggaaaaggtgccccatttttttgtttaattgggccaatttttggttttttttaaccgggttttacccccccccaggaaattcccccgctggccctcgccaaagggaaacttaacctttttaaaggcagccttaaaaaaattaagggcccccccccaatggtttgttattatccccgcccccgtttccctttttaaagaaacccccggcccttttcaatttcccgggcataaaaaaaatatcccccccccccgccactgccccccccgaatttttggtttttttttaaaaaaaaaatgggggca

SEQ ID NO: 617979 - DNA, 250 bp, Homo sapiens
cgggagccatggatgcgcggccctgtgtggcccgggggcgctgggccggggtggtgcttcccacggcactgacatggagacctgtggttgcgaggctccctggggctcggcttgtgaccgctgaatgggtgctggtgccctggcctcctaactggggctgctgtactggggcgtgtagctgggtggggctgctctccccgctgccctgggactcggagcagccccgacccctctgcctgcccgtggccag

SEQ ID NO: 617980 - DNA, 232 bp, Homo sapiens
cagccagccactacctacacttcctcggggtgccctggacacacacgactcaccaggaaacaaaggaacacctcagctcccacagccactctcagacctgcccttgctgcactccccaccacgggcagcctcggtctctatgggtcacagccaagcagctcccccctcgcttttctgtcctcaccacttccaccaggggccctaataaagatgtcaaaccagaaaaaaaaaa

SEQ ID NO: 617981 - DNA, 249 bp, Homo sapiens
gtcagggacccatctctacacaaaaatacaaatattagccaggcatggtggcatgcacctgtagtcctggatacctgggaggctgagatgggaggatctgggaggatcgcttgagctcgaggaagtcaaggctgcagtgaacgaagatcatgccactgcactccagcctgggctggacagagtgagaccccatctcaacaaaaaaaagaaaaaaaggagagctctttgactcctacctctccctctcat

SEQ ID NO: 617982 - DNA, 307 bp, Homo sapiens
gaattgtgtggtgttatgttctccttgtgcttgtagcagtgtttgctcaataattttgtaagaagcattgatatgtcgatgcatgagcagctcggcaagttcaccatcgccttctgcaatcgcatctaaaatacggatatgttcgtcccaagctttgcttggacgatcgggtgtgtttgaaaactgaattcggtacatacggatgagatgataaagctcatcacatagcattttttctagggttttattgccactacttttgataatgcagtagtgaaaatcgtcctgcccataacaccacacaatt

SEQ ID NO: 617983 - DNA, 216 bp, Homo sapiens
tgtgtttgtttaccttcttgtaaggtacgagtacccatcctccttagttatagcacttttaccggtatgacgggttccattaaatgtctaagttacggtatgggtagttcaatggttacggaaagaaatgtcttaatctttttgatgaaatttcaagtaataccttggtttttttctcgggcgtaacggttcagtaaggattcggttttttttttt

SEQ ID NO: 617984 - DNA, 166 bp, Homo sapiens
gcggcagactcattaaaactaggcggctatggtataatacgccgtcacactcattctcaagcccctgagaaaagacatagccgaccccttcctatgtactactccgctatcagacataacttataacaaggctccactctgccgtacagacaacacagcaccttaa

SEQ ID NO: 617985 - DNA, 575 bp, Homo sapiens
  misc_feature (99)..(99): n is a, c, g, or t
  misc_feature (114)..(114): n is a, c, g, or t
  misc_feature (228)..(228): n is a, c, g, or t
tcttaggatcccgattgacgcgtctcctgctctaaggacagaagctctctctcagacacatctcatgggcccattcaggacacttctgagtacatcatntcatgtcatcctgtngcactgatgaaagaacccttacagttcaggtttcctggaacttctaccagtgccactctgacaggcctcaccagaggtgccacctacaacatcatagtggaggcactgaaagancagcagaggcataaggttcgggaagaggttgttaccgtgcgcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggacagatgatgagctgcacatgtcttgggaacggaaaaggagattcacgtgtgacctcatgaggcac

SEQ ID NO: 617986 - DNA, 888 bp, Homo sapiens
  misc_feature (798)..(798): n is a, c, g, or t
cgatgacagatcgcgcggcgcgtgccacgtggtgtggctacgggtcactccgggttgctcagaagctcatctatgggcactgtgaccactacgacggcgtgagaaagttgtggaagctggtccgccgagcatggactagcaaaactgaaacagaatattcgtgatctacgtccaggtgacaagatccagagctggatagcacagtgcttgtctgagagcgaggactctctgcttatagaagatcaccagctttgtgtctcctacacgtgggttcccccagatgggtgaccacactgaagtcttgaagggcattcgagcaacgtttcctggctatcaattacccagtccgtgaccgccacagattgtgaaaggcttcgaggcagcgggtagcatgtgtggagccagggaagtaggtcatcttttggagctgcctcagagctctttcactcaatgaaggaacatctaattgttccagtataggagagtttcagaggtttgacgctaatcctgaaggcagttgcagttcagccaatatttctgtgctgggggtacggtctcctgtgctcttgggctgcccttatgaagggaagatctccccaggctaaagtagctgaggtcaccaagaagttctactcaatgggctgctacgagatctccctgggggacaccattggtgtgggcacccccagggatcatgaaagacatgctgtctgctgtcatgcagggaagtgcctctggctgccctggctgtccacttgccatgacacctatggtcaagccctggcaacaccttgatgngcctgcagattgggagttgagtgtccgtggacatcttctgtggcaggacttgggaggctgtccctacggcaagggggggccatcaggaac

SEQ ID NO: 617987 - DNA, 161 bp, Homo sapiens
atcgaagagcggtgcgtatctcattcccttacttgaacggctagacctgaagaaggaaaatatacaagcaatggtgattgttcccactaaagaacttgctctacaggtcagtcgaaatttgcattcaggtccagcaaagcacatgggcacgggcccaaagt

SEQ ID NO: 617988 - DNA, 631 bp, Homo sapiens
atctgcaaggagaatgcccaccagccttgtcctaataaaattaagttgtatcattaaaaaaaaaaaaaaaaaaaaaaaaaaaaaaaaaacaaaaacccaaaaacaaaaaaaaacaaagcaaaacagaaagacacaaacacaaaacacacaagattgcaaacaaaagaaacaacaaaataaagacgcgagggcggcgcgcggcggcgcacgcacgcgggagcagacaccgccgacgccacacacgtgagtaagagagagagagggagaagcgagaaaaggatgatagtaggagacagaagcggagcgcgagatcacatacaatagagtgaagagacaaaaagagacgaagtcacggggagggagagcagagacggagaggcggacggcgtcaagcaacgccaagaaaaaaaaaaacaacgagggcgaggactacaaagatccagcgattcgaccattaaacaggcaaaagaacccccaaggcagctgcgtcaccgagaagaaatgaaacgatatgcgaggaccgacaaagaagagaaggagacgaagtcacaagacggcgccggccggcacgaaaaagacaaaaaacagaacaggacacacgccgcgaaccacagcaaaacccgaacaccaa

SEQ ID NO: 617989 - DNA, 404 bp, Homo sapiens
ccagtgaatcgagctcgtgtaccgtttgccagcgagtgctagcgccgccgccagctgccgggtctcgccctgcatgtcggcgggcagcttgttcggctccaggtcggccgcctcggggtggcccgggtcccagcgcgagacgcgccgtgccagccagttcaccggcgacaccaggcgcttggacgcacggtaggtcacccagctggcgccatacaccgccagcagggtcagcagcaccggcacgatgccgaaccagaacgccagcatctctgcgcgcgaacgcaggaacaccaggtacaggcggccggccgggcgcacatcgaccagcaccagctggtcgtccttgggcagttcgtggaagccgggttccagattgcgcaggttggccggtaacgacagtgccg

SEQ ID NO: 617990 - DNA, 1454 bp, Homo sapiens
ggagcaccctggaggtgggtagcgctcctccagggagcacccatgcccaccaagaagcacatgggtgaccagcgtggcagactcgggaccaatacgtactgacgtcctccctgatcccaccaccctccatcccccagaagtcacccattatcttcactatattatcgataagttatagcctctagacagataccacagggcgccaacacacgttaggactaggatagacaagaaggctacaggcaacatacacacatcgatacaacagacgacactgaacacaatgcatgataatggcacacatgggagaatccattcaccaacaagagaagcgggacccaagacgacatgacgggaccacttacaaaaaagacacagaagattgccaacatgcacataaccaaggaatgaccacataacgaactgccaccgatgagagagaacccaaaatggaccatacgagagacgaccaaggtggactagggaatgccaattcaaaacaggaaatcgcggtggccaatcgggtgacatccggacaggaacggacatacaacgaacatcatggacaccagacagagccacaaaaaaaacaaaggaccagaaaaagaaagacacatcacacaaaaaaaagcaagaccaggagcaagaggaaaacacgggccacccaaggaacaaatgaccgagatgcaaccagcccgaatccaaccacatatacacaaacaggggcaatcacaaatcattggcagacgccaacagatgcaaccgggacacaatgaacataacgacaaggagcaaaaaaataacactgaaacgaggcgaaagcaaaacaccaagggataacagaaagcgctcggaatgaaaccaccacagaaaaggaacaaccccaatggccaacaagaaaggaggaaacatacaatgaaaaaaaaacgaacagcaaaaccagaacgcacaaaccaaacacaaacaaggcagttctacagcaaaccaaaacagcaaaacagagaacaaaaacaacaacaaccacacacaccaccagaattgaaaaaaacaggaaattataagcaaaaaaacgaaacaacaagagacacacaaaaatgcacacaagacaacaaacatacaccacagcaaacggagacaaagaacaggcccaaaggcgaaacgacaacaacgggacaccagagccacccaacaagacaggaacaaacacaccacagaagagacaacaccgcacaaaaaaaagaagaaacaagacaaaaaaaacagaaaaacgaaaaaaaaaaaaaaaaacaaaaaaaaaagagaagaacagaaaaaaaacaggagaaacaaaaaaagaagagaaagaaaaaaacagaaaacaaaaaagaaaagaacaaaaaaaagacaaaaacaaaacaagcagaaccaaccaagaacaaagtagcaacacaacacaaaacaaaacgaaaagaaaa

SEQ ID NO: 617991 - DNA, 246 bp, Homo sapiens
  misc_feature (97)..(97): n is a, c, g, or t
cgggtttttttccaaaggggtgggggtggcccccccccggggcctttggttaacccaaaatttggggcccttgggggccgggttcggcaaaaggganaaaagggcaaagcccgggttcggggggttttttcccctttgcagggggccttgggcccccctttccttccaagcccccttttggaggtgcccccccccccgcccggggtggggtttgtttttggggttttaaaggcccttttttttcca

SEQ ID NO: 617992 - DNA, 298 bp, Homo sapiens
acgttaagaataaaagtttagaaagattattggttatttagcttgctggtgaagtgagggttgacaacatatctaaaggtgtatagtatgttccaaattctttctgattataaagtacaatgagcctaacaatgtttcacaaattgtgcaaggtctcctaatagctatttttcaatagcaatatgctgtccagccctgtaaacaatttttgactgtcttgcagaatagctgaccaggcctttcaatctacaacagcatgaggttgctttaccaagttccctagtatgagctgcttttt

SEQ ID NO: 617993 - DNA, 198 bp, Homo sapiens
ccgccttttgggcccaaaatttgggttttgggttttttaaaaaaaagggtttttttattgccccccccgggggggaattaaaacccccaaggggggttttttttttccgtttttggtttttaaaggggagcccccccccttttttcctttgggggcctgggggatttttttttttttccccctccccgggttttttga

SEQ ID NO: 617994 - DNA, 162 bp, Homo sapiens
ggagtcacataacaccaggtggaaaagatttgttactaattccagggaagaaccattcacatagtgttggttaaatggtcgcctgcgttcacacttcagtgcctgtagaccagagccctggaaacaaaagggttacttgtttccccaccatcgcctttacca

SEQ ID NO: 617995 - DNA, 104 bp, Homo sapiens
tagaagcagcagcaggattactctgcttcctcgaccacatcctgtgacgaggaaccgatcgtgaatagggtgctgtccgctgccctgctcctgtgtcgtaacac

SEQ ID NO: 617996 - DNA, 382 bp, Homo sapiens
  misc_feature (11)..(11): n is a, c, g, or t
gctcgtggggnatggaacaggaactgacatgatcaaagttacagtacagtaggaacagaggcagccagccaatttggcacagttaactgcaagtacgtcaagccattcactcttctcgaacccgggcatgccaactgtccagcacagcaccttaaaaagcagaggcacaaacgtaggatggttggaccatagggcgggggggtgcgggattttttataagaaatgccatcttaaaaaatacggggtggtaaaatgtggccaggtaacagactgacaggtttttttttttcaccaccaaaggttcatttgttgcaaccatgacaggtcagcatcataagggcatcctcgtgtcccgagagacttctcatcaaaatgtgccccg

SEQ ID NO: 617997 - DNA, 193 bp, Homo sapiens
tcaaaacgtatcagaacctcccgggttcagcaattctcctgcctcagcctcctgagtagctgggactacaggcccgtgccaccacgcccagctaatttttgtatttttagtagagacaaggtttcaccgatgttggccagtgagggtctcgattctcgttgaccctcacgatcctgccctgcctcggtggtac

SEQ ID NO: 617998 - DNA, 317 bp, Homo sapiens
agaagaccaagcagcagcagcagcagcagcagcagcaccttccgcagcagcaacagcagcaacaacagcagcaacaacagcagcaacagcagcacattaaagggcttacatttttctgcttcaccattaaccattgattgctattttttcctttggcagttagctaggtttctggttccccacatagggttttcacattagagtaggtgccttttggagatagttgcagtgtttatagggtagtttttggagatctaggtattttgcatttgctatttggtctgcccactggatatattccgggttatggtaatggt

SEQ ID NO: 617999 - DNA, 927 bp, Homo sapiens
cctgacatcatcgcagatgtgtaatccataagcattctgcgaatggaaagccatcacaaacggatgattgaactgaatcgccagatgaatcagcaccgttgttcgcctatgttttataatatttgcccatggtagaaaccgggcgcagaaccaacgttgaccaatatgggcacacgtaaacattcaaaaacttgagtgaaagtcacccagcgcatttggctgctcacgacaatcacctctatctctcaaataaaaccctttaaggcgaaaaataagcgacacacggttgtcacacaccgataaagcacggcccaacccattactcggccgaacgtactactgctggtaagcacaaagcttgcccgcaaatacatacgctccgcggtactaattccacttcccaagcatcgtcgtacatgaaaaacggttcccacgatttgggccctcacgtgggacacaacaccgcgttgttaaccacaggggggtgaatacagcattaatcctcaataattcacacaagcatatacacacgatctttttcaactggccccaataacgagaaaactctccacggaacttgcagccacttctcaagtaagacggcggcacacaacagtacttggtgcaattacaaagggcctggaactacaaaaccttggctcacccaaagtattatactatacacgacggtctatcatacaagacacggccccggtacattattcccaagcctgataacaggacaccgtggcattatataagtctacaaatcggactgctaacttgctatgacaccgtgcccatacaacaaagtgtcttataacagaaattgcctcagtcgggtaactatattcacaaagggaggaaataattccagatgaataacgtatcacaccatatacaagataccttatgtaatcccggaaa

SEQ ID NO: 618000 - DNA, 488 bp, Homo sapiens
  misc_feature (185)..(185): n is a, c, g, or t
  misc_feature (479)..(480): n is a, c, g, or t
gtgcccttccagcagctcggccgttccccctcatgctggaaatctaatgtcagcccaggttgctatatgacaccctgtggagctgggtttccccagggcagattaatccaagaaagggaagatgtgaccctctcaagggaggttggggctgggaaggggtgggtagagagagatttgttaaaggntacaaaaattacttagaaggcataagttctaatgttctacagcactgtagaatgactgtagttcaacaataaattacatcatttcaagtagctagaaggaagatacagaatgctcccaacatggagaaaccccatctccactaaaaatacaaaaattagctgggcttggtggcatgcacctgtagtcctagctactcgggaggctcaggtgggagaatctcttgaacccaggtggtggaggttgcagtgagctgtggtcatgccactgtactgcagcctgggcgacagtgaaannctatctca

SEQ ID NO: 618001 - DNA, 312 bp, Homo sapiens
atattttacgttccttacaacgttctgcacagttgccgacttatgacgggtttcctactagagaatatcgagggaaacgggaattttgctttcttgacatcagatcagatcgtcattgctgtttcctgtatcaaaatatttttcaagaacagggatgcacatctcttcaagaaaaagtatgttagaatttgctgtgaggtttttgaaatgtctgaatacggatggcaacagaaatataaagatattttgggattttcagaaacgtaggctgaccctgtattggtacttacaatgaatattccagggcttttt

SEQ ID NO: 618002 - DNA, 299 bp, Homo sapiens
  misc_feature (105)..(105): n is a, c, g, or t
  misc_feature (109)..(109): n is a, c, g, or t
aagccccccaacaaggccgaggggttttggaggcattgttatttgggggaccccagggggcctgttcaaaaaaggtgtcagccacaaaaaaagaggttttagtcntggnttttaccctcctttgaaaaaagttggggcttgctttgacggtttccattcccgtttgcaggcagccaggagggcaggaagcccttgttttgtgttgccatcctgcctccctcttccagcctcagggcattggggcttgggtgggagtcaacgccttcccctttggattcaaataaaacccagtgccctca

SEQ ID NO: 618003 - DNA, 277 bp, Homo sapiens
ccgttctctccgggtcttagaaaaatcgcagtcagtcagtcgaggcgagtagagaatgccagcaagcaggtcgaatgtgtatgtgggttttctgtgagagataagtagggaactagggtctcacattcacatggtcagactatctgcctacacttgagatgtgggaatggggtaacttattagaataaatcaggtaaatgtaccataataaatatgtacattctcttcaaaaaaatcaaatacttgagatcatatctgaaagcaggcccagtagtgg

SEQ ID NO: 618004 - DNA, 130 bp, Homo sapiens
tcataacaccccctgccatcaccccatcaccaaacgcccctcttcgtctgctccgtcctcattacagcagtcctactatctcatagtacactcctccaacgatcatagtacactcctccacgtcctagat

SEQ ID NO: 618005 - DNA, 94 bp, Homo sapiens
tcaagcttctaacgatgtacggggacatgctttatgtttctaccctttactcaggctatcatacaataaaaagtattgcctgttttaataaaaa

SEQ ID NO: 618006 - DNA, 1115 bp, Homo sapiens
gcctcgatgcgcacagatggtgcgcatcctgttactgggcgaggcccacgtggggcacatgacttcgcctgatcctgtccctgggtgggcgagtgtacgttccccgatgaggtccctccccgcgcgggagcgagatctaccagtcccgcgcgggacggtcagcccgggaaaagcgtgcccactcacagtcagtggaactactcaagaataccggaagctaggactggacgatggacgctgctgtggagtgagatcgcatcaacggcacaatcgatggatgtagtgttggtgtaatgaaccgattctacttgcatgcgagcgccactcgaatttgatgaaaggagttaactccaagcttaaatgcagtgagtacactcactatgcgcttgaaatggcggctgcgacctccacagcgatggaggcgctcaaaggatagcaccaatcgatcacgtagctggagacaaacgaagctccgatgaccgtggcccagtcgcggcgaagcgtcaccatggggaggattccggtgacgtcatcctccgtcgagtgcagtaccaacttgtgtccccggacgtaaatggtaataagcccgtgtcagtggttgagcttcgttacgggaccaattgagacccataggaagaaatcacattgtcgagaagcttgattcctatcgtacgaccacaagaacgggctcggtcactggaagtcccgacaacaagagcactacatgtcgtaaatgaaacccatgaaatgcggcccaaagtccaagtctaacagagtgctccacgtatgacgaaccgtcaggatcggcagtgacggtatgccaattcattccagaagacatcgatcaaaatcatggaacccttgggaacaccagagcggcgacaggatgagcgcataggaagcttcaacagcaatgttgcacgtacaagacaaggccgtgccctgtgagtggcgaacagaccatgcgagacgcagcgagggacccatcgcagagacccaggaaggaacggatggagcacagacacctgaaggccagcagtaagggccggggggagcaagcgaggaagggccaaaagctaaggagcagaaactagatacactggacaccaccgaac

SEQ ID NO: 618007 - DNA, 770 bp, Homo sapiens
gtacgcaggccgcctgggcgtgggcgcggcacccacgtcgtgatctacgacgccagcgaccagggcctctactccgccccgcgcgtctggtggatgctctgcgccttcggccaccacgccgtgtcactgcttgatggcggcctcctgccactggctgcgccagaacctcccgcttcagctccgtgcaagatgccaacctgctcccgccgatgttccgcgctcagctcgaccccgccttcatcaagaccttacgaggacatcaatggatgaacctggaatcccgggcgcttccaggtggtggactcccgaggccactggcaaggtcccggcggcaccgagccccgagccccgaaaacgctggagtacagttggcgcaatctcgggttcaccagaacctccgcctccccgggttcaagtgattctcctgcccttaatgcctccccgagtagctgggattacaggcattgaaccttggcccacttcccaggttccgtgaacatcccctttcacagacttcctgagccagtgaggggctggagaagagccctgagggagatccgccatcttgttccagcgaccacgacaagttgcaccctgtctaaagccactggtggccacgtgtgggcttctgggcgtcaccagccttgcaatgtggcacttagggggcctaccctctgcggcaaaccagaatgttgcccaatctacgatggctccttggggttggcgttggtaccattgcgccgccctggcccggaggatgtcatcttcag

SEQ ID NO: 618008 - DNA, 182 bp, Homo sapiens
cacaaacaggcttaggtagatctaccacctaaacctaccggagtagctgggactacaggtacatgccaccacaccagctaatttttttgtatattttaataagagtacgaggtatttgccatagttcctagaggtatggtctcaacacacctgtagctcaaagtgactctgcccactctcac

SEQ ID NO: 618009 - DNA, 306 bp, Homo sapiens
tcggaacgtgtatccttatgcgctgtagagcgtaagaacaaagaatcacaatgggtggtccagattcttccattgactgacaggcctctccaggttagaggcatttacatggtgaagggggcctgtccgggcagaacaatggcatgggacccggtccagtgtttggcttctcctctaaagagctactatttgccccagtgtgggggtggtggtcctttatctaagtcgtactcagccagctcatcatcatcaagcgtcctgtcatcctctgggtcaccatcctccaggggataacacgttcgcgag

SEQ ID NO: 618010 - DNA, 269 bp, Homo sapiens
tctgtgctgaggtgatctagaggatcccgtggctcatgtgatcctccccccgagatgcagaggatgctatttatgacagaaaagggaaaacaagtgggacgcggtggctccttgcctgtaattccaacattccgggagaccgaggtgggaggactgctagagcccaggagttcaagaccagtctgggcctgtctctacaaaaaattaaaaaatcatcggggtatggtggcatgcgccggtggtctcagctgctcgggaggctgaggagg

SEQ ID NO: 618011 - DNA, 1822 bp, Homo sapiens
  misc_feature (146)..(146): n is a, c, g, or t
  misc_feature (401)..(401): n is a, c, g, or t
gacgggatttcaccatgttagccaggatggtcttgatctcctgacctcatgatctgcccacctcggctcccaaagtgctgggcttacaggcgtgagccaccgtgcccggccaaaaataacttttaaaaacatgagtatagcatacncacacacaaaagtccacaaatcctaagtgtaccacttgatgaatgatcccaacgtgagcacacctctggattaccacctggatcaagaaataggacatcacagcagctggcagcttccaaggagaagctctggaaagttctgcctgtctcagcacctggctggatcggaaacgagttttctttaaccagatttttaatgactgacttatgtggacaaatcataactgaatgaatcacctcctttgtgattttttngggtactttatttgctattataaatgatgctgtaataagcacccttgaagaaatcttcatatctgcctctcctgtgtagcaggtcacagtgcctgggtttggttctagccctcatttgtgaactgtgtgactcaccatgccttttttctttctgtaagacaggaataatggtaagaatttaaatgggggtaatatggagcgcgtttagttcagagcctggtgcatacaagcactcaataagtactggcgattattagacctttagattaatttattagaagttggatttctggtgaaagggtttgagtgtttttgaggctttggcacagaatacccagctggtcccagaaaggtggttcccatttacctgcccgaaggtaattcacccttactgatactgagtactgttttctaaaagaacattaaaaattggataggttaaaaacaggtgaatacatttttttagttgcatttttttggttacccgtgagagtgaacatgttgccatgtgtttgctgacctcctaaatggtctatttgctcctacctttgtaccccaaaagtctgctctcaagatggtagccagaatgatcctttttgagacataagtcaaaatttcactcttctccttaaagctctgcaatggttctcaggttaaaagccaaagtcctgttcaaggcctccagggtcctcaccacttggtcccttgctctttctgttctagccaacttggccttctcctgcccctccgccgcaccatggcaatttcccctgctctgtgtggtcaactacctgaatctgttcaaagctttgctcaaatgtctccttcctgatgagacctccccagcccctgagctccccatgcctcactcctgatcgccttacttaacccttctttttcttttttgccagtagtacttatcaccgtctaaaatacttcataatttacttgtttattgtttgcccctctccaatagaatgtaagctccttggggcagggacctttgtcctttgtcttgttcactgctgtgtcccatgtgtaaacttgtctggcacagaagaggtgctcgataaatatttgttgagtgaatgaatggtaaattttctgttcatattctttgactattttctattgtaatgttcatctttttagtattggtttataagatgtatatttagcaccttttcatatatcactctttgtcacatattatgcaactaatttgtcatttccatcaatttttaaaatactttcttgatgcttcatttttaagctgtcagattattaatcttttctttatggtcttggactttattgttgcataaccgctgccttcaccaggaacatataaattttcaattaaatgttcttctgagattttatgatttcactttttatattaaactcttcattttgtcttc

SEQ ID NO: 618012 - DNA, 233 bp, Homo sapiens
gtagctttgcttatacaaagagatgacttttatacagctttggctgggactctctctgagtggaggtgtttcttggaaagacatcaaaactcaagtaatacaaaaatcattccatgaaatttgaatgtaagccaattgccacttcagtcatatgttgagagctctattttactttattactgagcaaatctttgctgggggggacaggcatatcttccaagtaagggaatggt

SEQ ID NO: 618013 - DNA, 306 bp, Homo sapiens
ttaattagccagatgtagcaggcatagtggaggcgcctgtaatcccagctacttgggagactgagtcaagagaatcacttgaacctgggaggcagaggttgcaatgagccaagacctcaccactgcactccagcctgggtgacagagcgagactccatctcaaaaaaaaaagaaagacaattagccagatgtgggggtatgtgcctgtagtcccagctgctcaggaggctaaggtgggaggcacatttgagctaggaagttcaggcggttgagccatgatggtgccgatgcgcgattagggtaagt

SEQ ID NO: 618014 - DNA, 394 bp, Homo sapiens
  misc_feature (19)..(19): n is a, c, g, or t
  misc_feature (37)..(37): n is a, c, g, or t
  misc_feature (58)..(58): n is a, c, g, or t
  misc_feature (214)..(214): n is a, c, g, or t
  misc_feature (250)..(250): n is a, c, g, or t
  misc_feature (274)..(274): n is a, c, g, or t
gccagcaggtagcaaagtnacgccgagggcctgagtnctccagtagccaccgcatctngagaaccagcggttaccatggaggggatcagtatatacacttcagataactacaccgaggaaatgggctcaggggactatgactccatgaaggaaccctgttttccgtgaagaaaatgctaatttcaataaaatcttcctcgcccaccatctactncatcatcttcttaactgcgcattgtgggcaatggantggtcatcccgtcatgggttaccngaagaaacttagaagcatgacggacaaggacaggctgccctttcagttgccgacccctttttgtcataggctctcttctgggcagttgatgccgtagcaaactggtactttgggactccc

SEQ ID NO: 618015 - DNA, 350 bp, Homo sapiens
  misc_feature (19)..(19): n is a, c, g, or t
  misc_feature (37)..(37): n is a, c, g, or t
  misc_feature (58)..(58): n is a, c, g, or t
  misc_feature (214)..(214): n is a, c, g, or t
gccagcaggtagcaaagtnacgccgagggcctgagtnctccagtagccaccgcatctngagaaccagcggttaccatggaggggatcagtatatacacttcagataactacaccgaggaaatgggctcaggggactatgactccatgaaggaaccctgttttccgtgaagaaaatgctaatttcaataaaatcttcctcgcccaccatctactncatcatcttcttaactgcgcattgtgggcaatgagttgggacacccggcacagggtaccccacgagactcagaagcactacgcgcacattcacactcacccctcaatggcgcactctctttgtcacacgcgtcctc

SEQ ID NO: 618016 - DNA, 474 bp, Homo sapiens
  misc_feature (75)..(75): n is a, c, g, or t
  misc_feature (91)..(91): n is a, c, g, or t
  misc_feature (114)..(114): n is a, c, g, or t
  misc_feature (145)..(145): n is a, c, g, or t
  misc_feature (158)..(158): n is a, c, g, or t
  misc_feature (284)..(284): n is a, c, g, or t
  misc_feature (292)..(292): n is a, c, g, or t
ttgtaatccctaggcttctcaagaggttaagcagaagaatcgctttgagccccagaaggcggagattgcatgtanccaagatcgtgtcaantgcactccagcctgggtgacaanagtgagactccgtctccaaaaaaaaaaaaanaagaatttattancctggttggttaataaattgtgtggtccctgccgggcgtggcggctcacgcctgtaatcccagcactttgggaggccgaggcgggcagatcacgaggtcaggagatcgagaccatcctggctaacncggtgaanccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctc

SEQ ID NO: 618017 - DNA, 193 bp, Homo sapiens
tacatagcgcctgaatcgctacgtggctcttatggcatatagatgcgtatgtcaccttccccgttgcgcagcgaagacatagagcaggccccactgaccccgcagatggcccggtgtaggcgagcttccctcatttctctctgcaatctagaaatgactcctccattgaaataactcctccccaccccaacaa

SEQ ID NO: 618018 - DNA, 679 bp, Homo sapiens
  misc_feature (243)..(243): n is a, c, g, or t
  misc_feature (406)..(406): n is a, c, g, or t
  misc_feature (417)..(417): n is a, c, g, or t
  misc_feature (437)..(437): n is a, c, g, or t
  misc_feature (440)..(440): n is a, c, g, or t
  misc_feature (444)..(444): n is a, c, g, or t
  misc_feature (451)..(451): n is a, c, g, or t
  misc_feature (457)..(457): n is a, c, g, or t
  misc_feature (469)..(469): n is a, c, g, or t
  misc_feature (527)..(527): n is a, c, g, or t
  misc_feature (529)..(529): n is a, c, g, or t
  misc_feature (538)..(538): n is a, c, g, or t
  misc_feature (540)..(540): n is a, c, g, or t
  misc_feature (619)..(619): n is a, c, g, or t
ctcagtgctaggtcgaggcctgggtggtggcatggcggcgcccatgtacccggtccgtgccgcaaagcgaacggcggcgcggcgcgggccccgcgggggttagaggtcaccgatgctgagggtcgcgtggaggacgctgagtttgattcggacccgggcagttacccaggtcctagtacccgggctgccgggcggtgggagcgccaagtttcctttcaaccagtggggccggcagcctcgaangtctcctcctccaggccgcgcgcggatatgtcgtccggataaccagcccagtctaggctggatgatgacccagctcgcttctacgctgcgtcaaagagctagccagaatgtcccgtggaacttgagaaggttgatgagtgtcgtgaaaagactcttgtcgttnggaaatggcanagcaagaaggagatgctaanaantcangcaagancagttnatgaggaagatngttgcaaacccagaggacaccagatccctggaggctcgaattattgccttgtctgtcnangatccgcangntatgaagaacacttggagaaacatcgaaaggacgaagcccacaaacgctatctgctaatgagcattgaccagaggaaanagatgctcaaaaacctccgtaacaccgaactatgatgtctttgagaagatatgctggggg

SEQ ID NO: 618019 - DNA, 94 bp, Homo sapiens
ttatgtcatacaggttacacgtatgctatttacttttaactaaaagacgaggccctttgacgtatagcaaataaatgtgcaatactgataagtt

SEQ ID NO: 618020 - DNA, 191 bp, Homo sapiens
  misc_feature (183)..(183): n is a, c, g, or t
  misc_feature (187)..(187): n is a, c, g, or t
ggttttaaggggaatagggcccctacgggaaacataacctaataaaatttttggggggggagggggccgaaaaaacataaaaagggaccccaaagggggccccccctttaaaactttacgggaaaaaaccccaaacttgccgaaaaagagggggaacgggccggggctcgggggcttgagagngggncccg

SEQ ID NO: 618021 - DNA, 132 bp, Homo sapiens
tatcagctcggtccatgtatgggtctcacgcagacacacccacagaaggacactactgtgcacgcgtgcgtgcgcacacacacacacgagttcataatgtggtgatgtccctaagttaagcaaaatgcttct

SEQ ID NO: 618022 - DNA, 104 bp, Homo sapiens
ctcctcttcatcttcctcctcctcctcctcctcgtcttcttcctccttgctcgttcctcttcttcttcttcctcctcatcttcctcctcgtcttgcgggggttg

SEQ ID NO: 618023 - DNA, 474 bp, Homo sapiens
  misc_feature (1)..(1): n is a, c, g, or t
  misc_feature (204)..(204): n is a, c, g, or t
  misc_feature (307)..(307): n is a, c, g, or t
  misc_feature (366)..(366): n is a, c, g, or t
  misc_feature (417)..(417): n is a, c, g, or t
  misc_feature (426)..(426): n is a, c, g, or t
  misc_feature (456)..(456): n is a, c, g, or t
  misc_feature (461)..(461): n is a, c, g, or t
ntaattacagtttttaaagtccgaagtctgacacaggtctcactgaactaacattatcaacaaagttttattcctttctggatgtctaggggagaaccttttttttttaatttttatttttaaatcttttccagaagctgctagagaccacccacatgccttggcttttggtcccattccattttgaaagcctgcaatggcggntctaattccttctcacatcaaatcattccagtctcttttctgcttccctttcatttttaaggacccttgtgattactttggtcactaagaaacacaccagggntaattctccatttaaatgtcatctcattaggcaaccttgaattccatgcttcaaccctnaattcccctttggccacgtaagtttaacatatttcacacggtctgggaganggaccgggncgtggggtgtgtttgggagggagaggggtngggcnttcttctggccta

SEQ ID NO: 618024 - DNA, 453 bp, Homo sapiens
aaacatgggctgtgcatctgctccgcgctgatggacaggcccaggtcctcctctttgccattccctggctctccaatagtatcacatccttaaagaccagcccaacatacacagaggtgacggtattacatgaaaacacttacgttacacctaatcttagttgtagtatggttattcttacaacccatagatgcctctaagactcaagtaccaatggaacatgctgtaaggaagtgggaagtaaggggaaaagcagtctacttctgtaccattcctgatttaactgtaaacacgctcaaatcctctggtcagagtttacacttcactggaaaggtaacaagcagatagtgcctgctggaaatcttacatacattagtaagatgcatgtaactgggtaaagaaacatatcggggacacagttcctggcatgtagaaagcactcagtaattaata

SEQ ID NO: 618025 - DNA, 882 bp, Homo sapiens
ccttttcttcgggggttctgcccaaggataggcgtgggggcgggacccccccggaagggagcccgcccaagggccgggtgcccccacgccccccacctttgttttacactcccgctgattgtagggggcccgcggtgtgtgtgtgtgccacgccccccattttcttgggctctgttccacatgggggagagaaatatttattccccacaccaccttagataaatgtggggaaccaccaccaatggcttataggagtcccccgtgtgtcgtgggggtaaggctacaagaagaaataaaccacagagagatgtgggaaaatatatgtgcacgagcacattttctccgcagaggaggtgttgatgaaagcccccccctgatatattctcctgggtcccaatctgttctccacgccgaaggccacatttgggaatattcacacaataacccacatctgaacaaataagtttggagagtataagggagacttcataaatatacccgagtttcctcttatgaagggccggtttataacactatgccccactgcggtgtatacacgaggaaccggatgtgggatgttccctcttattatttctcttgtttatattgtgaagccctctggtgtacacccccaccactctcggaaaacccctggagaatattgtttttcacggtgttgagaaccccttcacatgtttctttttataagcccaaggaatcacataatgcctcttttatataaaaagttcactagtgctggattttccggggccaaattttcaggctccctttttataaaccggggaagtttttttttgttttaaaaacaccctggagaaaaattttccccaaataaaaaataaaagaataacaaaaaaaagg

SEQ ID NO: 618026 - DNA, 870 bp, Homo sapiens
tgctcccctacatgtgcctatgtgctctcattgttcagctcctacttataagggagaacatgacatgttggtttctgcttctgcgtagttgctgaggataacagctcccagctctatccatttcctggcaaaggacataatatcattcctttttatggctgcattgtattccatggtgtgtgtgtgccacattttctttacccagtctgctattcatgggcatttgggttgattccatgtctttgctgttgtgaatggtgctgcagtgaacatatatgtgcatgtttctttataacggaatgatttatgttcctttggtgtatgccaagtaatgggattgctgggtcaaatggttttctgcctttagatctttgaggaattgccacactgtcttccacaatgcttgaacaaatttacactcccaccagcagtgtacacagagttactctttctctgcaacctcaccagcatctgctgttctggactttttttttttcctgaatgtggcatgagatgatacctcatgtgtgggttggcatggcttgctctaataactcaggatgtcgaggtccccatggtgttgggttggcccatgaattgttgtcctgttgagaccctggctggtcggggtcatctgccccctttgagtgggggtgccgctccttgcacactgtgttgagtcctgttggccctgtgttttagcccttgccatgtgggttattgcgagatttccactttgaggcgtgtagctcgggaggtttggcgccacacctggtgcgcccccttctcactggtgtcacgctggggcccaacatgcccggtctgagcccgctcgtgggggcccccggtgcttctgttgtgctgtctcat

SEQ ID NO: 618027 - DNA, 829 bp, Homo sapiens
tggaaggagctgcaaaatgaaaaaaaaaaaaaggaatcatgtcatcttgacccagctgactggaaatttcaatactgtcttttaactgttgtactccagccagccttgggcaacagagtctctctctgtcacccacgctggagtgcagtgggcaggatctcaactcattggcaacctccgcctcccaaggttcaagcgattctcctgcctcagcctcccgagtagctgggactacaggcacatgccaccatgccaccatgcctggctgatttggtattttgggtaaagctgggttggccaggctggtctgtgaactcctgacctcaagtgattcacctgcctgggcctcccaaggtcctggaattgcaggcgtgagctaccgtgcccagttggttttacatcttaaaaacgttagagaacagaacgaatatgcaacagaaactgtattgtagcctgcaaagcctacaatgtttactctctgtctgggagtcggtctcccctgtctagactgtcagcaagcgcgtacacggcatacagacacagggtacgtgcccaactgcccttctcctgcaaggggattctagggtgccttgccacactgaccatatgtctccttaaccacctctacatgccttcaactggtaccccactgatgtattcagacttcctgacctattttttttcaccgtcggcttaaaagtgacaaacctgttccagggctaaccttgggaacatactattccaggccagatctccaaaaaaggaatagcctatgcaacacaatgtaggccacatagtgccaacaactcaccatcactgacatgccgag

SEQ ID NO: 618028 - DNA, 961 bp, Homo sapiens
gtattgaacgactctcgaggttaccttggttggagctatcctatgtgtccgacaccagcatctcagcatcaacatgaagaacaaggacatctggttctatgctgggtgcatctggactacggaagctaggtaactagggagcgtgcgcgagactgggaattcagatcttggtgtgctttgttgaatagagtggcgctgtggcttgacagaggtctgtttgctgcctgtgcgagctgatacactcctcctgctgtggtaagtgcgtgctttacgttctatagctgaatgcactcgcactctgctgctcactgtatagaagtcttataggagggcagataggcgggaggatgcagagagtcccatgccgtctgagcacggaaaggctgactcgacagtaggtactgagggtggcagagcccgcgcgtcgccccgcgccgaccgtggtgctgacgttcgttgtaacgcagtgatccgcctagtatatcaggagtcaatgccccccaaattacatggcgagatatgacagattaagatataacataagatcaatacaggactatactcaaccacataccacacatccgtggggcgggtcaccaaactcagaaattctttcgctaggagcccttccgagcaaaagcggtgccgaatggttagataggtgttctctgtgcttggtccgtttcttatagtcctcagtaaagaaggcgtcaggaatgatgggtattctggtgaaggttatgttagaagcaaagagttcaaaagtaatagttttggtaaagagacaactccaagtgtgatgggtaaaaaagaaggtgctggtacaagagcttggtacttttgtcccatttttactatagattggaaaaccaatcttgagtattggtttagctttacataaggcagaatattctttgtaggaagaaaatattgcaagggggatatatgagaaaataacaag

SEQ ID NO: 618029 - DNA, 158 bp, Homo sapiens
acttcccctctcaactgaccctgctcactctgggaatggtcctgttgtaagagccatcacttagaacccacgtcctcagaaattatcccaaaggctttaggggcagagaaggaatatgtgtatctattagaagtgacatggggaagaaaaggaggaca

SEQ ID NO: 618030 - DNA, 239 bp, Homo sapiens
cccggacctctttcgaaaggcacatgtatttatgggttactgaaattattttttagagttgtgtgggattttgtatttgttttggttttttctgtaagaatgctgaatacatgctccattctcttatggcttgtagggtttctgctgaatgacccactattagcctaatgggttttcctatgtaggccacctgtcctttctctctagtggcctataatattttttctttcatgttgcct

SEQ ID NO: 618031 - DNA, 241 bp, Homo sapiens
agatctcgtcttttttggatatcatttcgatggaaagttagaaatgaaagaaccaaggaaaaagaaaaatacatagagaaaataaacaaatgcttgccaaaaattaagtttaaatacttcgtctacaaaaaacgcaaaatgtcctgtcacattagttgtcaaacgttgaactgctaaaaaacctgcaacatttaccagtcccgcaagtcaaaagaaattagagctgatcctctagagtcga

SEQ ID NO: 618032 - DNA, 248 bp, Homo sapiens
gcactgtagccgctactgtacaattccagcatggactggagctcaacactgaattctaatgctatgcacttgatgtattctttctccttggccttttcatagcaggtgtgaacaactttgatgcttgaggaggaatgaaactgtgcaaattagactggggactgagcttcatgaccccatgcagagttggatgtgatgtcctgtagtttcacatgctcaccagcttgcatgaccttgagcaatgtaga

SEQ ID NO: 618033 - DNA, 89 bp, Homo sapiens
tgggccagtttttttttaatttgggtaaaggctcggccataaactttcatagggggtgccaaggggtcaccggccacactcgcaccagg

SEQ ID NO: 618034 - DNA, 139 bp, Homo sapiens
gtgagtaggtatataccaatggtgagcaaagtcccagccttgatgagggtagctgtggtggctctcaattgagatgtgctgaggatttatcagagtgaagagtgggaactaccacagcttcactctgataaatcctcag

SEQ ID NO: 618035 - DNA, 322 bp, Homo sapiens
gctcgacggtatctcgttctacatcttcgagtccaacagctacatcatcgacgtgtaccgcggcgataccccggccactcgcaacctgatcgactttgcggcgttcgtggcgattttcccgcacctgattgccggccccgtgttgcgctttcggacctggccgaccagttcaacaaccgcacccacaccctcgataaattctccgagggctgcacgcggttcatgcagggtttcatcaagaaggtgttcatcgccgacaccctggcggtggtcgccgacattgcttcgccctgcaaaaccctacgacgggtgacgcctggct

SEQ ID NO: 618036 - DNA, 548 bp, Homo sapiens
tgtccggaccttcctgattcctgaggccatgacctttgaggaagctgctgccttgctcgtaaattacattacagcctacatggtcctctttgacttcggcaaccatacagccatggccacagcagatcattggtacacatggcatgcagggggtgtgggatatggcatgccgtgcagcatgtgccgatacagatggagaaatgtgacagtgttcggaacggcctcggccagcaagcacgcaggcaacatgcacaggcagcacatgtgggtccacaaccatcacccatcagcactcatcacacacgcacatgcactcacagatgagcattgaggcatcgcaagcaagcattatcacccatcaacagggcagtggcaccatatgatcagtgtgacaccaatcatgggatgaggatcaagactacgctgaccaaggagcataacaaacacatccgtagaaacacccagtgggacaacaagatcagatcaaccatcatggacactggaccaagccgtgacatgcacgggacccacaaaaacaggaaaccatg

SEQ ID NO: 618037 - DNA, 386 bp, Homo sapiens
ttgggagtagaaaagtgagagggcttaatgcttgccttaatttctgttaactctttattttgttttttggagacggggtctcactttgtagcccaggctggatggagtgcagtggtgcgttctgggctcactgcaacctctgcctcctaggctcgagcgattcgcccgcctcagtctctgaagtagctgggaccacacacacgcgtgcaccaccacaccaggataatttttgtattgttgtaggggatttcgccgtgttgcccgggctggtcttgaactcctgggctcaagtggtctgcccacgtcagtctcccaaggtgctgagattataggcgtgagccaccgcacctgcctggtttctttacttaaaaaaaaaaagtcgacgc

SEQ ID NO: 618038 - DNA, 808 bp, Homo sapiens
  misc_feature (150)..(150): n is a, c, g, or t
  misc_feature (168)..(168): n is a, c, g, or t
  misc_feature (170)..(170): n is a, c, g, or t
  misc_feature (174)..(174): n is a, c, g, or t
  misc_feature (176)..(176): n is a, c, g, or t
  misc_feature (179)..(179): n is a, c, g, or t
ctcttatctctgcctccttgtattgtatgaataaccctgtgtatcacctcttagaactgattattaagctaatagactgcagcggatacgctgccacgtgtgtatatatatgacgttgtacattgcacatacccttggatccccacagtntggtcctcctcccagctncntttnanttncgagttaacaagttggtgacctgcacaaagcgagacacagctatttaatctcttgccagatatcgcccctcttggtgcgatgctgtacaggtctctgtaaaaagtccttgctgtctcagccagccaatcaacttatagttatcctctctgggttccgtcgtacgtttctttctaatcgaggtgtgaacaagttctaggttcagtctgaagttctgatgaagaaacacaatgagattgctcaggtgataaaatctgcatattggtatttcaacaatgtagctaaaactgtgatgtaaattcctccttttgttccttatatggcttaatgaatatcattttattcagtatgaaatctgttatactatatggtccaacgtggtaagaactcaaggtcacatcgaaatcgtggacaccacaacaacagaacaaaaagcacaaccgtgggagcgcacggcgcccggcagacgccgcagcaaccagcgcaggggcccggtccccatccgaccgcaccgcggccacggggcccagcgaacaggggccacacccacggggccaaccaaaacaacggccgcgaccgccggcccgaacccgcggggcgcaggaaggacccgcacaccaggaagccaacc

SEQ ID NO: 618039 - DNA, 820 bp, Homo sapiens
  misc_feature (162)..(162): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (188)..(188): n is a, c, g, or t
  misc_feature (191)..(191): n is a, c, g, or t
gaatgacatcctgatctatttgtgttctccgggctcggtacgattcagcctgagatctcctctttgtaatgttgttcatacatctatttcgctgtgtgaactcggtctcgtgtgtatatatatgacgttgtacattgcacatacccttggatccccacagtntggtcctcctcccagctncntttnanttncgagttaacaagttggtgacctgcacaaagcgagacacagctatttaatctcttgccagatatcgcccctcttggtgcgatgctgtacaggtctctgtaaaaagtccttgctgtctcagccagccaatcaacttatagttatcctctctgggttccgtcgtacgtttctttctaatcgaggtgtgaacaagttctaggttcagtctgaagttctgatgaagaaacacaatgagattgctcaggtgataaaatctgcatattggtatttcaacaatgtagctaaaactgtgatgtaaattcctccttttgttccttatatggcttaatgaatatcattttattcagtatgaaatctgttatactatatggtccaacgtggtaagaactcaaggtcacatcgaaatcgtggacaccacaacaacagaacaaaaagcacaaccgtgggagcgcacggcgcccggcagacgccgcagcaaccagcgcaggggcccggtccccatccgaccgcaccgcggccacggggcccagcgaacaggggccacacccacggggccaaccaaaacaacggccgcgaccgccggcccgaacccgcggggcgcaggaaggacccgcacaccaggaagccaacc

SEQ ID NO: 618040 - DNA, 217 bp, Homo sapiens
ctgtcactgcacggtactctaaggatcctttttcttcattgctcaggggacagccataactggtcagatatgaggtgacccttagcgtctcagcagacactctgctggacacctctccaggagtcagacccaggaactttgcctgctggttgagcatgaacactagtacagtcacagggatccagattgtgccctggttcctcgattggttatacct

SEQ ID NO: 618041 - DNA, 415 bp, Homo sapiens
  misc_feature (368)..(368): n is a, c, g, or t
gttacccatattggctggcgaggatgttcagaaagaggccttttctgtggagtatttttggcagtactcatcaaagcacattaaaaccacatattctttttgtgtgtgtgtgttcccgagacggagtcttgctctgtcgcccaggctgtagtgcagtgttgagatctcagctcactacaacctccgcctcccgggttcaaacgattctcctgcctcagcctcccaggtagccgggattacaggtgcccaccaccatgcccagataattttttatatttttagtagagacggggttttaccatgttggccagactggtctcaaactcctgacctcatgatccgcctgcctcaacctcccaaactgctgngattacaggcgtgagccaccacacccggctgagttgttgattttttt

SEQ ID NO: 618042 - DNA, 320 bp, Homo sapiens
ccgcctcagactcccaaagtcctgggattatgggcatgagtcactgtgcccagccagacatatggcttggattaaccatcaaacaattatgtcccagggttatcagggacctcagcaagtcatctctgtcacctccctcatttctaaacaagctcacacctgaatgatcccagaaagatagtcttgggagaagatacttcataatatccctcggtaacaacatttcagtatctggtagtcaggaagttctttctaacatgtaatctacatcctttatgtggcaattaaaacacattccctctggtcctgtcctctatgga

SEQ ID NO: 618043 - DNA, 1059 bp, Homo sapiens
gggccttccccgcgcagagctccgaccgcgggcggcccagggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgacccagcccaatgcatgatcattactcagcacgatcactagtttggcttgcgaaacttcactgatgggcatgtcccgcgaaggactgaagaactgacttcctcacagaggcgcattaggctgctaaggcatgccaagcttactggcacgtatcgcagtcacaactgtaacttcatggggatcctggcaggcccactttgctcttaccaaagactacattacttccattcgacggcagatcataccatatcacacaatctggtgcaacctggcccacgcagagacacagtatgaaagaacagagccatctccaaatactgcggctcgtccagaagctcttacctctgtgggctgtccttgtacattccacttgaaccatctgtacacacattacctgtgcgagttacaaccattgcttgcagccattttcaagctaccagcttcgtggccaacaacagcatcatctactcctggaaatatcccctccttataggcctgccacagaccccaacatactcactttctgcattggacgctacgccctgatgcccatgacttactgcctgcacgcctcacggcattcagacgcgtactgcgcgaaccactggcagacgctgacagtgcgcaccgtcaacttgtgcaagttggcgacacttcccacccgccttcgcgcagtgtcgacccggcttctccaggcagtgcttccgtgcacacgcgccgaacgtagtccacccagcctcttggcatcacaaagcgctgttgaagtacacgcacctccatacggtcccacgatccaagttccatctctcagacccttgcacgagagaataccaggacatatgttaagtgtctagcgc

SEQ ID NO: 618044 - DNA, 766 bp, Homo sapiens
gtattgtctctcgtgacctggggcaagcaatattctggtccaagtggttcctttgcggggcacggtttaacacctagaaaaggaaggaggaatggtcttccaagtaaggaaacccactggggaatcctttggccaagcacaagaagttaggaatacccgtccctccgaatttaagttatgacccccaggtttctgtcagctaagaccaagaaatccccggccagaagttgtgagaaaggcatttttcatagtatttcagggctggcatatctggtctctccctcgtgcccaaggacatcacacatgtagtgtgcatactaatgatccgctcgtttccatgatgtcgtcgcttcacagaccttaagtgccaggcttacctacactatgctgagtcctggcgtccgcacaaccacatgtatgtaaaggagtaggtaatgtacaattctcagtattcagtaatcctcacatatcaaagaagcattggatgacaatagcttggcatggaagtcataataagaattttttttcaattgaaataagccctgttccatacccagctttagtgatgtcagcggatgccttacttcaaatgtcaatagagcttcactttctgtatagtttgccatatgtccacatccttcttcttaaatgtaatagcctacatttctgccatccctcatcccagacttttcatgtgttctcgatgatgaacagttgtgaacattgttcactaatggtgaatggctctgatattgtcttacttaga

SEQ ID NO: 618045 - DNA, 437 bp, Homo sapiens
ctgcagcggtgaccgattacaggcagtctgccttgtcttcattggcctctgatattattgatcgcttggccgtccggatctactatgctgatgtatagcaggtctatcagagcgtgagttaggatgcttatgctacagggccttctgactactttgtggatcacgtgttgacattcgacagcacatatgaaatcactgtatagaattgcatgctatctgcagatgctaccgaatgctgtgccaccgccttcgtaggaacttgaaccatttagctggagcttcatgctactgcagatgcctacatatgttgtgagacttgttgacacatctatgcctatggacctgattcacagaatgtgctcgatactcctggtacacctagtagcgtgcatactacgtttgaacgtcccatgatcgatgtaggcctcacgtgcatg

SEQ ID NO: 618046 - DNA, 148 bp, Homo sapiens
tacacggggaccgtaccgtgtggaacgacggtactacttggtgcgtgtgcttgaatactttgtgactgacatcggtacgaactatgacgacgggtagggtgacacgtggcgcttggctgactgtgctggacgttagctggctatcgcg

SEQ ID NO: 618047 - DNA, 307 bp, Homo sapiens
  misc_feature (39)..(39): n is a, c, g, or t
  misc_feature (211)..(211): n is a, c, g, or t
  misc_feature (229)..(229): n is a, c, g, or t
  misc_feature (269)..(269): n is a, c, g, or t
  misc_feature (300)..(300): n is a, c, g, or t
tagtttcccaatgtccactttattccatataacactccnaccagatatcatttacatctgaggaaccgatggcccatgagactgatctatagtaccacactctaagaaatgcagtccaattttccacacttccaggcatccctagacaagtgcgtcacaatgcacaatgtggaaatataggcatcactactacattttacataaaagggangtatcaataaactttagnaagtagtaaattcacctgtcccttaaaatatgggtatgcnattgttacaaagccatagtaaatggtttatnaaatgtg

SEQ ID NO: 618048 - DNA, 433 bp, Homo sapiens
  misc_feature (215)..(215): n is a, c, g, or t
gtggggtgatctaggtgatccctttctcaccaccacatttacctgagtaatccctgtctctctcgtcacccacatttacctgactgatactgtctctctcgtaaaccacatcttaactggcaactgagagctcgctgctctagtgtccagcccgagttcccaagtcaaagaatcccatcagtctaagaacacacagtgaacacccgctgtgtgtncagcatctttccaggccctgagatacgacagtgaacaaaggggggcgacacttccgaggagaacaccctgagcaaacaagcagcatggctggcagcaacgggcacacaggggacaaagctgcagggcggaggggtggggagaacaggctggggtccactgagatgggccaagcacagaggaactccaaaaaggcaacgctggggcaaagagctgacaa

SEQ ID NO: 618049 - DNA, 396 bp, Homo sapiens
atcgtcggtagcgtgtgatgcaggcttttaggtgcgtcattatccgatcaggatatcagctgatttggcagcgtcttacgccagtctaacgtcatctgacacatgatattgcctcagaaatgcccacgggcaatcctgagattgcccgttaggtaactgacgtcggttgtcgctatacggcactgacgacaacggtgccaatttccggatggctaaagctttgcaatgtgatccagacgcagatctcgttgttcgccgttcgcctcaaccaccagatattccactttcttacgcattaacaaatcgttggcttcagcctccacgacttctccgctacgcatcttcagcgtcgaaaccaggtgatgctggcaggcgagctcgagattatcgtagtcc

SEQ ID NO: 618050 - DNA, 264 bp, Homo sapiens
aacgcgacttgcgcgctctgcggaccgaccgtgaagaaggccctgtcgcgggtcgaaggcgtgaagtcggttctgttcaaggaagccgacgccggctcgggcgccgtcgcaaccgtcaccttcgatgacgccactgccgatgttcccaagctgattgccgcggcgacgaacgccgggtatcccgcgcgcctcaagaactgaggcggcggctgataggcgagcgaaccggacgcctcggctgaggcggcgttcgatctactgaac

SEQ ID NO: 618051 - DNA, 610 bp, Homo sapiens
  misc_feature (610)..(610): n is a, c, g, or t
ggctggagtgggaagctgggtaccctcttctgtgcctgcggttctctgacccaccgcgagcctgcagacgcagggtggggcgctcacagttgtggcactgctgctctgtgggcctggtgtggctggattggtttggaatgtgcgaggcctgaggagcttgggagctgctggtccactgctgggtgcgtctctgaggctgcccatcggggcttgagtgtccattgagcatctgcagctccatctgccgcctcggggtctgaccctggtggcttgcagacatccttgcgaatccggtaagtcgttgggcgtaccatttcaagaaagcgaccacacctttccatggaaagaacgacaaaagatgggcgcgcaaagggaaaacattctcgccagggcgaggaggtaatcgaagacgattattcgaccgagccgaacgcagaacgaccaataaaacagcgcccaaaaagaacagtttcagccgaattttttaccaaaaagattacctcttatggagagatacgaggggagaagcacatatacacgggggaggaggggcgcataaaaaagggcgcaaaaacacagcctgggggagccaagagtgttttcgcgacan

SEQ ID NO: 618052 - DNA, 100 bp, Homo sapiens
  misc_feature (13)..(13): n is a, c, g, or t
  misc_feature (38)..(38): n is a, c, g, or t
  misc_feature (43)..(43): n is a, c, g, or t
  misc_feature (51)..(51): n is a, c, g, or t
gccagcaccaacnagacatcatgtatatctctgcagcnaggangacagggngagctcctacgagcagtacttcgggccgggcaccaggctcacggtcaca

SEQ ID NO: 618053 - DNA, 269 bp, Homo sapiens
  misc_feature (69)..(69): n is a, c, g, or t
caaaaaaaaaaaatttttttttctggtgtttggcccccccttgataaaccgagggcctgccccaaaaanctggttaaaggaaaaaattttttggcccaatcctttaaacccggggccccttttttgggaaatgaaaggtggctgttttttttgggggccacaaaaaaaaaattttccaagggtttttttttcaggggaaaccttccgattttttgttaaaattttcccccccccccttggtttttaaatgtttttcccttttccgggga

SEQ ID NO: 618054 - DNA, 903 bp, Homo sapiens
  misc_feature (15)..(15): n is a, c, g, or t
  misc_feature (67)..(67): n is a, c, g, or t
  misc_feature (75)..(76): n is a, c, g, or t
  misc_feature (81)..(81): n is a, c, g, or t
  misc_feature (97)..(97): n is a, c, g, or t
  misc_feature (116)..(118): n is a, c, g, or t
  misc_feature (125)..(126): n is a, c, g, or t
  misc_feature (128)..(128): n is a, c, g, or t
  misc_feature (140)..(140): n is a, c, g, or t
  misc_feature (148)..(148): n is a, c, g, or t
  misc_feature (158)..(158): n is a, c, g, or t
  misc_feature (169)..(169): n is a, c, g, or t
  misc_feature (172)..(173): n is a, c, g, or t
  misc_feature (175)..(175): n is a, c, g, or t
  misc_feature (180)..(180): n is a, c, g, or t
  misc_feature (197)..(197): n is a, c, g, or t
  misc_feature (212)..(213): n is a, c, g, or t
  misc_feature (221)..(221): n is a, c, g, or t
  misc_feature (228)..(228): n is a, c, g, or t
  misc_feature (231)..(231): n is a, c, g, or t
  misc_feature (240)..(240): n is a, c, g, or t
  misc_feature (245)..(245): n is a, c, g, or t
  misc_feature (256)..(256): n is a, c, g, or t
  misc_feature (269)..(269): n is a, c, g, or t
  misc_feature (320)..(320): n is a, c, g, or t
  misc_feature (326)..(326): n is a, c, g, or t
  misc_feature (338)..(338): n is a, c, g, or t
  misc_feature (410)..(410): n is a, c, g, or t
  misc_feature (484)..(484): n is a, c, g, or t
  misc_feature (584)..(584): n is a, c, g, or t
  misc_feature (590)..(590): n is a, c, g, or t
  misc_feature (776)..(776): n is a, c, g, or t
  misc_feature (814)..(814): n is a, c, g, or t
  misc_feature (818)..(818): n is a, c, g, or t
  misc_feature (828)..(828): n is a, c, g, or t
  misc_feature (873)..(873): n is a, c, g, or t
ttctttttatttacntctttttacattatattttaatctacactactcatatacttcacaaaataanatcctttnnaacanttatgcacaacacatnatattccatttatacactnnntcccagnntntcactcactggnaaaaaatnttggactagncatgttcagtnaanntnccagnaacttatataacacacngtaaacatccacctnnctcaaggngcaaatncantacgtacancattngcagtggtgcntcagatgtggcanaactatttcacactaaccacttgaagactacacaagattaataccatccancatcangatatagctgtngattttacaaaccattcttatttctaacttcacgagttgatgtttttcccactccatcttaaaatattactnctttaatcacagatcagataaaaaggacaacatgcacaacctccacctagaatcctgttgtagcctagacagtnaaatgatatgacatcagcaagactttaaaattgcagctccttttggatcccccaaagtgtatctgcactcttcttcaaacgggcctcttcctcagaagtnagagtnaccttcacaaggtctgagattccattctgtcccaaaatgcaaggaacactaaggaagacatcatcctttattccgtaaagacccttaatcatggtggaaactgggtgcacccgcctaagattcttcattatactctctgccaaatctgctacagagagtgcaatagcccaggatgtgtagcctttngagtttgatcacctcataagcactctcaaccacctgcntgtnaacctctttncactgttccttatctttatcagttcctaaatctgggtgcagagtnttcagagagaaacagccacatttattccac

SEQ ID NO: 618055 - DNA, 948 bp, Homo sapiens
gcagccggccgggcccccgccagcctccctcctcgcgtccctcggtgtcctccgcgggcgggcgatgcggtgggcccgaggaccgcgggtggggctgctgctgtgtgcgccgccgtggcggcgccggcaaggccgaggaggtggcactacccgtgggcgagcgcggaggggaatacgaccgcgggggcgctggctggggcgtccacaggacggatgtggctggactcttgtacaactccggccagcgaaggaggcagcaaaaaaggactgcaggcggatcatagacgaaaagtcgactgggggcactcaagcgtggtggcctccactggaagtggactcggcgttcccggcgatgccagacgtggtcctgttgaaacgcatttagtgggttatggaagaaagtcaaacccacgcgtgttgggtgcgcactcatcgtctcacaccgccgggggttgataactggtgcactggggggatgaatcataacgattcagatcgttctgactcgggtggtggattgcgacttttgatgacgacaccactggctcgggattgatgcagaaagagggcgggcctttaagagaacggcctccacttgaagggggcccaggaaggcgattgtgaaaacggtaactcaggactcgggtcccggtgggagtcctgaacaaaattgatggttgtgacgcatcctgaagaaagttggttttatgggccggagtgtgtcatttcaagagggttaggaagaccgtggccaaagttgggatggggctggtagtgtgggaagaattcttgggactacggggtccacctgcaatgaagtcgacgggttttgcggggacgacgttggggtgggttttacaagaacgggggttgtccaagggtcctggggcccaaacaggtcgaaagggctcattgaaggtggggacatggaagtatacggtgtcacag

SEQ ID NO: 618056 - DNA, 233 bp, Homo sapiens
tagaggatcccctctatccgtgagttctaatggagctgttctttattaaaattttttattcttaattttactttattcatagagatggagtcttggcccagtgctgttcccaaatctcctgtgtttcaatgcatgtccccaccctgctgtggcttcccatgctccccgtggatacatggacatggcccatgcatggacagggtgtggctctattccccttggatgacaaatga

SEQ ID NO: 618057 - DNA, 778 bp, Homo sapiens
  misc_feature (520)..(520): n is a, c, g, or t
gagtgcactgaagatggcggctgctgtaggacggttgttccgaacgtcgtgtgtgcccgacatgttcctcatgccatgcacctgctgtcaccctagctatgcagccctattttaagggtacagccgtttgtcgatggagtagttcaacatgacctaagccttgcatgacgttctaaggggaaactattctggtgcgttttcattctatccctttggcatttcaccttttgtcgtgtcctacaggacaattcgttgcttttacgtgactaaacgctagacgcacatttcacggatagtgacactgtgaacgttagtcgcggtctcgagtggattcccagttttagccatctttgctctggattaaatacaccaatgacaagacatgcgtggtgtgggccactatgagacattcgcactctttgtcagacttacactaacgcagatttcccgagagctacgcgtgtgctgttagaacggttctggtcattgcatctaagacggtctcgttcatacagttganccccaatggagttcatcaagccatttgaggcgtcacacgatctccacagtgtgtccgaagcgttggaagaaaccgctgcgcttggtgaacggcggttccacgtattgttagaaacacattggaagcaatgtctgtcccattgaactgggacaccggattctcctacgatcaagcaaagtcaggctgcttccccagagtactttcagaacggtacatcagtagatcaccatgtgtatctgcacttttcaatgagagaag

SEQ ID NO: 618058 - DNA, 478 bp, Homo sapiens
taagtgacatactgtacatgggttggttagaattaaagtggagaactctaaatcttatgcttatgttataaacgtaaacaaggttgcctcactgtcatgaagatcctgttactttcattaaaggaaaaaacaaatcctgtagaatggtcctttcgcataacaaagaatatgatggcttggaggcattcatacttaccagtttacattgggctagcagactggtaaggtttagggttctctccactaatggaaaattaaatgctaaacgtcctaagaattatgttgttttcaaggctttgactcagatttgtagcttggatgtatgaaagtgaatatcaagacttgtttatagaaaagactatatagaaaaataagtctgtgtagtgtatagtgatacatgttttatgttacccaatgcctgtactaaatcttgtgcttggcttgaattatatatgtgttacctatgactttttttgaa

SEQ ID NO: 618059 - DNA, 254 bp, Homo sapiens
ttgtaactcatcatagataaatatgcatcggctggtggacgatacgcatcctcggatgcgatgaccgatcaggcaccatattcataatattcaatcgtccgcatctgccatttcggtcgaaaatgtcagtccacagccagtcatctctaacttgctggtgaggaactcggatgctaacatgccatcgctaaactcctgacgtgttctcttcccatcctggtccttatcaatgcgccggatgaagaaattgatca

SEQ ID NO: 618060 - DNA, 1093 bp, Homo sapiens
  misc_feature (6)..(6): n is a, c, g, or t
ggtacncgcgggcggcaggggacatagtgctaggtacgaggccgtgtgttgactgggcggcgctgcggggcgcggtggggcaggaaatgtaggcggtcccactccgctctcggcgcctcgggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacttgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaatggtgaaaaaaaacaaacaaaaa

SEQ ID NO: 618061 - DNA, 269 bp, Homo sapiens
aggacccccttttctgtaaatctgttaaaggcggttctacatttaagggtcttagaataggttcgtgttcagtaaagggaaggacttaacaaaaaaggaaaggacacaatggtttattatgaccttttacattaaccttaagaaccatctgggaataaaaaaggcaaagctgtagggtttggtaccaataattcagagcacaatacctatccgggacataatccttatgaaaaggtcttcaaagaagggctggaaaaggcccaggatgg

SEQ ID NO: 618062 - DNA, 1065 bp, Homo sapiens
  misc_feature (6)..(6): n is a, c, g, or t
ggtacncgcgggcggcaggggacatagtgctaggtacgaggccgtgtgttgactgggcggcgctgcggggcgcggtggggcaggaaatgtaggcggtcccactccgctctcggcgcctcgggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacttgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttc

SEQ ID NO: 618063 - DNA, 897 bp, Homo sapiens
  misc_feature (301)..(301): n is a, c, g, or t
attaaccagacacatgggctgctactttcatagcaccacgtgccagggagagactcagcactgggccagaggattctggggaagggtgaagctgctgagtcaccaaagcagggcagtgggatggtgatgggttagaggagggaaggtctggggcccctccgctgttcgtcagctgtgtcccctgaggagggtgcagccacctgcatgatggctggtcctggagtgagagaggctgaaccaggagctaaggtgtgcggtgaagggggcaaaaggagagtgacttggctttgggattcctggnccgctgtagcctgtgaacactgtaactaggggaccgtttttcttctccactcctctctgctaggggcctagcacagcgtttggtacgaacaaaggctcagtaaatgcagtaatggatgggtggttggaccagctgaccaacaaacgggtaaacaaatgaactgggtgactgaggctggataactggccacggcctcccgctgaccgtggcctgttggactgttcttttcggcagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttc

SEQ ID NO: 618064 - DNA, 329 bp, Homo sapiens
agaactatcacaacaccatcctgtgacattgaaactgccctggctgggctacctcgttacgccagccctacaggatcactacacacactgggcaagccacccctgtcacccagcctcctgccactctttgaaggacagagccgcctgattttcttctgaagcagtaagacatgcggcgcgggcgagcacaaacgacctatctgaccactgagtgctgaagccaatggagactgacctggtattgcctttaataggctgcgaacccatgacaatagcttatgtctattacacagagaggaatcggagaatttttctttgtagaaattata

SEQ ID NO: 618065 - DNA, 1120 bp, Homo sapiens
  misc_feature (6)..(6): n is a, c, g, or t
  misc_feature (1094)..(1094): n is a, c, g, or t
  misc_feature (1113)..(1113): n is a, c, g, or t
ggtacncgcgggcggcaggggacatagtgctaggtacgaggccgtgtgttgactgggcggcgctgcggggcgcggtggggcaggaaatgtaggcggtcccactccgctctcggcgcctcgggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacttgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaaggtgagggccacggggctcagcctctgccaacattactttgtcagccttttccttccttccttccttcctctttcctccccccctccctcccctcttcttttctcttctcttctttcttttgtagttttccgctagacttagtttcatccgtgtctagactcctcaactacccttggattttgcccatgaccctgaatcattgctagttcgggattcaggaagcaacagagaagggtgtcccgagtggtcgtctttgcctcttctgttcgttcagcaaattctcattgcccccatgccagggatgcctatgagttttctagcctttgaaacattcccagtcccaggaatgtcatgcaggcaacttgaatctatgctcctgggtgcagtcctnaaacttggccatctctagntatactt

SEQ ID NO: 618066 - DNA, 413 bp, Homo sapiens
  misc_feature (34)..(34): n is a, c, g, or t
ccgggctggagtgcagtggctgttcaacaggcanggactgtggtgccctacggccttgaattccctgagctcacacgatcctcccttcctcagcctccccaagtagctgggactacaggcacacaatgggactttgcccagccatagtttatagtcttgctgcctcttctctacagtgcccagtcatagctcccaatagccactgctgactaacccctattctgatctctggaagaatataagagaattccttgactctacacattctaacttttctagaagagcaactggaagacttatgttttttctaactgttttgctggtgtatgtatgtataggcacagttcaaaacggaatgaaaactcagccaaatttcctcttaagatcacggagtaaattataagcaataatct

SEQ ID NO: 618067 - DNA, 175 bp, Homo sapiens
cccattgcacttgtacaggcaggtttgggatttagtagcgaagcagctgcctgaatgagttgttgtttccattatcactcctggtccctttgcaagtgaaccctgcagctcacccattcaattcacccaacttccttcattcacgctaggaggctctattaccctctccagctgc

SEQ ID NO: 618068 - DNA, 531 bp, Homo sapiens
  misc_feature (145)..(145): n is a, c, g, or t
  misc_feature (158)..(158): n is a, c, g, or t
  misc_feature (190)..(190): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (213)..(213): n is a, c, g, or t
  misc_feature (233)..(233): n is a, c, g, or t
  misc_feature (425)..(425): n is a, c, g, or t
  misc_feature (515)..(515): n is a, c, g, or t
gctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgnccacgacgtcagnataggtgtggagtttggagctcgtatggtcancagtcgtggaangncngttcaanctgcaaatctgggatacggngtgggcaagaatccttccgttctatcacccgttcctactacatgggagcagctggagcactgctggtgtacgacattacagtgcgtgaaaccttcagccacctgacctcatggttaggggatgcccggcagcactgtagttcgaacagggttatcatgctcattgggaataagagtgaccgggagtgtcgcnagattggtgaagagagaagaaggggaggcctttgctagggagccatggacggatattcaggggaacttcagccaaaacagcctgcaatgntgagaagcctcatgtt

SEQ ID NO: 618069 - DNA, 378 bp, Homo sapiens
  misc_feature (43)..(43): n is a, c, g, or t
tgtagtgcagtggcgtgatcttgggttcactgcaaacctcccnactcctggtccaagtgattctcatgcctcagcctcccaagtagctgaaatccccattgcaaaattataactgagacagtgaaagagatctgacctaaccaactccatcttgcttctaacctccaagctgttcttgtccattcttgggcatagggtgaactaactttgggaggaacttagcttatagtttaaaacaaagatgataacagtcctttcccaaaacaaaccaccttcttgcctgggggctagactacctttgttggactaacaaattagccacaagattagaaattacggtttaggagtcgagtcatggtcgacgcggccgcgaattta

SEQ ID NO: 618070 - DNA, 1613 bp, Homo sapiens
  misc_feature (301)..(301): n is a, c, g, or t
  misc_feature (452)..(452): n is a, c, g, or t
tcagacgttaggatctagatcgtacggagcgattatatgatgctatcacggagcatgagttgccagaaaacacatgatgtgatgtcactacaatcagcgcggatgcccgtatagttagttagctatcagtccacgtcttatctagttctccaacacgagagatcaaccgacacacactacggtacggtagtaccgccgacagccgtattgcgtgcctgaaaccggctaagacaaggcttactgttaatttactaaggaatcgggatctcgcctagctcggctgcgaccagaatcaataggnccacagctcacacggacacgaggtttgtacacaggtagaagagccaacgtacacttgatggcaatacaatggggtgcttaacactcctgcttaataacgtaatggcttcccgcataagcccattatcatgccggcggggagtgacgtaggngaagacgtatgacctggaatctgcacgtcgtgatgggaggggcgtcgtggaagaaagtacggtggacttctccatgttagcgtgtgtgttggtggttgataagtatatgcctaggtatcacctacacatgttttctaggatgagtttgatcgtgggattggtagcgataaacgagtaaaaaggttaatccgagcagaggcacacatccatgggactacatcttaagttggggactttcacaccttaggacccgagatacccaacatataggccacaccagggccaagattcgcagtatggagcatccggcgtatcctgcaagcgcccgggaacagcagccccgagtggacacctttgtgtagccatgggtgggcgcccaatggataactcgaggcgataagcgtaaatgggcgggggggcaaaccaacggcccgggggagttagaactgtgggggcaggaaaagagggcggccacaaacacctgcaatccaaagctggtccacactgggttaaacacggcgttcaagtagtcccagggcagaaccgtggtttgggcccacacgatggcacataaaccatggcactggaagcccagaatggacagcggaacaaaccggggccagtggtgcctgcgggccaacggagggcgcggacagccactgggggcgggcgtaaataaccagcgaggcagaactctgaagagcaagggtcacaccgcgatagaaggggttattaggccacgccatttattagacaacaggtcaccgggggacaccaaccagtgttgtgtggccaccaaaaccaggggggggggcgcagacacaatgtggtgcaccaactagcagaggcaaccaaatagagagcacgtgtggacaccacatcaacaaaggaggaagatgtaaagacaggagaaccacaccgggtatacaaacacacagggaggagatagtaatcacgcagacgcgacaaagaacaagacacaaggaggacacaacaaggcaacaagccgaaggcgagagagaggacaacaacagacgagacacaacaacagagcaaacagaaggagaacgagaagagaggagaataaatagacagacggcagcgcgcgacccccccccccccccccccgcgccgcccgacaagagagagaggggggggagc

SEQ ID NO: 618071 - DNA, 252 bp, Homo sapiens
ttgcgccacctctctcctcgcgggatgcttgctggggcagtcgggacagtgcgctggccgtgtgctcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagtagtggcaagacatggctgagagcaa

SEQ ID NO: 618072 - DNA, 307 bp, Homo sapiens
aaggagcagtggtgtgaacctgggaggctggcacttgcagtgagccaagcactgcaccactgcactccagcttgagtgactgagcgagactctgtctcaaaacacacacacacccacacacgtgcccgcgcgagagactctcaaaacacacacacacacacacacacacacactctctctctctctctctctctctctttctctcttagtgtcttagagatctgtgggctaaaagtgagatgatgatgtcaccgtgggctaacactcaggcatggacggggtggctctcccttcaggaggatgtagg

SEQ ID NO: 618073 - DNA, 294 bp, Homo sapiens
  misc_feature (270)..(270): n is a, c, g, or t
attacaactaaggtaatatctacagtgttatcacgacagaagtataggttgtattacaagatgttatgtgtcgtatatctatatcaggttattcaagagaatatcacctatagcataataataaattttcataaaaacaaactaaaaaaacctagaaacatttgacatcaccaaattcaacagctctcactagaaatccaagcataaacttagatatttgaaataaacataaattatgattatataactctaagtcacatacataatttngctgtcgtctcatttatattcact

SEQ ID NO: 618074 - DNA, 614 bp, Homo sapiens
  misc_feature (381)..(381): n is a, c, g, or t
  misc_feature (383)..(384): n is a, c, g, or t
  misc_feature (391)..(391): n is a, c, g, or t
cacgggacatgctctagtggcatgcggtgatcaaaatcagtgtcttactagaggctacagtgactggggtctgagaggcgcaccggcttcttactacaggccgtactctacgcaggccgagtctagggagcattgtgcgaacacccgtccctggcgggaaacctcgcgcagtttctcggagaaccatagcatggccttcacccacagcttggtcccatagttccggtcaaagggggttggagcgccagcctgctgcaggtggtccaggacattgtgtcctgcagtcgaagacgcccttgccctctgatgagtactaggttgtacaggaactccgtggtgtattagtcatggcacttctcgtgccgcagcaccaggcccctntnnaatgtcngtcttcatcttctccgtcatgtgctccacgttgacctttaagtcgtggatgttgaaagggtcctcgaagacgtaggcggcgtcggcccccacagcaatgccagtacggtggccaggtagccacagtcaacccacccatggctacaaagatgacgatgaggatcatacagaacagctgaatgcctgagccagcagggagctgaggatcatgggccatcggacgg

SEQ ID NO: 618075 - DNA, 279 bp, Homo sapiens
attttttaacttactatattattaccagatattcccagtgcttcctcagacacttctggcccaggtggctgttggagctccagccattatattcacattcaaagacaaaggaagaggaaagtatggaaggacaatagaagagaatctgccacaaggaatcttctggaaatgccatccaacaatctgcttatatctcattgactaggacttggtcctgtcacatctaattgcaaaaacaaacaaataagcaaagagtaatgaataaaaatgctacacttt

SEQ ID NO: 618076 - DNA, 817 bp, Homo sapiens
tgtatgtttggtcattcggaaaacccgcattcacaaaagacaaacattcaagccgcttggaggctcatctcacaagagatgaacttagggcaaaagctctcgcatatcccattcgcctgtagaaaaaatcgattaaagctcccagccgtcgactcccacccgcaacatgatgtccaaagagcagttcaagtgaagctcaacttgcaattaattcgggatatacgtaggaggggtaagaataacagttggctgctcagaattgcagagaacaagaaagacctggtaacacagtactagctacgaactagagccacacgactcttacgacctcactttccgacaccgcactgtaacccatatggaacctaaatttggctttgctaacatggagcaaacaaacgggaggaaagatgatcaaaaagctctttcagctccttatcttgggatagattaacacacaatccatcatcttgcaagcccacccccctttaatttattctcgtaaacgcgtttcgccacgacaattggcactacgtttgacctggaaccgaacttgtgcaccgtatatcccccccttgtcatgttttcccgtcctcctttaacggtctgggcgactcctcctttaacccctctttcctcccctttgcatacgcaacatgcacatgacgaatggtcaaatgctacttcccatgtgcttgcccctatacacaaggcttacacctgtacaagtggctcccgctgggacgtggctttctctcacggaatccgatacatctacgcatcttcttgtgcagggacttggggctctttttctctg

SEQ ID NO: 618077 - DNA, 684 bp, Homo sapiens
tggctgtaacagtgtttattggataatgagtccagggttcttggttgaagccttggtgggggaggggcacagagcgaaagggggcgtaagggaatgtttgaaggttgttccgtgatgtcggtcggagcttccaaactaggcgagggcagggttgaggcctcgggcacacagccggacgcccagtcacccggcccaaagtggagggcggccgggcccgtgcgcaggcatttgccaagggtggctcacactcacgcacactcgcaccgagaacttcagaggccgctcttccacaacctccacccaggtgcaaatgtgactttaggtgcaaatttaaattctcaaaagggacgggggaaacagagttcggtgaacaacagaacagttcattcctttctttttaaaagtgggtgcttaagtttccagcagaattgccacattaaggggttggccattgtgattacccctgtggggaacattttctgtaaattcccattgacacattccgcctttggtattacatccggggtaatgagaggtggctttcggcggccagttattagcactgggaagtcacatacctaagtactggtaataatacctcaaggtttgaggagcttgttggtctcctactttttggtcaatctctgaatgtacggactaaatctacatgctgtatcataaaag

SEQ ID NO: 618078 - DNA, 450 bp, Homo sapiens
  misc_feature (3)..(3): n is a, c, g, or t
  misc_feature (19)..(19): n is a, c, g, or t
acncgttgagtaagctaangggtgtatataagtaccccaagtgtgtataataatggattctcccactgattttatagagaagaactatatttcccagtaatcttcccctaaatattgtgggaaataattctgttttagtgaataagcctaattaaagtctatccagaccaccatgtttttatttacagtgactatatatatccatgattttgacatagagtataattctgatgttacttatttcaatatgccttgtatatattagctgtttataagagagtcgctttttggttgaaaagtatttctaggctgagcaaggtagctcatgcctgtaatccaaacactttgggaggccaaggcaggaggatcacttgaggtcaggagttcaagagcagcctgggcaacatagtgagacctcatctctacaaaaaatatttattaaaaaaaaaa

SEQ ID NO: 618079 - DNA, 122 bp, Homo sapiens
gataggtcaaaatgcgggaatgtaagaagaaggcagggtgacacatggttgacaaagcgatagtgtgtgatgaaagttgtcacaggtgaccactcttaactaacccaccaaggtagcatccg

SEQ ID NO: 618080 - DNA, 362 bp, Homo sapiens
gctcgactgcatgcggcatggccccagccatgaagcgaacttaaccgctagtgccgaggacacattaaacgaacaggatgggccgggcacggtggctcacgcctgtaatcccagcacattgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctc

SEQ ID NO: 618081 - DNA, 295 bp, Homo sapiens
gtgatctacaggatctggcctcccactggtgctgtatggtgcgtacaccttgtaatctcagcaggaggcgggagggttgcttgagcccaggcgttaaagaccagcctgggcaacatagcaagaccccatctcaaaaaaaaaggggggggggcagtgattgtccctaacaaggaaagaaattctttcagatgaggggtcaacaaaaaataaagaccctaaaacatttctaaaaagtcagaccgcatttggatttttggcataacctaaatctgggaatatgaagtaaaacagaaaa

SEQ ID NO: 618082 - DNA, 153 bp, Homo sapiens
caggcgaggggctacacagaagcagccagcagttcgtgaattgccatgaaatccaaggtagaaaaacaaaactcactggttctgaaaaatatgcttttacatgttcatatcacagagccaccttatagcactactcctcgctacataccgtat

SEQ ID NO: 618083 - DNA, 116 bp, Homo sapiens
agcgcacttttcgaactggttcacgcagaatcgggccaacatacgataggagttggccttgagcttttcctcattacccagaatgaggtcgacttcatccatggcctcgaatttgg

SEQ ID NO: 618084 - DNA, 381 bp, Homo sapiens
ttacggagactctctggaagagcatcagtataacatataatggctgctatagactagagcaccaactcagtcaggcattgtcctatgcgattaaccgtggagatgttatctgtgactcctttcaagtctgtgggtaggtattatgataatatgtcctctaatttatcatgacatggagagttaactaacttgctcgaactcagtcgtggatctacgcacttcaacacacagcccatgctgaatgccactttaccagttgcccagctgctttctattttccaaattctaacctgtcctgtctgcgtttcggcacgtctccgatccgtcccgatcttgaaggacttacggtctttgtcttttttcttttttttgtttcttttt

SEQ ID NO: 618085 - DNA, 659 bp, Homo sapiens
ggagagagacctagtctcgagttttatttgtttttttttaaaatggcggaacaaaaggttacaaaacagaaaagcaccaagaacaaagcaaacccttacttttgacaaagtgcacttccctggggcccatgatctatttcttacaacgactaaccaaaagtacaagtcctacggtgtcgcgaaggggtcagagggtttcaccctgtaacgtccggccctttgggtcccccttggggcagacatccctttcccaggtgtgtgctggacctgactctcggtacactgtgcaacccgaccaaacactctaggaaggtctgcacatgctatgatctgcttacaaggtcacgatgggctcacctaaaacttaggcattcctcaccagtgttttaaaaagctgctaaaacaaccgttgtgaacaaataacccaattcccagaaagcgacccatataacctgcgaagtatcccaaggggacatagactcataacccaacaacatgacccaggacagcaacagaagacagcggttgaacgctaggggggttgctgccaaaagatgccatgagaaagagaccaccagacaacacaacgagacggacaccaatgagatgagtggccacccagagctgcaacacaaccgagggcatgggactcactgcaa

SEQ ID NO: 618086 - DNA, 382 bp, Homo sapiens
ttggggcgtcacagcctaaggtgaggctcctgggttctaggcgccaggccacacaggcccttatgcagccctcattcggcttgcttctgcctgtgtcctctctatagacgtgtgtgcgccacaagtggcaggggagcatgtaatgtggcatgtgcctactgtgtcccgtgtgcctggggacatgtgcccatgcagcgcaaaatggaccgtccacattatggcatacttcctatttccgtctcccagtgacgcctctgtcctggctctgccagggcatgggcttgaatgacctgtggaaaaagtctctctatgctgttatgtgtgtgtgtgagacaaggtcttgctctgtcacccaggctggagtgcagtggcgcgatcgcag

SEQ ID NO: 618087 - DNA, 453 bp, Homo sapiens
  misc_feature (9)..(9): n is a, c, g, or t
tccgcttcncaggttccagtgattctcccgtctcagcctccccagtagctgggattacaggcacacaccaccatgtccaactaatttttgtatttttagtagagccttgttggccaggctgatctcaaactcttggccatctgttgatccgcccacctcggcctcccaaagtgctaggattacaggcgtgagccactgagcccagcttaacctttttttgttatttccaaaagtaatacatatttaaggtatagaaattcagaagccataagtaagcaaaaagaaaacacttaaagcgagggagaggggttgaagacaagttggttaattggtacagaaataaggtagaaggaataaattctaatatttgatagtacagtagggaaattatagttagaacaatttatggtgtatttcagaagagctggaagagaattgtactgttcccaatac

SEQ ID NO: 618088 - DNA, 273 bp, Homo sapiens
cctaagatcccgcgctagcggcatagtgaacgcatgtcgcaggtggtggacgccggtacggcacgacgggtgtcggggagtttcaagttgcccgacggcaccctgctgaccatgggcggcaagaccggcaccggggacaaccgcatcgagagcttcggtgctggcgggcggctgatcggttcgcgttcgttgaaccgcaccgcgacgttcgtgttctttctgggcgacaaccatttcggcaccttgacggcgttcacttaatgccgctagcgc

SEQ ID NO: 618089 - DNA, 365 bp, Homo sapiens
  misc_feature (291)..(291): n is a, c, g, or t
cacaaattgacagtagacaatatggcagaaggttttcaattatcaagactgcttttcacttcttttatcacatggacccttctttgatactggcactgaatctaaagcaaatggtagaagaaagatcagtactatataaaaatgtttttagagaaatgaaacggcaaaaagtcgggcagaaatcatgatgtacttctataaagtcgagtgtgcctgccacttctgcatccccttctacctctttcacccctgcaattcctcagacagcaagaccaacccctcctcttcagnctacccagtgtgaagacaatgaagatgaagacctttgtgataatccattccattatagtaatatattttctctt

SEQ ID NO: 618090 - DNA, 864 bp, Homo sapiens
cgtgaagcagttattttctacgctacctgtgcgccataaggaatttcaaaggaatattaagaagacgtgcctgcttccccttcgccttctgccgtgatgtcagtttcctgaggcctccccagccatgcttcctgtacagcctgcagaactgtgagccaattaaacctcttttcttcataaaaaaaaaaaaaaaaaaaaaaaaaaaaaaaaaaaaaaaaaagaggggggggggcgaccacaaaagattatcccccccggggggaccacaagaataaagaggcggacaccacgcgctttggtgagggacaaagggggcgctccaccaaatagtgaggagcgccgccgaactataacaagacaagagaacaacgcgtgcgaagcgctcgagctatataaaacaccacggcgacgaagagacatgagtgggtgataaacaacaggagcgacaacatgaggagcgaactacctctacgagagaaaaagaaagagaacaccactaccaccatcgcgggcgagagggcggaaacaacaacgatggggcacagccaacccaacccacccctacagaacaagagtacagacgtatatataaagagcgctaatagagggggaaaacacaatataaaataacagacttattagctagcgagtgcgtgtctacatacttgggcgtgtgtgctcaaacccataaaccgtcacgagaccaactatatcagaggtcggtcgaccgtgataagaagacaaacattacttgtgcatgccatcctcaacacgatgagaattctgcgcagtttatgacaagcagacacacaacttgtttcttctgacacctagcaggcggagagactactagagtacataaat

SEQ ID NO: 618091 - DNA, 808 bp, Homo sapiens
gtctgtggccggaggctgactcagtgtctagaacagatcagacttttgtaatgatgcctgaaataaaattaaccacctcgaaagcaacaggttccctctgggcagagatgtgtatccttatggatgaaaatgacactaaacatgggagtctggagagcaggaagatgttgtcaccttgaaggagacaccttggagaagggattatggcatcgagctttatagtgtcttctaattcaacagggaaaaataagcttctggtacacaggaaaagatcagatgctaggataaccctttccaaggtggtcttacagcgaattacgtgtgtgtagtcatccattataggccaattcaagccggagttttggaggaaaatgtgcgcgccctttggaagttgatggggcagacagccagaacacagacagaaagggctgacagaggtagacgcataggaactaccccttgtgggacaagacggttcctccacaggacgggacaaaatcacttaatcaacccaccggaattccatctaaccaaagtctccagtctagatgggtatctgggggtggaacattggacacttggattaacatattgttggtgggggttgaggaacagcagatgtacgttttggacatccgagatcccaattgtgagaattcagaggctatgggtgattgtgttccaaggggaggaactaagcagaaactttcgtgaaaaaaggcagccaggggttgaaattagagatacggcagggttaaaaatatttgggcaggaacttctctttagatgtggtaacttaatattggac

SEQ ID NO: 618092 - DNA, 124 bp, Homo sapiens
tcgtccccagtctattacatgtacaccaagtcacaacgtaggtagtggtcttgtataacatagtcccatatttcttggaggctttgttggttccttttcattttcttttccaatctgtcaatca

SEQ ID NO: 618093 - DNA, 247 bp, Homo sapiens
  misc_feature (109)..(109): n is a, c, g, or t
  misc_feature (165)..(165): n is a, c, g, or t
aggatcccggtattgtgtggtgtatgagtacacattgtatagtgaatcggctagtccattcaatacgtagtttcggcagaaaaatcagaatgattctgtcacgccccgnacacgcatcctgccctggccgcagcgcgtaagaaaccgaactataaccacccactnagccactgggccaccacagtccacctgaaaaggaccacgtaggtcgatgaactcattaagctcaatgccatacatccaacac

SEQ ID NO: 618094 - DNA, 172 bp, Homo sapiens
tggatgcacagtcgcgcaggagatggtggtgggtggaactggcagtgtcagggccggtgctcagtacccgtggtcagaccccagaggccccaaaggcacttggtagcagggggaaagagcaaggtggggcccagctggtctcagagggcaagcaggtgaaatggaactgggt

SEQ ID NO: 618095 - DNA, 294 bp, Homo sapiens
caagattgcgccattgcactccagcctgggcaacacagcgagactccgtctcaaggaaaaaataaaaataaaaagggggcacgggcccgtgacatccccacccttggaggctgtcttttcaggatctgccctgccctagctccacaccatgctcccaggactccatcacgctttgtgcagtggcccccacagaaagacctgagcttaaggtgggaaccaggtctgataacttggagccccagtgccaagaacagtgcctgcatgtatttatccaataaatgtgaaattctgtcc

SEQ ID NO: 618096 - DNA, 104 bp, Homo sapiens
cacaacagctcaaagtgcaaggccccatcatcaaacaggtctaccagttggccattccaacaggcaaacaaaattccagggcaacaaatcagccagtcatcaca

SEQ ID NO: 618097 - DNA, 137 bp, Homo sapiens
tgaatcacatgctgctagcctggtatggttatgggttctaattctctacaaaatcaaccagccatgatggagtaaagaaagttagcaagagtaaatatggtcatcataatttatattgaaacacttccagagtacaa

SEQ ID NO: 618098 - DNA, 910 bp, Homo sapiens
ggggcacggacagcttgggacccaggaccctaacgcagaggcgcttgtgtttggaagtcccagctatcacgggtccccaccatatggggcctggacagatgccgtcctgacaggccttgttgcttctggcgcctgtgcgccaccgacggaagccccccagtactgcggtcggcttgaatactggaacccagataacaagtgctgcagcgagcatgcgcgtgcaagcggcttcggggctcgaccacaccatgccgcggactatgaggtttccgggaaaacgtagctggtactcaaatgatccacggcgattatcgtaacgcgcgcccggttccgaaatgtgttcttgctgggcagatgcatagcccggacggcagcgggaagcttatgtaggcgccctgacagggtcggcgggaggccgttgaaccccaatactcccaggccagcgagcgccggtggtgcaagaacccccggtgggcatgctgctatgagagaggccggatcccctgcccaaaggggccactgtggcgcccccttcggcgagctcttgggaaaaccgcgagggcggctcccttaggctccccataggaagcgcagctcatctagtcaaagttccgtttgcctgggagagacccctggagccttgtcccctcagcggggcttggccgaattttcctttgccggcgcggtggttgcctgggtcctggcctccttgaacctttgtgcgtgcagattaggcgaatccttccttgatttaatgtctgggcttcgtggaattcttctggccatgggccccaggggaggaaagggcgacccttagtcgcttatcctgggctgtggtctggaagagccccaaaaaaaccagagccctttcctctcgcattggtcctacacagggcgcctggaaaaaggg

SEQ ID NO: 618099 - DNA, 168 bp, Homo sapiens
acgagcgcccaagtaacagcgacttctacagagtgcccatagatcatgtcatggtccagctttaataagtggtctggcttattccaagaagggattttagagtatccagactacaagtttaggtacagaataatctgtgaacatcctgacacttggggcgctcgtgcc

SEQ ID NO: 618100 - DNA, 333 bp, Homo sapiens
ccgagtgccggggggaactcgtccgggactttcaccaggctccagaggcgctactgcatctgccagaccacgcgccccctgtcatgggtggagtgccggcgctcgtgccaggccagggatgctgccagggccttcggtgaaccggaggaagttcacctttgagtgcagcgatgggacctcttttgccgaggacgtggaacagcccaccaagtgtggctgtgcctctgcgcatcacgtgggcgtggacaggccggtgacggcgggcaaggggcccacgcgctgcagcagcgcagacagtcgccagcagctgcgctggggtccaggtcatcacag

SEQ ID NO: 618101 - DNA, 237 bp, Homo sapiens
  misc_feature (17)..(17): n is a, c, g, or t
ggccgcgtcgacgtttngaccattctagtttgttggtgatgtgtcctcttcacgactgtcttggtgtgtttggaccatgttagtttgttggtgatgtgtcctcttcatgactgtcttggtgtgtttggaccatgttagtttgttggtgatgtgtcctctatacgactgtcttggtgtgtttggaccatgttagtttgttggtggttcagccggccgcgaatttagtagtagtcgacc

SEQ ID NO: 618102 - DNA, 270 bp, Homo sapiens
tgcatatcgggacgtccatcacccggagggacaccatgttcggaagcacacgagtccaatgctctcggcttccctacgtcgccagatgcagttcttgtacaatgcttagcctgagcagggatgcagcgagcgaaggcagggcctcggtcgcagtttgtaggcacccaggtcagtgatgttgttctgggacagattgagggtttccaaggactctcagctggggcgaaggttgctgagagcctgcgatacatccctcgttccccaattatg

SEQ ID NO: 618103 - DNA, 1198 bp, Homo sapiens
ccgggcctgaaggactcctaggcgtggagcagagcgacaaaacagaccagtttctagtgacgagacagcggcaggacagtcatcctctataaggtttctgatcagaaacccttggggagctggtcagtgaaacaaggtcaaattataacatgtccagctgctgtgcaactttcaaactggagagtatgttgttgtacacgattttacaggttattacagaatatggaataatgaagatgtaaacctggcataaacgtattctcacagctacattgtccagcaagaagtatataggatactttacagtgcaagggacagaacccattggtgctcttcaaggaaggtgctgttcgcggtctacgaggccttgagttgcagaacacccagcagaaaattgaacactgtatatctctgaatgaagaacgtgattaaatggacaaagtatctaacgctagtattcagacatcctgtatctaattatcttatatactgaaaaacatggaaactcactttgcttacgctgcaaactgtctaactcacgtatcttaaccaaatatacactcttacttggacaagacgaaaactctgtaatacagagtacaactgacatctgtagatcggaacattacatactcttggatgtcattacgctctgatggacgcactatatgaagacctcgaataccaataacagtacagacgaacccagacaacaactcagagcttaattaaatcactgctgctccaaggaagtggcatacagataagctacgcaactgcagttgacaatacatggccgtggaatcagaaacaagatgaagacgatagaacagtaccacaagctcataaggaaaggacaaacaagactgaaacaaaatctccaccataatgaaaataagacaatacaaaggaaaagacaacacacacaaagcaacacaacgaaaactaaggaaaatcacaaagtaaaaacacaccgacaaaagactcaataagagtcacaaaaacaaatctcaacacagaataaaatactcaaacaaacaacacacactaccattcaaaccgagaacaatacatataaaactacacacatactatacaaaacaatatagacaaataaagagaacaaagaccactaataattaactatactaacaagaacacatcatatcaccaacccacaatacaaataacaatacac

SEQ ID NO: 618104 - DNA, 992 bp, Homo sapiens
gtacaatgtacgagaggaactcgtcagcctgtaaattccaaggtagtaagatcgaagcatgaggcagaaggtgctcgtgaatgtgacaaatgctgttggttgcttgaacaagtaacgagggtaccgcgggggtgatcagaagctgtcgctagaaatgcctcagaatatgatcctatgggagagatgtgccggcaacaagtctgtagagacatcggaagagacatcgttcaatgaaatgcacgtgacgacaacgtgtggagcccagcaattcacccccggggaccaattctggatcatccttcactggacagccacagggggccaagagggttggtttccatgaacgcaagctgcatagtggcttaattacttgtgactggacctctggtccctcaaatcgaggttcctctaacgaaaggaaacaccaccagaacattggtcatgtgcccaacgttcaaaccaaaaaatcgatactcaagcaatgttacaaattcccaaaaacatcttacgtgattgcttaacttccacagaagcaaggaaagctgggaaagccccagaacacccaggaaggtgagatcttcgaacacaggaaccacagcagaagtttatgagcatcagggagcccagcgcaagattgactcagaacggctgcggacctcccaacattttcccacaaatcaaagctattccctcagttccaggactacctgcgaatctggtgcactgacgaatggatttatctcacaattgtggttctaaatgtcttagacctataataggtgatcaaaaaaacacaaaaacaaacatgtttgggtctcgcagaacgtttcacactgcgtgggccgcaagagaagaaagagaagtgatcaaacacgcaagagtggatccaaaaaacggggacaggttcacacgagtaggatggtaaagaacgagaccgggggaagcggaccaggagccaggtcacgcattattcaccatagttatgtcactac

SEQ ID NO: 618105 - DNA, 463 bp, Homo sapiens
actgagcggcgccatacagtggctgaaacagctgatgcctttcttcttgcttatgtggcacttcattctctgtgtctaaacggtttccactatatttcacgtacagcagcggctagcgaacattcaagccatgtggtagctaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacgaccagcaggatcccctggcagaactaccacctgaatgactggatggaggaggaataccgccacatcccgggggagtacgtccgcttcacc

SEQ ID NO: 618106 - DNA, 132 bp, Homo sapiens
gtctcccgctttactccgctcctggaggcgtgagagttccaggttcgaacctgtaataaagatcctttgcacttgcattgacgcctgactctggtgagcttttctggggactagacggacttggcacaacat

SEQ ID NO: 618107 - DNA, 100 bp, Homo sapiens
tgggatttcactggaacaaacacggtgctgtgagggccccgccgcttgcccgtgacacgcagcgcgttggtgtctccgtgtttgtcccagtgaaatccca

SEQ ID NO: 618108 - DNA, 537 bp, Homo sapiens
attatatatatatttttttttaattatttattaatagaggggggaggcaaaaatataaagccaactcaaaaaaaggaaaaaaacctaccccttataaaaaagcaataaaaaaaaaatgggtaaaaaaccaaacaaatctaaggaaaaaccctaaaaaaattgaagggggacaaaattaataaaatgaaaaaggtttgtaaaaaataaacgtacaaaagcagaaaaaacaacaaaaaacggcgtagaagataactgaaaagtttaacaaaaacagagaaaatctttgaaaaaaaagagaagagggaacctggggaaaaaattaagtaaaaaaaaaaactggaaattaaaggaaaatagaaaaaattttggataaaaaaaggggggcgacaaacgggaaataaaatggccataaaaatctggaaaggagcttaacctcaacaagaagagcagcaataaaggcccataaaaataaaataaacacctgctcctaagtaaaaagaaatctcgtagaaacaacccacagtagaagacaaaaac

SEQ ID NO: 618109 - DNA, 252 bp, Homo sapiens
ccctggggcctttttttgggggccccctttgttttttcctttctagccggggaaggataacaccaaggggggggccggtttttttgggggggggggggccccccccaggaccggggccagggggccccccctttggttttacctttaaattttgggggggggcccccccgaatttttgggccaccccggggttccccaccccaccccgggttcccaaaaaccaaaaaaaagcccggttttttggtttttgga

SEQ ID NO: 618110 - DNA, 852 bp, Homo sapiens
  misc_feature (240)..(240): n is a, c, g, or t
  misc_feature (604)..(604): n is a, c, g, or t
gtagagtgtggtcaggtcggctcggattgaacaggactttccttatcccagtttgattgtgcagatattacactgcactgttcgatgagtcttctaattcatcgatggcttcttactgatatcctaggtgaaagaacttgggagaagccgtcgactcacggtcaggcattcagacgcttgcattcatccagcccatcgtgtccataataggaactctgttcaacatgaattgcccgcctntgtccacactcacaagagaagacaggatctcttcacctgtggcatggaaactttccagaacgaattattgagaatgactagcatagacatgaaatgacgcattagtccctatgtacacagctgacgtgtcattcgtaagtcaggtctcgcgctgagtaaatccgtagacgtcaccgacgtagaacgataggtgtcttcacgaacggcaactatgaatgaggaaacacagcaacttcagctaacaccatggcacgacagaagataagctgatcccaacaatacattggaatgcttaataaacaccgagataccgcaagaggccactaatatgagcttggctaaacctggacacgttctgcgcagnagaacggataaagccacatctgaacgatagtgacggaagtaacaagagatatccaaacgattcctggctggacgaggactgacaagcgtgactaaatttcgttgctggagaactggactttctccccaatccccctttcctaaaatatccaagagatctggtacttggtccaggttgtcatctcttatttttttcccctacctgacaaaatattttacgaagctaatggtaggactggtataggtaga

SEQ ID NO: 618111 - DNA, 885 bp, Homo sapiens
  misc_feature (166)..(166): n is a, c, g, or t
gagttcattgaaaactcatttgctcttggagcagtcaggcagtgaccgccttcggctttttttctgctgactaagatctcctatagagagctacaacaatgcccaaaagaaaggctgcaggtcaaggtgatatgaggcaggagccaaagagaagatctgccaggtngtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaacgactcagaaacgaagactgaagaagatcaaaacgaagagaacggggaaagctggaaaacgaccgaccaacgactgaacacacggggaccgacgatggacacacgaggactaccccctggaccctgacgaccacggagacagatgcaaaagagaaaagaagatggacaacaacgggtgaagacggaaacaggaaatggagaagatggaaaacggagaaaggagaagatgacacacgaggacgaagacgaaaagaaaccgggagatggaaaagagattgacgatgcgacaagagacaggggattacaaaagaggggaaaggatgtaaagtccaagaagatgaaaagagagaagagaattggaaagaagattaaggtggcaattgaggaagaaggtggaaaagaa

SEQ ID NO: 618112 - DNA, 296 bp, Homo sapiens
gcggcggcggcagccgcgtcactggcgggcgggatcctccgctctggggaggcagcgctggcggcgggctggggccacgtgagtgaaatcatccgcgccgccgccgcgccgccgcgcgacgcctgctccgcgcggaggaagacagcgccgccgcgcaccgcagcgacccgctgatagtccaccgcacaggcctcggccgcggcagactgctccagcgggctgcgcgatgtgctatccaccttacagtttatacaaccagtcaaacctttttaaatgcccccctgtggtttcatttt

SEQ ID NO: 618113 - DNA, 316 bp, Homo sapiens
ctcaatccgagcgcggtaccggcctgtgcgtgtccagccgatcgtgccccgcgtgctgaaactccgtcgcgcccgccaaatatacgactatcacctgtcccgtcttggtattgcgccactgatcccctgcctaccgaagccacaaccaccgtaccccagatagcggatatcgcggctcaaccgcgaaagcgccaccgtaccgcatcccgttgttgtcatattgttccccgaataagtccacaaaaaaagaaagaaaagaagaagaaaaaaaaagaacgggcccaaatactgcattgtcgctggcctacagcacatg

SEQ ID NO: 618114 - DNA, 142 bp, Homo sapiens
cgaacgctacggggcggaaggctaaaggggagtggcccagtggcggtagctggcggtggtgccaatggtacctctttcagctacacatatccatggagaccctacatgccatgttatgctgagtacttctggtggcagaaat

SEQ ID NO: 618115 - DNA, 931 bp, Homo sapiens
gggctggctgttcatcccacatcgtgtggggcagtgtccatcccctgcagctacttggtgacttaacatagctccaggagccctgtcagactgccctcctaccagcataaaccccttcgactcgttctgctttgacaacagaccatgacattggggaggggaggtgctccgtcgtcccagcttttctcagaatagtcctatagatactggtgatctggacactgaagaagtaattctgtctctgcacctactttggcagaatgttgcacggacagtattctgtgttagtatctaatgccaaacaagttgtttgtagaggtcttagtacctcagcacatcatacaataccaccattactgtctgtcacttcagagggcatcgggacctggctggcgcccttgtgatgtgctatattaatcagtgtaacgattggtcacgttagttacccatgtatgctgtgtggatcatgtgtatatcgtccagaacagtcattacggctttcagcgtagatgcaactggccgacccttggcagcagggactgctagattgtactctgaccaacaggccaacagacctgatctctgtctctggttcaggtaacttacgagagatacactcagtctactgaggttagaactacatcatgaatccccaaacacactaattgagtgggaccccattgcccgagcctgacgggaaacagcgagcgaggcaacaacgtaataagggggcccacaggctgtccaaataccagatgataacaacatgaccacacaggtttgtttctgtggatcacaaactatgggggatagaaacattgatgcaggggagctccaccgaaaaagtgtgcaaattacaacaataacactgtaccaactgtaagacccagaggggataaacacttgcttataacgacactacacggaacaa

SEQ ID NO: 618116 - DNA, 507 bp, Homo sapiens
  misc_feature (27)..(27): n is a, c, g, or t
  misc_feature (47)..(47): n is a, c, g, or t
  misc_feature (69)..(69): n is a, c, g, or t
  misc_feature (78)..(78): n is a, c, g, or t
  misc_feature (116)..(116): n is a, c, g, or t
  misc_feature (125)..(125): n is a, c, g, or t
  misc_feature (137)..(137): n is a, c, g, or t
  misc_feature (155)..(155): n is a, c, g, or t
  misc_feature (183)..(183): n is a, c, g, or t
gcacggatcacaactcactgcagcctnaaactcctgggctcagcaantctcccaccctcagtctcccangtagctggnactacagggatgcacccatcacacctgggctaatgttntaaattttntcataaaggccngggtctcactggtgtttnccaaggctgggtctcgaactcctgggcncaagtgattctcctacctcagcctccgaaagtgctggtgtgaggcactgtgcccagcctattttatttttatttttgtagagatgcagtttgactgtgttccaaggctgacctcgaaatcctggccttaagttatcctccttctacatcggccccctaaagtgctaggattacaggtgtgagctattgcacctggcccttggtttacattgttcctgttgacaaatcaatcaccagtgatactgttatctttttaatttttttttatttttgtctttggctttcgaagttttactgtaatgcatctagttgtgatttctgttaa

SEQ ID NO: 618117 - DNA, 1497 bp, Homo sapiens
  misc_feature (459)..(459): n is a, c, g, or t
  misc_feature (477)..(477): n is a, c, g, or t
  misc_feature (759)..(759): n is a, c, g, or t
  misc_feature (779)..(779): n is a, c, g, or t
  misc_feature (836)..(836): n is a, c, g, or t
  misc_feature (1451)..(1451): n is a, c, g, or t
taagggaaggaaaatttcaaacatatagcttttattgtgggtgacctccggccccctttgagaagcccatatagtctcacaggccctcagggggtgtccgtgataagtagagcctctaggaaacctttgccagtcttttcctcactagtataagacagggctgtgaaagcgtggtgggatatcttctccttctacagtgggcgtgccatctcacacacgagtttacacgtgttgtgggagggtgtgtggtctcataacaacactctcattatataacttctcatgtgtggttctcacagcgcgcgtgtcacaaaacccgagggggcgacacagatattgaggctgataatctcacatctacatatagagagagatatagagaaatcgtcgttgcgcaccacaaaagagagagagggggcgcgtctctctcctctatatatatagcgcgtcagagaaaancctctctctctctactanagcgcgtgtggggagaaaatatctctcttttatacacgagaaaatatctctctctctctttataggcgcgcacgagaaatatagagctcttctctcttatatatattgtggcgggcgtctctataaatataaaagcgctatctctctataaccccagagggggagtgtgcgccaccccctcttatatagagagacaacacacctctccatagagagaactacatctactgttatgcggtgtgagaccagaaagactatctctccctccaagatgaggggggngggctccaactgcgccgggngacaacaaagagagcaatagtcttttctccccgccggggaggagataatgtgtgctntttaccaatctccacgaggggaggttaatctcctccaccacgcagggtggttatatggtgggcggcacgaaaactctttcctgtttaaagaaaaccactacccagcgcggttgaagaaacctccccgacgaagcagcacgctggtggttctctctcccccacagagaaaagtcggtggggtccgcccccccaggagaagcacgcaaacgaggggcggcacattttctcctctatatagagaggagaaacccccaacctcccgagggggccttaaatattacctcaccccacgggggggcgggaacacaaactgcggacagaaggcaacctctacacgagcgcccaagaggaaataacccccccattagggacggagccttctcacgaggggggaaacataatagaaaccaggcgggttcacctctctcttcgaacgcccaagcacgcggcgggccaagaaaaacccctcatcaatatggcgcgtgggagaaacaattcgcgggggatatcagaagggcctctcacgggggagaaactcggccccgcgggaggggggcgagcagagttatacccctttaccccccacagagcctctcgtggggcgtgcggggaaangtcctaacaacaataccgagaagacgagggcgcgcagctctacata

SEQ ID NO: 618118 - DNA, 402 bp, Homo sapiens
cctcacggacgtgcgtcggtggaccacgtaccaccaagggtcactggagatcggctaatgggcccgaatgcgtggctgcgctgtatatttatagtcatacaaggcaaggggacaggttatggagtgtgagccatctccaatgataggtcaggtcacgcaagtcacgtgtccactgggcccttccctgtttggcagccaaggtggagagagaggacagctgacgccattattttttctatgtattcaaagactttagcactttgactgattctgctactgctatctagaagacagagccaggtgtacagagcggatcatgaaagtggaccaggagcgtgactgctgaagcacagcatcacagggacacaggcctctggatggctgcgggcgcagtctgtgagg

SEQ ID NO: 618119 - DNA, 165 bp, Homo sapiens
tccatagcgtctatccggccagagcacgttgcgaggggacttttttcaggtggctgtaagggaggcctgcgtactctggttagttggactgcctcgttgtggaactttctcaaaagtataccactttctattaagtggattggggagaggtggggtggtatcaga

SEQ ID NO: 618120 - DNA, 1476 bp, Homo sapiens
tcaagcaaatgaatacttttattaacagtggataagttttgtgggttgtgtttaaacatgtggtagggttttgtgaccctcaaatatattgtgtaaggctcgtgcatacctcaaatgtgaactttacagtcgtggccaacgttagtgaccctttgaagagtgcctcttcatagtctccagtttaggggctccaatgtgcaagacaggtctccatatacctcttacattcccacaaggcccctctcaaggggcctttggccaattctttcacattttaatgtgccaaggctccttcataaaacggcatatcgggggatatttacattcaccacttggtgtaccagcaatatattcagagcactcttatattctttcatatttagagggattctccagtgtgtacaaaataagaaggcgatggagtttgagggtggtggctccaagacaaatcctccacacagaaacgagggtatacccttagaacacatagtgtgataccccaacaaaaccaaaattttcaaaaatgtatgtgcgaaaaccaaaacagacaacaatttcgtctttcccactcccttgtgggggctccctccaccacaaaaaaacacaaacaaaacaaaaaggggggggggcgggggccgaacctcaagcaagagaattaatctccccctagggagggggggggccccacaagagcttacagacgcgcagaaatacccccagaagcaatatctctggtgtgatcaaccacagggggggggcgcccccaaaaaaaagagcagagaagcgcaagcaaaataaaaaacaaggcacaaaggccgccatgaggcgcccaacaggtataacaacaacaaagcagacctagcagcaacgggcggaacaacacgcgtgcacacacatatgggacaaacctaggggcgacaacaaggaggcaccaccctacaacatcagcagaaggggagggggcgacacaaccagcaggggcacacacaaaccacccgctaagagagaaattcaaacgaccacaaagacgaaaaaattaatcaacactatacacaaggggacaacaggggcgtaacaacaacacaccccgcaactagcaccgcacatcgcgacaacacattcgggcccaccggaagcaaaataacctctagaaccaccattataacacggcaaacaatcagacatacacacagaccacccgacacgacacccaaacaaacagaacgaaggaccaagcaagagaagaacccaacaatagaacaaagaacagcagacagaaacgccggaacaaactagccatgacgctacagaaagaaacacaaacgacgacaaaacacgcaacacacgaagaacaaacaaacaacaacagcaacacaccacaacaaacacaactaagaaaccacaaacatcgtacagccacgaaaaggccgacaacagccaaacagcacagtaacgcaatagagagaaagaacaaaa

SEQ ID NO: 618121 - DNA, 263 bp, Homo sapiens
ggggggggtttttttccccccccaagggttttaagggtgggaaaacccccccgggccttccccatggtttgggcccccaccccccttaaaacccggggggccttaaaaaaatttggggccccaaggggggggggcccttttgggggctttgggggcgggggcccccccccccaccccccggcccccgggggccccccggggggggggcccaaaaaaaaatattttgggggccctttttttttttttattttttttttccccca

SEQ ID NO: 618122 - DNA, 228 bp, Homo sapiens
ttggcgggaaagggcccccccccctgggggggttttttttttgggtttttccttcccccccaggtggggccctttttaggggtttggtccccccccccttttttttgggcccccctggggggggggggggtgggggggcccttcccccagttttgggagggccaattttggggggggcccttttttcctttttggggggggaaaattatttagattttcttgtcccca

SEQ ID NO: 618123 - DNA, 138 bp, Homo sapiens
tgtttatcgatgccatcaaaaacaatttctgccaaaccttggggaaagtatcaggggttgggtgggccaaattcctcatcaagatagtgcaaacgggtttcctccaagctgtgacttctgcagagacagaaatgtccg

SEQ ID NO: 618124 - DNA, 136 bp, Homo sapiens
attcgcggtcgagtcgacgtcagcctccctggctgatacccttaagctggaactccaaaggtctctctgatcccaaacaccacccgcttaaacgtgctgcatgaacctgattcatgggtctctctctctctctctc

SEQ ID NO: 618125 - DNA, 213 bp, Homo sapiens
  misc_feature (1)..(1): n is a, c, g, or t
  misc_feature (58)..(58): n is a, c, g, or t
  misc_feature (81)..(81): n is a, c, g, or t
  misc_feature (105)..(105): n is a, c, g, or t
nctttgtcaggacaagactcttcaggaactcacttttctggtcttgtaactatcatgntaatcttttattggtacactgtntactaattataattgattgctatntatagccagggagcatatcccaggcatgcctcatctatttactaacaacaaagtatgcttactttatctacatagtgccacgggtttctcttttttcttctctttttt

SEQ ID NO: 618126 - DNA, 179 bp, Homo sapiens
gggaggtgcaatggcacaatcttggctcactgcaacctccgcctcctgggttcaggcaatgtttcctgcctcagcctcccaagtagctgggattacaggcacccaccaccatgcccagctaatttttgtatttttaatagagagctaataattgtatatttaataaagacgggtttcac

SEQ ID NO: 618127 - DNA, 899 bp, Homo sapiens
cccttgagcggatggtctgtatcgttccaacctctggacccaggacaacggcattctgatccattctccgaacgctgtagcccttggcctagttattacttcaaacccatgatgaacggagtaccggtttgagccatcctcacagacttgatcgagtgatgcaggcaaggccagagtcctgaagatcaccatacacggggtattcgagaaccgccttacaggtatgctcatggactacatgttgtctatcctgtaaacggagagactccgattcaaggggtttgccagggatagctggtgcgtgccaagatagtgagttgtcgagcgatttcacgtgcgcacgataccgtgggacagacggaacatgaggggcccaagtttcggggcattgaggtgcgtatctggttgcctggtattgttgtagtacccctaccgatgcaagtctcaaggcgtgaatggcaccccggacccacaatatgcagctgggcgcatctcgcactcaaccaataagaggttgatacgaagcgtgcggggaatccattgcattctatgacttgcatgtaaaagcattaattaagtggttcttgggccaagagtctatgtctagcctagacttatcagtggtgggacatgagttgacttcgctgtcctcatggagaataccgtgtcacataacaggtcaaatgtggtaacagccttatacaagatatagctaaaaaaagctcggacgtaattcctaactgcaagaatggttaacccgttgtgtccgagatacccatggagtcttaccatgtttaccccccctatatggtcaaaagaaagggcgaagaactggtgtttttgccttcaatggattttggaaatttcccatgaattccaggttggataatttgtggccc

SEQ ID NO: 618128 - DNA, 263 bp, Homo sapiens
  misc_feature (42)..(42): n is a, c, g, or t
  misc_feature (92)..(93): n is a, c, g, or t
  misc_feature (153)..(153): n is a, c, g, or t
  misc_feature (162)..(162): n is a, c, g, or t
  misc_feature (177)..(177): n is a, c, g, or t
aaacgaggggagaatcaacagagccaaaggactaataaaatnaatgaatcctggtgagactaatcaagaaaaaatagcaccaacaacaatgnngagaaaatggaaaaagggcagagtatttcaatgattacgaagatgggcaaaccaatcaangaatgattnttaagccttcacgtntgccctgtaagcaaactgaagacgtgcaagtcatcctttgccctgggagagttaacttaacccacagggacaacgagaagggacag

SEQ ID NO: 618129 - DNA, 190 bp, Homo sapiens
atgagacactgctagcggaacgaacggctctacagaggtaaatctagtgcactttcccctacagctagctgtccaggctccagtagcaggaatcaggtccccaagatttcagtttacaactaggagaaaaagcaggagggtaccccaagtgataccaagctatccaactagggaggggccccacgaatgc

SEQ ID NO: 618130 - DNA, 84 bp, Homo sapiens
acggccgtgtattactgtgcacggactgggtatagtgggagctacttgggctttgactactggggccagggaaccctggtcacc

SEQ ID NO: 618131 - DNA, 467 bp, Homo sapiens
  misc_feature (343)..(343): n is a, c, g, or t
gagacaaggtctcactgtgttgcccaagctgaagttcaggggctcagtcatggctcactgcagcctcaacctcctgagctcaagtgatcctcccacctcagccttccaagtagttggaagtacgagtgtatgccacaatgcctggctaatttttgtattttttgtagagacaaggtttcaccatgttgctcaggctgttcttgaactcctgagctcaagtaatctgcccacctcagcctcccaaagtgttgggattacaggcgtgagccactgtgcccagcctagagttttctatagtactttttttttttttttttaaacagggtttcactctgtcacccangctggagtgcagaagcacaaaggcacaatctcggctaactgcagtctttcaagttcaagtgatccttctacctcaacctcccaggtagctgtgactggaggcacccaccaccacgccccagcta

SEQ ID NO: 618132 - DNA, 319 bp, Homo sapiens
  misc_feature (54)..(55): n is a, c, g, or t
caaaactgctgcccccaaaggatattaaaaatatttttattcagccaggcgcanngtgtcacgcctgtaatcccagcactttggaaggccgaggcgggcggatcacgaggtcaggaaatcaagaccattctggctaacacggtgaaacctgtctgcactaaaaatacaaaaaattagccgggcgtggtgcaggcgcctgtagtcccagctactcgggaggctgaggcagaagaatggcgtgaaccggcgaggcggagcttgcagtgagctgagatcgcaccactgcactccagcctgggcaaagagtgagactccatct

SEQ ID NO: 618133 - DNA, 189 bp, Homo sapiens
cggaaggatctttctcacaacctagaaacccccatgggatgacccccagcctggctgggggtatgtaccatgtgtgctctccggtgaggacacaggaaacttgaacactaaatgatgcccccttatgctagtctttcgaaagacaaagaataaatggataatctgcccacccggcctggttatcctcag

SEQ ID NO: 618134 - DNA, 365 bp, Homo sapiens
  misc_feature (1)..(1): n is a, c, g, or t
  misc_feature (346)..(346): n is a, c, g, or t
  misc_feature (360)..(360): n is a, c, g, or t
nttcggcacagaaaagaatataaactattcaaaatattgagtgaattaaacaagattgcctgatgattttatttctatatgacaacaagaaaggaatttaaaacataccatttacaagcagaaagtacttgaacagttggatatctgtatgaggaaaaaaatgatcttcaacctctgcctcatatgatagacaaaattgcttcaaaaaagtagattatagatctaaactgaaaagctaaaattatgaatttttagatgaaaaaatagaagaaaatctttacaaccttagggtagggcaaaggttttcttaggtcacacaaagcctttaagcatttaaaaaattccngattaaatttaggntgttc

SEQ ID NO: 618135 - DNA, 484 bp, Homo sapiens
  misc_feature (15)..(15): n is a, c, g, or t
  misc_feature (67)..(67): n is a, c, g, or t
  misc_feature (94)..(94): n is a, c, g, or t
  misc_feature (99)..(99): n is a, c, g, or t
  misc_feature (101)..(101): n is a, c, g, or t
  misc_feature (109)..(109): n is a, c, g, or t
  misc_feature (112)..(112): n is a, c, g, or t
  misc_feature (119)..(119): n is a, c, g, or t
  misc_feature (128)..(128): n is a, c, g, or t
  misc_feature (147)..(147): n is a, c, g, or t
  misc_feature (150)..(151): n is a, c, g, or t
  misc_feature (178)..(179): n is a, c, g, or t
  misc_feature (199)..(199): n is a, c, g, or t
  misc_feature (201)..(201): n is a, c, g, or t
  misc_feature (205)..(205): n is a, c, g, or t
  misc_feature (212)..(212): n is a, c, g, or t
  misc_feature (231)..(231): n is a, c, g, or t
  misc_feature (238)..(238): n is a, c, g, or t
  misc_feature (245)..(247): n is a, c, g, or t
  misc_feature (259)..(259): n is a, c, g, or t
  misc_feature (316)..(317): n is a, c, g, or t
  misc_feature (319)..(320): n is a, c, g, or t
  misc_feature (323)..(324): n is a, c, g, or t
  misc_feature (328)..(328): n is a, c, g, or t
  misc_feature (347)..(347): n is a, c, g, or t
  misc_feature (354)..(354): n is a, c, g, or t
  misc_feature (356)..(356): n is a, c, g, or t
  misc_feature (366)..(367): n is a, c, g, or t
  misc_feature (369)..(369): n is a, c, g, or t
  misc_feature (374)..(376): n is a, c, g, or t
  misc_feature (380)..(380): n is a, c, g, or t
  misc_feature (392)..(392): n is a, c, g, or t
  misc_feature (399)..(399): n is a, c, g, or t
  misc_feature (477)..(477): n is a, c, g, or t
ataaacaaagatttngccaagtaaaagacatcaaaacaaatagagagaggggggttgggggggacanaccgcctacagcatctcaaaccccaanagaangngaggggcnganggaacanaacataggntacacatgtaagacacggnacnntacactaggtacaggggagtatgaacnntccacgggcctcgccggggngngcanaagcccnggggggggaagagaagggnagggagnaggcaannnagcataaggggnagttctttaaggtgggagggagaaccctgcgggagggggaggtggggggaggggagnngnnggnngagnagaaggcatgcccttaaanagacatncngtaacagcgnntncgggnnntggnctacttcttgtncttcttnttatctctctctctctctctctttcactccatttcattgaaccgtggcaaacatggctttccggacagtatctctgtnggaatcg

SEQ ID NO: 618136 - DNA, 152 bp, Homo sapiens
tcccgtattatctggtgtgatttagtgggataaagagcacttgtgtgtgtcgctgcggtatcccattgatacgccaagaatactgcggggataggttagaggccgagtggcaggataggttgaggttcgttcccaaaaggtcagactagcac

SEQ ID NO: 618137 - DNA, 156 bp, Homo sapiens
gagtgcactaggaaacctcaccaatgcagagaaccgaaaccccagctgcgaggtacaccagggagccggtgacatacactagctatatgaccctggcctgcaaggatgctctatcaccagtagtgtcaacaagcaggtccagtccagaggctagga

SEQ ID NO: 618138 - DNA, 661 bp, Homo sapiens
cgtggttgtgtcccgggtgttttccggcgaagggtatcggcgtgtctcacgatagcccggttgtcttgtgcgggcgcaggacttgcctttgtgaatcgcttcctcggccgcgttgtatgggcccgggttggcgggataagcggggcccccgtgccggtgccgcccggtcttcgcgggggtcttgcgcatgtcgcgacgccaccagtttcgggcgagtgggcttattggcgaagccagttgtcatgcgttatgagtggcgtcttgcgcccgcggttcacaagggattttctggttctccccccttctggaacttcgcggggagccgccgtgcccccccctgtatctgggtagggcgcgcccgcacacgccgcgagtggtgtcacgccaatcgagcgccacgcacatacatagtagaacacacagacatgtgtgcgggccggacagagagtattctatctcgtaccccgtggtccttgcaatactcccctctctacctgtggggaaatacatatggcgggaatcctcttattgtttgtcggtgtgaagaacccgccgagccgcaatgtttataaatgctaactcctccttgttgtgttaacaaatgtgtatcagtgttttctatccaaataaaagaaattaaaagacccgacatagatcagaa

SEQ ID NO: 618139 - DNA, 157 bp, Homo sapiens
ctagaggatccctgcaggctctctacttgttcatgtagtgcatgctctacatcttcttcagcatcacaaactcattctcagcagtgtgtactgcgtgttgatttcatcctcatcacttgtcttgaatgtcttccacccgtgtcctgcatgttgtctc

SEQ ID NO: 618140 - DNA, 573 bp, Homo sapiens
aataacgtttaatagtaaggaaacatgtcaaaatacataccagaggtcataaatgctaggagaggctctgagaaaggagaaaattagcataagttagattaggtgggggaaggctttcggcaaaacgtagaacatcccaagtctcaaaaaagttgctaggatttgattaacaaggaggagtagtaagaatttgcagggttgagaaatagaaggagggaaagtaaataacatgtttgttagtgagcagacaggtccaattggtcttggttcaggcagaaacacagtggggaataaggtgaggtggtaatgtcacaaggaaacagaagacaaggtaaatttagattgtggaaagcctcaactgccaaaagatatttaatctctatcctttacacttgatcttagtcaaaaggccaagaagtcacaatctctattttttatcttcaaagtttttattcaaaaaagtgaggtacgggaattggtattttcaaaagattgagagatttcccaggacacataaggatggtagaaaatagagacaaggagaccaatttggaggctactattatggtgcca

SEQ ID NO: 618141 - DNA, 114 bp, Homo sapiens
caagccaaatttcaaccatctttattacacatacaattctattaatagcacaaatgcactttcaatacatgtctgcatgtgtgtcttgtgtatgttgtgtgagacagcagagaa

SEQ ID NO: 618142 - DNA, 248 bp, Homo sapiens
aagttgctgctggatactttaaaaatatctgccagaagagtgaaggcactgggggtttacagcaagtatttactctttaaaacggtttattacttcaacaagcaaagagcaaaccaactggagaaatgtatgtgaaatctttttatttatcaagttgtatactacagctaaatatcagattccttttacatatagacctcgcaagggcacggtaagaactgagcacttgtgttattcgagggataaag

SEQ ID NO: 618143 - DNA, 516 bp, Homo sapiens
tagcggtcctcgcgaacgtgtatcctgatcccagtgtactggtgggaggctgagacaggataatcacttgaacttgggaggtggaggctgtactgagctgagactgcaccactgcacttgcactccagcctgggccagacaaagcaagactctatctcaaagaaaaaaaaaaaaaaaaaaaaaaaaattctgaatggctaaatttttccgggttttttatattccctacgggtcctggctaggctccctcttttaaaaaattgttctggttttcctctctggtacgtcaactgggctttaatattcttttcttctggctggcggcttttttttccctggctatcagtaccatcatagttcttaatgttggtctcctctggacactcattttctttacccttgaatggtgcacccttgtaatccagtttgggcacagtgaacccttaagaggtgttggtcatttaaaccaagctcaagaattagggcaggtgacatacgggataccacgttcgcgag

SEQ ID NO: 618144 - DNA, 239 bp, Homo sapiens
ggcagaaggatcacttgaggccaggcattcaagaccagcctatgcaagataatgagaccttgtctctatttaaaaaacaaaaagcctggtgtggtggtgcatgcctgtagtctcagcctcctgagtagctgggactataagcacgcaccactatgtctggctaatttttgtatttttagtagagacagggtttcaccacgttgcccagggcagtcttgaactcctgaccccaagtgatc

SEQ ID NO: 618145 - DNA, 601 bp, Homo sapiens
  misc_feature (37)..(37): n is a, c, g, or t
  misc_feature (41)..(41): n is a, c, g, or t
  misc_feature (83)..(83): n is a, c, g, or t
  misc_feature (93)..(93): n is a, c, g, or t
  misc_feature (124)..(124): n is a, c, g, or t
  misc_feature (168)..(168): n is a, c, g, or t
tacccccaggaaacagcttattccatgagatgttganagcngcagtgtccctgtctgagaacgatacaacgcattctatgctngtggaagcanggctgaacatatcactagtgtatcacggccnattggagaaacaaggccggggctgactatgcctcgtgtcttggnagacaaaaggcagggggtcagtcagtctgaatattgcatcttttggagaaaaaaggcagccagatggtccacgcagcactggaagaagagggtggtgatgtggtcagtatactgtgtccctaagaaatgtatgtactgtgaaataaggcagcaggcaggatgacttagagaactaaggttgtgggtggtctgttcattgtgtctataagaaaaaaggcagcaggatgacttgggaatcatgtccattggagaaataaggctgcacagtggtctgtgtatcgcatcctttggagaaggagcccacctgtcagagcaggatgcatctgttgggggcagggctcacagtgcagccccattgcagccagagggtaggagctgtagagaggggtagcagctccctggtcctcatggtcaggctatttcttgtccatca

SEQ ID NO: 618146 - DNA, 395 bp, Homo sapiens
  misc_feature (2)..(2): n is a, c, g, or t
  misc_feature (11)..(11): n is a, c, g, or t
  misc_feature (54)..(54): n is a, c, g, or t
  misc_feature (353)..(353): n is a, c, g, or t
  misc_feature (365)..(365): n is a, c, g, or t
antgtgtactngtacaaaaagttcatggatttcaactgaggaagaggttttgcnaaaattgcttcaaaaatgagggggaagccatgcctggctaattttatatttttagtagagacggggtttctccatattggtcaggcttggtctcgaacttgtgacctcaggtgatccgcccgcctcagcctcccaaagtgcctgtagtcccagctgctggggaggctaaggcaggagaattgcttgaaccagggaggtggaggttgcggtgagccaagatcgagccattgcactccagcctgggcaacaagagtgaaactccatctcaaaaacaaaacaaaacaaaacaaaacaaaacnaaacaaaacaanacaagaactggaagcaataaaggagagctg

SEQ ID NO: 618147 - DNA, 508 bp, Homo sapiens
ctttaaaaactggaaccgcgtgaaggtgaaacacccactcgcgtttggagcgcagcactccccccacagtgtcacccaagtggccgcaggaactttgattggacacttgttgtttttttaaatagtcacttcccacatatgagatgcgcttgttaccacggagagtcccctgccactccttaaagcccccccccttctctctaaggagaatggccccatcctctccccagtccacaccacaggggaggtaataaccttgctttcctgtaaaattatgtataatgccaaatttttttaatcttccgcccttagtacattttttattttgttttattttgaactgatgagcccttctgtgccccccccttccccccttttttgtccccccacttgagaatgtattgaaggcttttggtctccctgggagtgggtggaggcaacccgggcttagcctgtacccatgacttgagacccagttgaattaaagtgccacgaccctttaaaatga

SEQ ID NO: 618148 - DNA, 198 bp, Homo sapiens
cacgatggttagtactgcatgtgggtagataggttatattttcatacaaatatcatcattgaagagtgaaaagggtgttacataaatatctatcataagacgtgaggttcatgggtctggccagagactgctttcctccatctcatttcccgccactttccctccctcccactgcaatcactctttctcccctgtagt

SEQ ID NO: 618149 - DNA, 133 bp, Homo sapiens
gatcttccggttaaaaaaaatctcatgagtctagtgtcctttgccaggcctagtgataggaacctcttcttggccatatttagttcagccattctcacttgtagatcactcttggtaccaaatctgttgaccg

SEQ ID NO: 618150 - DNA, 677 bp, Homo sapiens
aacttcaccgatgatcgacgttaagatgatggagcgcgtggttgagcagatgtgtatcacccagatatggagagggaatctcctaggccgtattaccagagaggatcgagcgatggtcctcttctcctctccacctgatgatcctcctgatctctttcctcatcttcctgatagtgggatgaggaaggtcttcctgtttgttcaccatctttctaatcttttgaccaagcttgagggaggcggtatccacctgcagtccctttatagtggtggtgtctcacatcttgtcttctctcttggtcccggataggctaatccatacccttggcactgatgggcactggaaaatcatcgagtagactctgagatgctggtcaatgccccctttgattgagttcatcatgagccgtagctaatgccaggccagtagaagtagtaatgcagcgaaataaactcattggctttaatctgtgacttagttgtcttgtgaccgttacgatgctagactacggttgaacgctaataacaatatctcaggaacagtctgactatacctttgcctggataacctcgtggctccttcagggagcgtagagctctgtatactaatgccctatcttagtagagatttcgtagctattggagacgatattcttgcattttaagaagaatccgag

SEQ ID NO: 618151 - DNA, 113 bp, Homo sapiens
agcggccgggtcctccctccccagacccaagagaggccaccgccagcgcagcgcgtgaaggaggggaggtacgggcaaaggatcaggctagctacaagtggccgggccttgcc

SEQ ID NO: 618152 - DNA, 394 bp, Homo sapiens
ggaactggacagcagacaaaataggtcatagacagaatgactgtagattagggccaaggagaggcattgggattggggaactggaggtcggtggtggagtggagcggtggttccagacacaggccaccgttctaaggagtgtggctctaacaggaggacaggaggacatgggctcgggacaggaggtgcttcttaacgtgacaaggccaggccccttacctaagtggacactagtcctggggccctctctgcagggttggtgcacatgaggaaactaaggcatggccagcttgagtggtttcccaggtgacccaggtggtgtctcgcagacggagccagaactcaacctcgggactccgactccagcagccccgggccctgggtggccagagtg

SEQ ID NO: 618153 - DNA, 270 bp, Homo sapiens
agaaggtatgctgagcaaaggggaaaagccacttataaaaccatcagatctcgtgagaactcacctactatcatgagaacagcatgggggtaactgccaccatgattcaattacatcccacgtggtccctcccaggacacatggggaatataggagctgaaatataagatgagatttgggtggggatactgccgaaccatatcattccactcctgggcccttccaaatctcatgttctcatattttaaaacacaattacgccgatgcgga

SEQ ID NO: 618154 - DNA, 190 bp, Homo sapiens
gaccagactgggcagtatggtgaaggcatgtctctactaaaaatacaatattagccggacattgtggtgcacgtctgtcatcccagcagggcaggcgaatcgcttgaacccaggaggcggaggttgcagtgagccaggatcatgccattgcactccagcctggtcaacagagcgagactccgcctcatta

SEQ ID NO: 618155 - DNA, 409 bp, Homo sapiens
aaacaatcacttcccatactattaagttatttggtttttccccaactttactattatacacaatacttcaattaatacatcttacgctaatctttgcacactttcataaataaatactgaaatctttaattatagggttaatgcatatttaattttttttaagacttatttgctacaccgtttaaatgctttcaaatagcaacctgaaattccaatcaatttatgttgctataacaggtcaattcattgggtttctttttttaagacagggtctcactctgttgcccaggctggagtgcagtggcacgatcatggctcacagtagccttgatcattgtagccctccctgggctcaggtgagcctcctgcctctacctcctgagtagctgaatctgcaggtgcccgccac

SEQ ID NO: 618156 - DNA, 416 bp, Homo sapiens
tcctcatctggtttcattcaactcatgtcaaagcgtcagtcgtgacccatgtcaaaggtatatgcagctggatgtaagttaaagtggagaaaacagattttattcagtcgctgctgacagcaggggacagagctgagctcctttcaggtttgtgcagatgtgactgggcattttaaagggagtgtggggaacaggtgcccaaatggagtcagggaagtgaaaattacagaaagcagcaagagggttgggtagcatgaatgtgatgagctgactctgctacgagctggcaggttggggctggcagggatgggctcctgctccccttccccagccccagactaggagacaggcctgttttcctgatgattacgttccaaagggttggctctcggtccttgagaaggacatcccagagc

SEQ ID NO: 618157 - DNA, 609 bp, Homo sapiens
  misc_feature (351)..(351): n is a, c, g, or t
  misc_feature (385)..(385): n is a, c, g, or t
  misc_feature (482)..(482): n is a, c, g, or t
aggtattttaatagcaaacttacaggaacagcacagaagacagacaacattaaaaacagtgtactgggcatgtgtaggacaacctcagttagaaaacgtataggtgaagtggagtggaactctacgtggtagtgatcaaaaagtgctacaacacaccattttagttgtgcgcatcaataagaaaattttacttgtggttttaaaaaaaatttccaaagtggcgtggcatggcgtccagaaaaattttaaccgaggtttaatttataaattatttataagagtgtgaacgcgcgtgaacactgggttcacgtggaaacatttttacactgggcatttaagtggctttagcgntctccggcattttatatttaacaatttcacacancaaagtgcaaaagctggaaaaacgtggccaaataccgtggatttcgtgtccccatatttttccactccgcaatcatattacttagggatacctttgngacccctagtggaaaacaaaatatctaagcgttcagaaactacccaataacgaggaacgaagagaaatttcttttctatttattggggagaaagtgaatcggttccccatcaagagcggggccaaaa

SEQ ID NO: 618158 - DNA, 549 bp, Homo sapiens
  misc_feature (421)..(421): n is a, c, g, or t
  misc_feature (504)..(504): n is a, c, g, or t
  misc_feature (536)..(536): n is a, c, g, or t
gacagagtactcctgctataaggcccagagagaaatttctctctgcttttttgggacattttcctccctcatgatgcagtttttattaactgcggcaatccgctgattattaatttccttttaataaaccctttcttttctcacgcctaatgtagcttcggagagccacggcctgttacccagctcctcttaagcttcactgctgaacctaagtgaaccagtgctcgggtttaacgctgtttcagtttagcccatactgaccttctctggtatgaatttcctttatcctttaattatttcatggagctccaaaccagcagtgcctcttccaaaaatcctttgccgtttctcagtcccgcgttggttcgccaaatgttgtgtctggccagcagatcacagcctgggttctagcctggaaagnaattttggaaacctggaagagaagagggtctaggtggcaagataaaaaaatgcagctaagacagttattctgatcaaagctcnattttactggtctgcacgcagttataaagcangggaaagggggcc

SEQ ID NO: 618159 - DNA, 421 bp, Homo sapiens
gatatatgtgcatgtttgttttataggtaaactatgtgtcacaggggtttggtgtacagattattcgtcacccaagtaatcagaagagtacctgataagtagttttttgatcctcatcctccttctaccctccaccctcaagtacacatatgcatatgtgtactcaaagtttagctcccacttatggtgagaacatacagaatttggttttctggtcctgtgttagttcacttaggatgatggcctccagctctttttatgaacacatgtactgaatgtgttatgagccaagataattcatgtctaaactccacagtatttctgcaaatccctcttttttaatggcaaaaaataaacagcactattatatgtagtttaagtttatctgaataccatatatataaggttttatatgtatata

SEQ ID NO: 618160 - DNA, 229 bp, Homo sapiens
tatataaatcatgagtaatgagcaggctcagtcataggggaataattgccaacaaacactttttgggaagcctgggaccatggctctcgcgaggaatctgtgacatctcctggcatcatttgagtcctgccttctcaaagtatttgtgccaggcagacgtgattccggccaggaacagaatgaattcactgaaggtccaccttggccattctccatttggcggccaggt

SEQ ID NO: 618161 - DNA, 1381 bp, Homo sapiens
tcaaaaaacccctagcaatttttggattttctctatttccaaaaaaaggcaaatactttagtggtgttcacacaagggaaacgggggcctgggcgcgggcacaagggtgtccttctacaaactatagaacgcaaggggagaagggtggggctacaggggaaggctccaaagatccctcacaggcaggcccccgggtttccctttccctggcgccacccacaagccggaagtcttgggtccttcccaggccaggtacacgccaagattccaaggggggacacgcgcaagacaggcaaacacgggcgctctgggtgtcccccagagagggatgtggtggagaggtcaggggctggctatgtgtgtggagtccccatctggcaagaaggtgggctgaggtggcgccaatggactggagatttggcgcattgggccggataaaacacaaggagaaaatccccaggggacaagacgtctgaggggtgcctaacacccaatatgggggccccacaaactgggcgaacctcccctttaataaggggggagcatatatggcgccctggagtaagtgtgaagacgcgcccacatggcagagatctaaaaaaacattctctgagaaacacccagtgggcgtcccggcgcatcacactttagaaagtcgtctgtgggcaatacagtcatccctagggtgatctcacttaacttccttaagagaacacatcgcccacttgtataagggtattttcgggcccccctctttcaaacaatgtggacaagaggccctggggactacaagaagcggccccagggaggtaggaccactaagaagatgaggggcccttgaaagcaagggcagcatagggggcgaccacctcgtcgacgccccaaagaaatgcaccacgacctctgcgccgctcaaaacacgaccagagccaacaaaaccccgctgaggaaggtcctcctaaggaaaacgatctgcactagcgttacccccaaaggggaacaggcagctcaggggccccaccggggggactacacaccaaatatcttagagaaacgaggtcagacgcgaacacttcaagcaaggccaaacaggcaaaaacaaaaaaaagagagacgaaagcaaagtactaaagcggcaacacgagaacacccgacaaagcacacgcgaccaggcacccaagacgacgacagcgaatccacacacccacaagagaagcgccctaaagaccccaaacaaagggagacaacatacaacaacacaagaagaagaacaacacgcgaccaagcaacaaactcataaacacatcaataacaggcacacccacagacaaaccacacatagtaaaaaccaagaggacacagcagtaaaaaaacaacagag

SEQ ID NO: 618162 - DNA, 273 bp, Homo sapiens
aaatatgcctttcgatcaatcaagaagaagagtgtattaacagaaagactagtatagattgatcggatgtgtacgcgaattggtaaaccggatacagcagagtctgaacgtaaggcacagttatcattcgtatgtacacacgctctagagactatcagagacttagctcttcaattaccgataagttcgtatccacaggattacagctagctgagatcactgctaactagtagctgctaatagcgttcagagctcgaatcgagcagctacgga

SEQ ID NO: 618163 - DNA, 1723 bp, Homo sapiens
  misc_feature (245)..(245): n is a, c, g, or t
ccaccgtgtgtgttatctacgtttcgtggggtggtttgcttaccagcacgaccatctttttgtgagtgtgtgcctcttctttgtgtggttgttgtagtaaggtagtgcttttgttgtgggctacctctccaacctaatagttgtgggggttttgtatcacaccactggtggtgtgctcgcccgcttaagttggtggttggtcctccctccgccgcaggaatgctgtttttttttcctgttttttntggttggggggcgacagctactattgtgatttagaggcgctccgttgtctctttatgtttgtatcgttggatctgtctatctgttgttgtggtggcgcggcatagatagtttttgtctctagtgggggggtagcccacccgggtggtgttgggggtttcttcgcatccataggtagttgccttctttagtgagccttgtttgttgtgttcgcccgcccgcgtgttgttgtggtatcgccagcgtggtgggtgtgtatataataggagctctctctttcctcttctctgttcctaccaagggggtttcttcggcggctttttcctttgtggggggatcccccgttttttttttggtgtgaggcctctctcttgtttttgttagctgagtttttgttgatgctcctccctccgcctcttctgcgcataatgtggttgtgggagctccctctcccggcccactcgttgtggtgccttctgctggtgtggctgtgttctcctgtgggtatgtggagtattcccccgcgggggttctacgggatagttttcttggggtgccgtcgaccccacctaaagagggggtgaccttttctgcttgtgtggcacgcaaggggttttttctccctgttttgccccctgctcctgcgggttttttctcatagttcctcacaagaggggctctgtgggcgccccgccgcgctgtcccgctgtgtgtgtggcccccacgttctcgcttgggtgctttcccgctgcgagctgctctttctgttgaggtggttttcctcggtgcccccttattatggccgtttgttgtgtggctgtcccacaggagagggccgtttggtgaataccccacggggacgaccccggcgtgctttttttttggggcacacgacgcgcttgtaaaaaaggggggcgccacatatagagggaaagggcgcacaatagggatacccccccgggtctgtttgttttccccccccacccgggaatatttgggtgcgaaagaaagtgcgcccaacgaggagagggatgtgatcctctctcatcgcgccacatatgtcggccctcttttaccttcacagcccctcgagagggagaggggggctttgtgtgtcccctctccctttccccggcgcgacacacaagcttccacagggcacagggctttgtgccactctcttgggcgccgcgcgccacacgcacactttcctccaacagagcaccaaacattctttccctgctgcgctccccgtccgtggggatctatccacgttacccccccccccatgttccagaccccaattttcccacgtgccccccttctcgtgtttcccctgtgtttgcctgtagcctgggcatgtctcccgggacccagaagcccctccgccccggtgtaatctccctgaccccttggttaattcccttaagattctataagatgtatggaccttctttataaaaaataaataaaaaataaa

SEQ ID NO: 618164 - DNA, 563 bp, Homo sapiens
gtgagcggccgccgagcgggtgcgggtgcgggcgcatcggccatcaccgcgcggcgcgcagtggacaccgtgcgtaccggcctgcggcgcccggccaccggggcggaccgcggaaccccgaggctatgtcccatgaaaagaagtttttgctgtctggcggacaattattctctcccgccaaaacccttggatatccgggggggcgccccaaaggccaaacctaattgcccccctttattgctcaagggccttccctataacctttgcgggcccctttttacccaagtagtggccccccttgtttccgcgaggccccttacccccaattaagggggtccaaggcccagggggattaccccccacgcgagttgggaccagcagagtgagacggttgtaagcaccccaaagaagggggagtattgaagcccacaaaaggggactcgcactaacacgcccgcagaagggggggagggtctaagcccaaaccagggggggcccccggtttaggggccagagagtagacggggggcataccgcagaggaggggacccaatagacacggg

SEQ ID NO: 618165 - DNA, 381 bp, Homo sapiens
caatcgcttgagcccagaagtttgagaccagcctggccaacatggtgaaaccccatctctacaaaaaatacaaaaaattagccggatgtggtggcgtgcatttttagtcccaggtagttaggaggctgaggtgggaggattgcttgtgcctgggaagtcaagactccagtgagctgtaatccgcgccactgcactccagcctggacaacagagcgagaccctgtcttcaaaaaaaaaaaaaaagggcggccgtcgcgatctagaactagtccttttgaacaacttggtttcagaatatgtaaaatgactttaaggatcttgtgtatcaaacctatccccggatgtgtgagaataatgtgttcataaagcatggatctcgca

SEQ ID NO: 618166 - DNA, 581 bp, Homo sapiens
  misc_feature (102)..(102): n is a, c, g, or t
  misc_feature (109)..(109): n is a, c, g, or t
  misc_feature (112)..(112): n is a, c, g, or t
  misc_feature (150)..(150): n is a, c, g, or t
  misc_feature (170)..(170): n is a, c, g, or t
  misc_feature (173)..(173): n is a, c, g, or t
  misc_feature (228)..(228): n is a, c, g, or t
  misc_feature (247)..(247): n is a, c, g, or t
  misc_feature (250)..(250): n is a, c, g, or t
  misc_feature (275)..(275): n is a, c, g, or t
  misc_feature (285)..(285): n is a, c, g, or t
  misc_feature (317)..(317): n is a, c, g, or t
  misc_feature (320)..(320): n is a, c, g, or t
  misc_feature (366)..(366): n is a, c, g, or t
  misc_feature (382)..(382): n is a, c, g, or t
gccctttggagggtctggggtgcctattcttgccggaatagccctctctctctagagagagagagagagagagaatatctggttggagaaatgaattggtcngctgccnacntgatatgcactagccttggctaacatgtaaagattccnatgtaatatatgtttttccntcntagtgcctatagaagctagaaatataatgttttctggttcttagctgagaaatcnaattctcttgttagctggnacnataattagatcgagaatcctggtcnaggcatgacnaataataataatagtaaattgacaccgacccnccnctatgtgggacatggcggaatgaaaaggaaatcataaatgtaaacnttgattgacatctccnaacggttgttttcattttaaataataacttgcttaaaatcactgttgtctgataattttgtttaagaaaaaaataacaccaacctgtttttcttccaaccgctatttttaaaagtcccttttaattttttgactcgagttttcattttcacctatgattctttccatgatggaggcccaaggggtcctctagatcacct

SEQ ID NO: 618167 - DNA, 145 bp, Homo sapiens
tagataggtcagtgcccatgtgttagaaagactctcacaggctcttctcccatgatctggtattaaaatcagcattcatacaagctgcttagcgatactctactgtcctctgcagattacccggtcctaggacagggaacccact

SEQ ID NO: 618168 - DNA, 183 bp, Homo sapiens
tgtatcattagaagagctgtcacatacagttggtaccatcagcagccgagacgaaatacaggggctgggagaacttcttggtaaaatctgaagctattcgggtcacgtatatatctgcctcaattctataggtcaccacgatgcatggggatctctggcctgaactccctacagctctgttta

SEQ ID NO: 618169 - DNA, 766 bp, Homo sapiens
tgtttggtgcgcacctgtagtccaagctacaggtgcaggaggatggcttgagccaaggaggtcaaagctgcagtgagccactattgtgccactgcactccagcctgggcaacaaagcaaggatcctgactctacacatttgtttttttttgagacagagtctcgctctgtcaaccaggctggagtacagtggttcgatcttggctcactccaacctccgcctcctgggttcaagtgattctcctgtctcaacctcccaagtaggattacaagcatgcgccgacgatgcccagaatccagaactttgtctaatcactctccccccaaacaaacctagatggtggaaaaccaggaataaaactttcacccccagaaaaaaccaaaaaaaaaacaaacacaacaaaacaacaaaacaaaaacaccacaaagcccaacaacacaaaacagacgggcaaaccaacaccaaaaaaaaaacacaaaaacagggtgggggggcgggggcgggccccgaagcagggtctttacaaaccaccgcgtgggggagcaggggccacccatactcgaacagccgaacaacacggcgctccccaacagctctcccacaagaccaacacgcgggacccaacagagcagggggcgcgacccccaaccaaaaaaaaaaagcgcgcgggaaaacgagcagcgtcgtcaacacccccgagcggcgcgccacgagccacggggggcaccaccacaacagggccgaacaaccgtgataataaccgggg

SEQ ID NO: 618170 - DNA, 661 bp, Homo sapiens
ggacgcgtgggtcgatgatcctggtggacggtgatggatccttccttcgtgtgcttgaaaatggagcctgcccctcggtcaacataagacccttgtgggaactgagaagtgtatatggggcccaagtctattggtgtccagaacacagacgacacgcagcccagtgcaaggtgctgtcgaggcattgctaaacgccagtgtgtggaactaggaggaggaagtattccatcttgtgacagaaaccacagcattggttttggtctacttgtgttgtcttgggggaatgacacagcacagatcttgtttgactttgttactaaacaatagagtgctccctcacacactcgcaccacagtattctgtgtcctttatagtagacatggctgtctgcaagggagcccctagcccctggcagacttagctgtttcagttgcccctatttctctctgactagatggatagttgatgcgactggaggtcttttagcactgccccttgcaatggcgcctgctggaggaggagagagctctgctggtatgagccacagtttcttgactggaggacatcaaacctcttggattgaggcctatgttctgagccctgacatgtgcttgtggcactggtgggcctgggcttctgaggtggctcctgaccctgatca

SEQ ID NO: 618171 - DNA, 87 bp, Homo sapiens
ggatttgctggtgcagtacaactaggcttaatagggagctcgaattcaaaaacgttagaagcttgaattcgagcagtagtagtagta

SEQ ID NO: 618172 - DNA, 175 bp, Homo sapiens
actgaaagaaaaaatttcttttaattggtgtgtgggtcccacaccccatctatcaatgtatgtgctatttacaaataagttctatacagtattttgcagtacctttgataattcctacgatctctattttcacttctgtgtattaactgtgaataatcagctggatattttaata

SEQ ID NO: 618173 - DNA, 323 bp, Homo sapiens
acagtaatctccctctatgccaataattagaagtgtcactaaaccatgaagctaggatatgtgcacaagtcattttatcttttctaaaggccttcagcagaatatactagaatctatatattgatgttaattttgattcagaaaaaaaaatacaacccagtatctaaaaagtgctaactagtccaagatagtcatgcatatgccaaagaaatattacacctaatctcatgtatcgcaataaaaatagaataggtcagctacttattcttaacaccctacttccagtatataagctctgtcattattaacttcagatctacctg

SEQ ID NO: 618174 - DNA, 154 bp, Homo sapiens
ataactatgtctcctggtaccaacacaacccgggaaaagcccaaaactctaaatttttcaggccacttattcggccttcggggatttcctaatcgctcctctccctcaaggtctccgaccatggcctcccttaccatctgtggcctcgccgcta

SEQ ID NO: 618175 - DNA, 473 bp, Homo sapiens
tgagcggactggccgtagtggcaggagactgcagcagcgaagggcaatgggggcggcggtggcagggccggggccgggtgacgccagctggcacgcggaagaagaagtggcccggtggccacctgagccactggctgttacctggttcatctacagatgtgcgtgatgatcagcctgggatggctggttatcgcggttgtgtctggtaccagagacatacctggcataagggtagctaccatagtactttattcattcagattgacaaagcctttgaaattctttcaaactggagccttattggacgattttacagttgtgctataggaattgttccatcttctgttgtcctgacttcttaccaggtgatgtcaagagttactctaatatgggcagtaacacatagcgtcaaagaggtacagagtgaagacggtgtcctcctgtttgttatggcatggacgatcacggaaatc

SEQ ID NO: 618176 - DNA, 194 bp, Homo sapiens
  misc_feature (4)..(4): n is a, c, g, or t
  misc_feature (13)..(13): n is a, c, g, or t
  misc_feature (23)..(23): n is a, c, g, or t
tgtnaccccattnatcgccaggnttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaaacc

SEQ ID NO: 618177 - DNA, 420 bp, Homo sapiens
ccgcctttgttctagttctcaaattattactccatagtatttctgagcatcatatatagaaacttcgttcatcttttaaaatagcctgtctccaaaagataattactgcctgatctggcagagtaaataacagcctgcacaggctttggagtcagatagacctcagcttgattgctggcttggtcatttactagctgtgtgacttgggcatggtttttgagggaagcagcggttgggcctcaagtgtataactgctctgtatttgattgagatgattaattgtatctttactttgtggcccattatcattaatccaagcccctttttctttttagtctcatgtccctcattgttaatctcatctgctcccaccatctacactcgtgtattaaatatattaaatatatatctttccagtgc

SEQ ID NO: 618178 - DNA, 550 bp, Homo sapiens
  misc_feature (8)..(8): n is a, c, g, or t
  misc_feature (87)..(87): n is a, c, g, or t
  misc_feature (118)..(118): n is a, c, g, or t
  misc_feature (126)..(126): n is a, c, g, or t
  misc_feature (131)..(133): n is a, c, g, or t
  misc_feature (135)..(135): n is a, c, g, or t
  misc_feature (142)..(142): n is a, c, g, or t
  misc_feature (152)..(153): n is a, c, g, or t
  misc_feature (157)..(157): n is a, c, g, or t
  misc_feature (161)..(161): n is a, c, g, or t
  misc_feature (206)..(206): n is a, c, g, or t
  misc_feature (208)..(208): n is a, c, g, or t
  misc_feature (223)..(223): n is a, c, g, or t
  misc_feature (235)..(235): n is a, c, g, or t
  misc_feature (247)..(247): n is a, c, g, or t
  misc_feature (257)..(257): n is a, c, g, or t
  misc_feature (320)..(320): n is a, c, g, or t
  misc_feature (323)..(323): n is a, c, g, or t
  misc_feature (327)..(327): n is a, c, g, or t
  misc_feature (343)..(343): n is a, c, g, or t
  misc_feature (369)..(369): n is a, c, g, or t
  misc_feature (392)..(392): n is a, c, g, or t
  misc_feature (400)..(400): n is a, c, g, or t
  misc_feature (409)..(410): n is a, c, g, or t
  misc_feature (415)..(415): n is a, c, g, or t
  misc_feature (427)..(427): n is a, c, g, or t
  misc_feature (447)..(447): n is a, c, g, or t
  misc_feature (450)..(450): n is a, c, g, or t
  misc_feature (454)..(455): n is a, c, g, or t
  misc_feature (459)..(459): n is a, c, g, or t
  misc_feature (464)..(464): n is a, c, g, or t
  misc_feature (477)..(477): n is a, c, g, or t
  misc_feature (482)..(482): n is a, c, g, or t
  misc_feature (504)..(504): n is a, c, g, or t
  misc_feature (508)..(508): n is a, c, g, or t
  misc_feature (517)..(517): n is a, c, g, or t
  misc_feature (523)..(523): n is a, c, g, or t
  misc_feature (548)..(548): n is a, c, g, or t
aatttttnaaaaatagcttttgtataggaaaagtaaaaatgggcttatagttcagatactgagcaaatacacaatactactttttantaacaggcacataaagggtatgggaactatnggggggcncaaannngnggatagnggggcgaatnntganaagngaggggtgaggatcggagagaagtgaaagggaatgggaggggacnangcccttttagaatanttaatatacatngccttgcttctntccaaaaggnacatgtacttgtgaccctagcttttgttatttagagcactggtacagatacgctgtcccatanatnaggntcaaattattagtttnagtttcacattgtaggaatttaaganttttttttttttttaacacaggnaagaatcncatcatttnnaaagntgtcttcatgtnccatcaatgacatgctaccnganatannagantccanaggataatgggancaagntacccaagtagatgtttctggnattnttgactgcngttcangcttgtttcctaaagtatacttaanag

SEQ ID NO: 618179 - DNA, 772 bp, Homo sapiens
aggggcgccgcccgctggggtgccgcctcttgttgagtagggcgcccccgtctgttgttgcagcgacaggtggtttgcggcgcgcggcagcagagagcgcggttgtggtctgtcgtcggctgggcgcgtacccttatagtgttctttttcccccgcctcgtcgttagtgttgttttgttcgcgccagctcgatcaccgtttttggtttagaccagtctggttgaggtggcctccgtccttttcgtccctagggcatagaccattcgtccctgatttggttaactccagctcgtaacgaactcttagtgagagtcgcgacgggaggtgggaggtgcgttgggtttcccacacagtgtctctcacacttaccataagcctgaaaaccttttgaaccgacagaaagaaggtaaatactgtatgtttccctgccttcgacggagttgcgtgttcggcaccctcatcccagattcgcttatacgataagctcttgtttgctatatccacgactactcgcccctaaatcacaatccctcatacttgtactatatgggtcttcccatccaagcccaacagatttttgtaagacatactcggtccctcttctctatctgttcgctgtaatatttcatatttttctgagtcttccactagcacaaaactgcttcgtactcatcagagatgagaaaatggatcaacaaaagaatctaaacaaaaaacaaaaaataacaaataatataccaaacaaaataaaaatacaaataacaacgataga

SEQ ID NO: 618180 - DNA, 266 bp, Homo sapiens
gcttcgatctctgtctattccttgtagcttagctggctagtgtgcaatttgtctttcacccatcttttggttccatctggagacctctccttatttgtcccatctgtcaggcatacttcggccctttcttcttcaggcattattgtgcccgagagtgtttcttgttcttctatgtcgttctttaggcgctgtatgtctctattgacattctgcagtttgtttcttaattctggtatttccttctccttcaaatcaattatgctttg

SEQ ID NO: 618181 - DNA, 255 bp, Homo sapiens
tgcatgggtcgacacttagatggatccaaagatattttggcacgaggaattattttacaagctacccatttgacaaaggattaataaccagaatatatgaaaagctccaacaactctataggaaaaaaatccaataacctgaccaaaaaatgggcaaaatatctgaataaacatttcttcgaagagacatgcaaatgaaaaacatgaaaaggtgttcaacatcattgatcattagagaattgcaatcaaaccttt

SEQ ID NO: 618182 - DNA, 172 bp, Homo sapiens
gcacatgtctggcggcttgcacatgttggctgggggggcggtggcagccggggctggcttgttgtcctggggctgaggtgacagtcgtgggctggcggggtggtggacgcccagtgcctggccttggtgccttgggaccggcggtgacactcctgtacccacggtggcacgc

SEQ ID NO: 618183 - DNA, 119 bp, Homo sapiens
tagaggacccgcagagcgcgtaaggttatgtacgtagtctaggcatatgtgttggagattgagactagtagggctaggccaccgctgcttcgcaggcggcaagactagtatggcaataa

SEQ ID NO: 618184 - DNA, 109 bp, Homo sapiens
tctacctgcgtttcctataagtagccttattctttggttgtttccctacttgcgtctgttagactgtgggaggaatgaaatccatttcaaactctgctgcaatacctgt

SEQ ID NO: 618185 - DNA, 290 bp, Homo sapiens
acccttgaacaaaagacagattaaactgggcgcagtcgtcacgcctatattcccaacactttgggaggctgaggcaggtggatcactagaagccgggacttcaagtccagcttggtcaacatggcaaccaacacggcaaaaccctgtttctatcaaaaacaaaaaaattagccagacgtggcggtgcatgcctggagtcccagctactggggaggctgagatgggaggatcccctgagcccgggaggcggaggctgcggtgagccaagattgcgctactgcactccagcc

SEQ ID NO: 618186 - DNA, 376 bp, Homo sapiens
  misc_feature (161)..(161): n is a, c, g, or t
  misc_feature (168)..(168): n is a, c, g, or t
  misc_feature (198)..(198): n is a, c, g, or t
gtggatgatacatatcgaaagaataaggccactcagggagaacagatatcgagaataagcacacatgaaggatataagcaagcaaggccaccagcatttaaggtagaagatgagccaagggacaagactgagttgtcttcagagaagcacagagatgttcnactgagngcagtgtgagccaggtaaagaaggggattntaaggggtgggcaatagtgccaagaaagaaagattaacatcatagccacattcaaaaggtgtcaatgaatctggctattaaaaaaataatctggaaaggccaggagcagtggctcacgcctgtaatcccagcactttgggaggctgaagtgagtggatcacttggggtcacgagtttg

SEQ ID NO: 618187 - DNA, 939 bp, Homo sapiens
  misc_feature (43)..(43): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctttatagggttaattcttttattttgagatcccccacaacttttgtttgtttgattatagaacatagcttaaattgttctttcgcaaatccctaatgttaattttgctcaagccaaggagaattattctgttacaatcgccattgtgccgtcacgattatcttcttgtttcttctcaaaaatttttccgaaaaactttgtatctcaaattacgttatggggggtgcggctaggtttatcatacctatactatacatgattcgtgtatcgaagaggtagagacctggtatatacagcgctgagcaacatcgtcctacttgttcattggttgttgacttgtagcgagaggtgttgtcttttggcgtaaagtagttcaatttttcaatcgcctaatatcgttttattgctttagttcgcctgtcccatgttt

SEQ ID NO: 618188 - DNA, 221 bp, Homo sapiens
cttaaaagggtttggtttttgtttgggccccccccttttttttttttagggaaaaattccgcccgggcccccggggggttatttctttgggggttgcccccccccgtttggggggggggtttgggttttaaaaattggaaacccgggggggcccggggggggttttcccccttttggggttttgggcccccgggccctccctttaggttttttttttccca

SEQ ID NO: 618189 - DNA, 964 bp, Homo sapiens
  misc_feature (169)..(169): n is a, c, g, or t
  misc_feature (285)..(285): n is a, c, g, or t
  misc_feature (923)..(923): n is a, c, g, or t
  misc_feature (925)..(925): n is a, c, g, or t
  misc_feature (937)..(937): n is a, c, g, or t
  misc_feature (941)..(942): n is a, c, g, or t
  misc_feature (944)..(944): n is a, c, g, or t
  misc_feature (947)..(947): n is a, c, g, or t
  misc_feature (949)..(949): n is a, c, g, or t
  misc_feature (952)..(953): n is a, c, g, or t
  misc_feature (956)..(956): n is a, c, g, or t
  misc_feature (961)..(961): n is a, c, g, or t
cgtggtgcgggagtggagctacgagttttgtagtgtattatggagtatgacagcgctttggaggagctcgctgaggtggtaatcacgacggtgcgatggtacgcaggatctttgcggaagcggcggcgagagatatgaacgggacttgatggtgtgttatatgtatggncgggcggggccgcagagtggctacgtggtggtgtatgacgtcgtacagcagttgcgagagagctaggattgtgagcatagttagtgtgtcgcgctcatctgaggataaaataatancgcgcgcgcgaggtatgagcgtgatcagcgatcagaggtgtacgggcgaagttacatctgtgggatattacggttcgcaagtgtagggtaaagggtgagtggcggtggcgtgaaaacaagagtgggtggggggcgcggacacaagcaatcacataggtaatattgggaactatatcatatagggattttcatagggaggggcgggcgagtgacataaagggtctagctgcgagttgggcttgatgtgggggttgaggtttactgtgtgaagcgggtaggttaatacggttatatatatgactgtttgtttagatgaaagatgtgtctatcgggggtggttgggattaaatatagtgccacggggcgtttcttttcatcgaattgtgatcggcaagtttatttttccagaccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctaagtctgatctcatgtggatncnagccctcctcgngggnngntgntnatnntgncgcgngtg

SEQ ID NO: 618190 - DNA, 135 bp, Homo sapiens
cagcattatcagcagcggggagttggtgtcttctttggttttctcagtctaggcattgttttcggctatttggtagaagtgggctccttgggtgctttggttggcctttgaggtttaggagttgtccctttagaa

SEQ ID NO: 618191 - DNA, 874 bp, Homo sapiens
  misc_feature (43)..(43): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctatgtaaatgatctcatttgtatcctcgaggttctcgtttttttgtaatatttggtggaatacttgaatcagtctga

SEQ ID NO: 618192 - DNA, 964 bp, Homo sapiens
  misc_feature (1)..(1): n is a, c, g, or t
  misc_feature (923)..(923): n is a, c, g, or t
  misc_feature (925)..(925): n is a, c, g, or t
  misc_feature (937)..(937): n is a, c, g, or t
  misc_feature (941)..(942): n is a, c, g, or t
  misc_feature (944)..(944): n is a, c, g, or t
  misc_feature (947)..(947): n is a, c, g, or t
  misc_feature (949)..(949): n is a, c, g, or t
  misc_feature (952)..(953): n is a, c, g, or t
  misc_feature (956)..(956): n is a, c, g, or t
  misc_feature (961)..(961): n is a, c, g, or t
ngcgcgggcgggtgtcgggtagagtggataagatacatatgcttcatatttagagcccgtggcgcacgatgcagcgcggctagccgaccgcacacacaatcatctccggggcggggtgggacggagatgtcagggagccggcggtcgttcgcaagacccgcgcgccggggtctactcggacaataaaccaaccgcaagtccaccatagggctgcgtgtggtcacacctattgggccacgcacggccctcggggtatgtgtgtgttacatagggggcgacgcgatcgctactgtgtcgcgccgggcaggcgggcctgcactcagtcgtcgagcgcccgcgcgccgtaatttttccggcgtgcagccgcgagcgatcggtatttcaggggtggcgggggggcccgcgcgcggaactgggctcgcggccgcaacggtgctgttcgttcccacgggcacactactgcgtggcggggcgaggcctcgtgcgaccaggtctgctatggatcttacactggtggttccgtcattatgtctatcggacactctcgcctccttgaaactcggagacgagacacagttatgatgtctatccatctttttcctttctgctttcagcgggacggatcttgctacagatgcgcgaattcgtatgttttctttcgcgatcacgcgtcgtttcaatgcattgtgaagtaggcctgtcctattcgtgcacccggctcttgttttctctactcccgattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctaagtctgatctcatgtggatncnagccctcctcgngggnngntgntnatnntgncgcgngtg

SEQ ID NO: 618193 - DNA, 411 bp, Homo sapiens
tgagacaaaatcttgctctgtcacctaggctggagtgcagtggcgtgatctgggctcactgcaacctccgcctcccaagttcaagcgattctcatgcctcagccttccaagtagctgggatcacaggcacccaccaccatgcctggctaatttttgtatttttagtagagaaggggttttgccatgttggccaggctggtcttgaacccctggcctcaagtgatctgcctgcctcggcctccaaaattgttgggattacaggcatgagatactgtgcccagcccagaataatgtttttaatcgtgcagaatcaatcactatgggaaactatgttggaaatgcgggtgctgtctttggagaccctgataggcagtgttttccacagtgttaggcaagtgtgtggagctttta

SEQ ID NO: 618194 - DNA, 121 bp, Homo sapiens
acgatctatgacggaccaagtctctacacacataaataaaagatctgggtatgaccatagactatctctagtgttctctacgagagacagtgacagactaagtacagtgaggatccaccat

SEQ ID NO: 618195 - DNA, 242 bp, Homo sapiens
atcagtcggtaccggttagagcggtctcctagttcaaaaaacatctgaatggcaatctcaccaactccacaaaacaagatgcttgaagtttcctgattgcaaattatattgtgcacagtgaaaaaacataagtcccaatggtggtttgcttcagaaagcaacacttgcctttttcccaccctggtatgtgttatacaaaggatgaatgagccccaccatggtcaagtgccctgagaccgctc

SEQ ID NO: 618196 - DNA, 174 bp, Homo sapiens
ccgtcgatgactcgcaaaacactattacgcccccggcaccaagacccgcgactacagctacctgggttccgacacggtgttgcatatcggcaacgagctggaactggtgcaagacctgtggctgaccaccggcctggctgcgatctacacccgccgcgaaacccaggtcagcta

SEQ ID NO: 618197 - DNA, 909 bp, Homo sapiens
  misc_feature (43)..(43): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgtttttataaagggtgaatgtaatgagtttgataccctcacagatgttgttatttttaatgagatgggtaaatgaatagtagaagggatagtttagtgtgtggtgagagggattatagctttgtatcgtgatttccgttgattaatgtgtggtagttgtgcgagtgttttctgtatgattgagtgtatgtatgctcaatggcgagaatatattgtagggatatagtaggtgttagtattaggtttatagtatatttaattttatagtatcgtatggaggaaacagaatatgttaggtatggtgtggttgagcgagggtatgcgtggttagtagggattggtgttagtatgaagtgtagctgtatatagcggacgaaatgaggaacggaggtattaaggtggag

SEQ ID NO: 618198 - DNA, 929 bp, Homo sapiens
  misc_feature (43)..(43): n is a, c, g, or t
  misc_feature (882)..(882): n is a, c, g, or t
tgcgcgggcgcgacgtattaggactaggcggctagtagatctntcatctcctgtctgcacgctgcggatgatccgatgtgtacgcgcgggtagaattaaggtgatgtgggggggtgtgattatcgggcgtgtggtctaggataattgactgtggtgggcggcctggagggcgctcctgcaatgtccggttcccttgtgggttcgacgcgggtctgacgcagtgctgaatgtggtcgcggcggaaccgatggatctaactgggggtgaggagtgtggtagttaatacgtggttgtaatggatggatataacgtgagtgttggtcgtcccgctctgaaacgtagcggttcacgctacagttcgtcaataagagggtgcgggccgcggtcacgcgtataggtgagtgattaatcgggtggtgtgtggtaaggtgggtacgggagggttgggagggcggggacaatgcttgtatctcatttggcactgtgcgtggcgacgggtgtgatagctttgttagtacgggtggaagaacggtgtgtgagggtgggaccgtgattggaaccgtctgaggtgctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctaaagtgtgatactcagtggatnctagggggccttgcgtgttgaggggacgagtgatggtgggtaagggg

SEQ ID NO: 618199 - DNA, 878 bp, Homo sapiens
  misc_feature (43)..(43): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataagtaagctgttttagaggggggtgaaaaaagctgcttgaatttttaccttgatcagaggagaatatgggttataaagggtgaattgagtatgggaagaccttccatacttgttttctagcttgggtagaccggtatattgtgcgttacaggccagctgggatgggttccaggggagggattacaggtgtgtattgagatgtggttgtaggatatggttgacgatttaaagacctttggtgtagatacctctaaagaaagctttggaggacgccgattttccgcagtttctagttgccctttgttgcaggggtttcgacgccgcgggttatttttgaatacggcatgtttttctttcttttgtggttgattaagttccttccccttggttgtgtcgttaagccccgcttgttgtttgttattcggatagcgtgtcgag

SEQ ID NO: 618200 - DNA, 824 bp, Homo sapiens
  misc_feature (43)..(43): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctattaaggggaatgcattaattagaaacccacaaattttgctttctgcatgggtatcacaaaatgatttttgcaggacatattcggtagccgatagtctgaaatcgggtggtaactcccattttggttcttaaatatcatggttttttccagcccctggtctaacggcggcccgaattcccgtagttgggccaccggatatggtatctatctgtgggacatctgcaccacacgcggaattgtaggcgcaggcttttattatacggtaccttgatgccgatgtctggaccttcattgtaccgctgacgtgcagct

SEQ ID NO: 618201 - DNA, 462 bp, Homo sapiens
aagcaatcttctgactcggactcctgagtagctgggagcacaggcacagtgccagcatgcccagctacatgggagtattgctcatgtagagatgggatatcattatggtgacaggctgctctcaaactcccgacctcaggtgatccagccacctcagcctcccaaaatgctgggattacatgcgtgagccaccgcgcccggccctgacagcatgcacactttgattttacctggtctcaaactgaccctttgcttattttaatagtaaaaaatacacccctgggtggacatttaagatggtaatgagacatgtggtgtatgaacaagcatgtaaactactgtgcatgtgcacccagaagaccacccagaacatgcttactagtaactcctctttccacttccttatgaataatcacataagactcccataaagggagcctccttagtgccagttttagctgt

SEQ ID NO: 618202 - DNA, 453 bp, Homo sapiens
  misc_feature (4)..(4): n is a, c, g, or t
agangtgagactcagtctcaaaaaaaaaaaattgcattattttgtttttttgtgagattattggcttttccaaaagatttcttaaagagctattattaaccaaattcaacttgagaactgcttcatgattgcctgtcgaagttctcaaattgttgtcaattcattctattattattttcacataacttttggatgtttcttcaaacttgggatttgaaaccaatatgtttaatcttcaaagattttttttaaggatataagatgtctattttataccatgacttttctttcatttgcacaatttcgagaagtgtttctttcctctgaaaagcagagaggactatcccagtataactccatttattttcactctgaggattgtagtttctgagcagctgactgaaaggaaattctataaagcagatcctctattcccattgtactgttgtaatt

SEQ ID NO: 618203 - DNA, 704 bp, Homo sapiens
  misc_feature (642)..(642): n is a, c, g, or t
  misc_feature (644)..(645): n is a, c, g, or t
  misc_feature (649)..(649): n is a, c, g, or t
atgtaatccaacccacggcataacaccagcgcactataattttggcgggaacacctctactttatagagaaagaaaagaaattacccggcccgttgttttaataggcaaaaattatctgttaaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618204 - DNA, 964 bp, Homo sapiens
gcatggtggtgcgcacctatattcccagctactcgggaggctgaggcaggagaatctcttgaacccgggaggtggaggatgcagtgagccagaggttgcagtgagcagagatcgagccactgtactccagcctaggcgacagagcaagactcggtctcaaaaaagaaaaataataataataataataataggccaggcgcagtggctcatgtctgtaatcccagcactttgggagtccgaggcaggtggatcatgaggtcaggagattgagaccatcctggctaacacggtgaaagcccatctctactaaaaatacaaaaaaaacaaacaataacctgggtgatggctggcaggcacctgtagtcccagctaaatcaggaggctcgaggccggaggcacggcatagaaccagggcaggccgagcccccagagagccgagtgagccctctgcgacatcaagcctaggtcgcacacgagtgaaaccgcccagggtacccaagcacaagaaaacaaaaaacggagcagacgcatgaccaaacgcgtattgtacgcgcatacaggcacatgtaaaatccccgatgataccttggagacagcgacacaagagagggcgccacaaacaccacccgtacgggatacatgaaactcacgaaacacacacgacgaagcacccagccctggaagaaacacaccgcaatcacacacctgagcaaaatatacacaaagctgttactagtgttgtaaaattgcagtggctgcgaaagacgccacaccatgggcaaatctccctagcgagtaccgctaagagcaaaggtcacggtcaccgcaacgaggcacagaagtcggcctggaaaaccacgtaggctaatacctcgtctgaggctgagagataagcgagtgacgcccacggtacactatttcgcacatacaatgtgttacgcctcgcaacgacgtggggcaaaca

SEQ ID NO: 618205 - DNA, 674 bp, Homo sapiens
  misc_feature (612)..(612): n is a, c, g, or t
  misc_feature (614)..(615): n is a, c, g, or t
  misc_feature (619)..(619): n is a, c, g, or t
aaacagggaaaagcaggcgtaatatttggggaaaagttaatttttaggaaaaaagtaataaccgggcctgttttaaatgccataataacggtaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618206 - DNA, 403 bp, Homo sapiens
cctttgtgtttcttcagcttactctaggccatctggatgtatacgtgcaagtcagcagggatgcgagtggccatggcctgggctcagaggcctgacattcctgccttcttatattaataagacaaataaaacaaaatagtgttgaagtgttggggcagcgaaaatttttggggggtggtatggagagataatgggcgatgtttctcagggctgcttcaagcgggattaggggtttttgtgggagcctagagtgggagagattaagctgaagggaggtcttgtggtaaggggtgatatcatggggatgttagaagaaacatttgtcgtatagaatgattgctgatggcctggatacggttttggatgctctgcgacggctaaatggaagatacaaggtccgcat

SEQ ID NO: 618207 - DNA, 527 bp, Homo sapiens
caaacggcggcgccggggccggaggaaaaagctcgccaccctgaagggtcccttcccaagcccttagggaccgcagaggactggggggaccagcaagaaaccccccaggcacgagaagagctctttggctgtctgccctgcctcacctgcccacgccaggccggtggccccccagctgcattcaagtgggaggcggaggaggaggcgggaggagggtggcaccatgggcccgggcgggtgcccctccatgcccgggggatgacagacactgctgccatggacagcccggtgccaagcctgcagccccctaagtcaggctctccctcaagttaccagggtcttcggttccaagaggccctttggggcaggcccttgaggccttggcccgtggccacggatggggagtgggaggagtttaccttgcccttgttccccctggcttccccccttccttacacacttgttcccagcgaagttgcctaggtgaagggccctcggccaggggcagttggtgaccccccagagcc

SEQ ID NO: 618208 - DNA, 1597 bp, Homo sapiens
ccttcttctgggggggggtctcgttctttattctttgctcattccttgtgtcaccgacgaggggctggtttttctctcctgccctcggttgatttagatgcggcctctcttctctttgggggggaaggagtgtttgtttggtatttgatcccccctccgtctctctttgctgtataaggtcccccctccccccttttccgtgtgtaggcctctcactctctggggtgtgctggtgtttttgtatgtaagcaatgttgtcgcgcttgtcgtgttgtcccgccagcagacatgagaccatcctgctagcagccggttgttttgttctctcacctcagaaaggtacgtatcccccctgtggtgtcagggggtggttcatcctttgttcttacatcaatcatctttcttgatggtgcttcaccccccacacaaggggtggttctgcccaccaacaggggggggtgtttttgggggagtgtcgacggtgctcgccacaacctgctctttttgagaggtttttcctacgtgaggcgggcgacggttactcctatatgtagtagttatcaccacttctttcgtcgtcgtaagtagtggttcaccggcccccacctctgtggggggtccacataatcagccccccttctttgcggtgggacaaatttttgtttctggggaagtacgtctcgtcggcaggctgctgctggtgagttcgccttcttttgcgccgaaaaaggactattttgttttggtagctgtgttgtatggtgcctcccccctccttgtggaagtacacctcctccccgctagaggggtgtgcgaccctcccccctcaggcgactctccactcgcggcggagattgtcgtttttttcctaaatgagttttcctttctctgcctacttttttctcgcgggccccccaccaaaaactcttctgttgtcctcccgtgattggggggcacaacgcgtgtcgcatataatatcccccgccccgcgctgttgttggggcgacgtcgtatacactcgggctgtccgtctttttccccccccgctgtgctgtccctcttcccgggacccccaaggcgttaggtctgggggggccatcaagagagtgtccccccacgggggggcacccctcacacgcggagagagaggcactcacggtgtctcctctctcgttgtcaacagcgcgcgtgcaggagagataggattcacggagagactctcgagcgcgccacaccccgcgagagactctctctggagagagacacaagtgtgtggagtgttcgcctatctgtgtgtacacagtgtatttccgcacaagtgtcatcagagtgtctctaaagagagtcccacacacactggagatcacgagacactgttttctgtctacgagagagaatattcgcgctctccagtgggtccacggcccccgccccgcgtatgcccggtagaaacgcccggcacacactctttgcatttaggttcttctaaagaccactcctggtacacgaggtgcaatccaactggatttatattttgacccttgcctggaccaatagggccaaacgccctacattaaccccgatatcatccagtacc

SEQ ID NO: 618209 - DNA, 804 bp, Homo sapiens
  misc_feature (148)..(148): n is a, c, g, or t
cgggacctggggtttcccccccaaacacatacgggggcgaaaagatacagctccttggaggtttaaagccccccctttgcgttggggtaactccccattttggcgcatccgctgtttatgagggaaacaggcggcatataccgttacncgcttgcgcgccccacgaagttatgggggttcattaccaaatggtcaaccccggagcactcgtgtctgtttccctaacaatgatgctctcttgagcagctctctgccacaccgtctgagagtatctgggcccggtggcgcccccagcgtggtttcacagcagggaggcgcaactcaatagggggcggggacccagaggagatttttcttattgctccgcaccccagaagatttgtgggccccaagtcgagagctcctgtcaaattctttgtgccgccacccgacaaccactgttaaaagaaaattcgtcatcggcggcctcatatcagtacatcggtccccccttcaaacacatctgcgcctcggtgtatgatatcctcggggcgacaatatctatagaacaatgaaataatgccgccggagttatcatgtggaaatactttggtaatagaaatttgaagtagcacccttgttttcgctcaataagaagagacgcatagatatagcacttctcttagacaccacgttatgatgaagagtagcgcgccgatgtttcttgcgttaaaggattctgcggggtatattgatttcgagtcctccgccacgcgttaaatataatttcagttttacaagggttgtgaacagacaccacaaaac

SEQ ID NO: 618210 - DNA, 258 bp, Homo sapiens
tcggtatgcatgcagtgcctgcagtgttgttctctggtggtgtgtggattgcctggctatttaggttcttttttggttccatatgaatgttaaaatagtttttttctagctctatgaagaatttcaatggtagtttaatgggaatagcattgaatctataaattgctttgggcaatatggccattttaacggtatttattcttccaatccataagcatggaatatttttccatttgtgtcttcgctgatttctttgag

SEQ ID NO: 618211 - DNA, 319 bp, Homo sapiens
tcttggcttacaaaatttgctctatgcttgctgactgctgaatgaatgaatgaatgaataggtagtcccaaagaatgtttagaatgtttttcagacagggtgagaaaaaacccacgaaccaattatttccgtttggaaagtttttttatttttgtgttcaggactgaagtaaaacaaaaatttgaataacagctgccccgttaaaaatgaaattaccaaaatatgaactttaggcatcaggcaaaaataattttttgtaaaaaacttttcttctcattttccttctcattctcttcatctttttctttttgtttgagca

SEQ ID NO: 618212 - DNA, 194 bp, Homo sapiens
agacatcccgcgcttagggaaaactggtttgtcgcttcccaccactgagttcgggccacattacccttccattcttcacccagagcgtcagcagcaacttctgtggtccatacctttttcctttattgaaagaagtttgcgttcatcgtccacttcaatgagtttctggcagccagtggctacgtgtccggcca

SEQ ID NO: 618213 - DNA, 172 bp, Homo sapiens
actacagggatgattcttcaataggagccgatggatctgtggtcctctgggactcatcaaagcttggtttagcatttgtcagtttatcttcagaattctctcgattagagatatttattaaggtggtcttcctacctctgtggtgtgtgtgcgcaccagcttagagtctata

SEQ ID NO: 618214 - DNA, 707 bp, Homo sapiens
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatctcgtctcttcttggatgatgtttgccgtcagcattccccaaataaacttgctttttgggcca

SEQ ID NO: 618215 - DNA, 161 bp, Homo sapiens
agtcaggaagtaatagcaccggctatggcaaaccgtccctgactgctcagcgatactatctgtttgaagtaagtctccagtgatgcatacactttctcccgcaggacctccacctcactagggttggagaggccctttgcactctgggatggcagggaaga

SEQ ID NO: 618216 - DNA, 377 bp, Homo sapiens
  misc_feature (9)..(9): n is a, c, g, or t
  misc_feature (88)..(88): n is a, c, g, or t
  misc_feature (236)..(236): n is a, c, g, or t
atatttcanaaggtgaagatggccaggtgcaagggcttcatgcctgtaaatccccaaacactttaaggagccaaggcaggaggatcgnccttaagcccaggagtttgagaacagccctgggaaatatggtaagacctccatctctacaaaaaaattaaaaaatattagtcaggagtgttggctcatgcctttagttccagctagctacttgggaggctgaggtggaaggatcactntgcacctgggagataagaggtcaaggctgcagtgagctgagatcacaccagtgtactccagcctgggcgacacagcaagaccctgtctcaaaaatgaaacaaaaaaaggtgaagataaatacaaaaaaaaaaagtcgacgc

SEQ ID NO: 618217 - DNA, 801 bp, Homo sapiens
  misc_feature (708)..(708): n is a, c, g, or t
  misc_feature (716)..(717): n is a, c, g, or t
  misc_feature (723)..(723): n is a, c, g, or t
  misc_feature (726)..(726): n is a, c, g, or t
  misc_feature (729)..(731): n is a, c, g, or t
  misc_feature (733)..(734): n is a, c, g, or t
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggccaanaacaagannaacaanaanacnnnannggaattaaaacccagggatgcgtgacacacaagaaggccaaagaaagggccaaggggacaaaccctg

SEQ ID NO: 618218 - DNA, 757 bp, Homo sapiens
  misc_feature (664)..(664): n is a, c, g, or t
  misc_feature (672)..(673): n is a, c, g, or t
  misc_feature (679)..(679): n is a, c, g, or t
  misc_feature (682)..(682): n is a, c, g, or t
  misc_feature (685)..(687): n is a, c, g, or t
  misc_feature (689)..(690): n is a, c, g, or t
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatctcgtctcttcttggatgatgtttgccgtcagcattccccaaataaacttgctttttgggccaanaacaagannaacaanaanacnnnannggaattaaaacccagggatgcgtgacacacaagaaggccaaagaaagggccaaggggacaaaccctg

SEQ ID NO: 618219 - DNA, 652 bp, Homo sapiens
ggggtgggggaagctgagcgctgagaccaagggctaaagctgggagactgaatgcagaccgccggggcattattcatttctccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggcca

SEQ ID NO: 618220 - DNA, 262 bp, Homo sapiens
gtcctggtggtgtgtgggcccttcttggagggggaacgttcaccttaggctggactcggcgctgcaggctcacggcctcgtccagctcgtagttgtgtctgcataccctgtccggcactgcccgctcctcctccaggatgtccttctggctgttccagtactcctcatcagggccgccccagctccgctcaccgtcccggtaactccccctacgtcagctctcgaacgcgcacgacactcctcccgggttgtagactgtatc

SEQ ID NO: 618221 - DNA, 696 bp, Homo sapiens
  misc_feature (95)..(95): n is a, c, g, or t
  misc_feature (98)..(98): n is a, c, g, or t
  misc_feature (108)..(108): n is a, c, g, or t
  misc_feature (112)..(112): n is a, c, g, or t
  misc_feature (123)..(123): n is a, c, g, or t
ggcattactgcaggaaaaggtcccggagagctgagcagtcaagatgtgtgacttcaccgaagaccagaccgcagagttcaaggaggcctgatctnatnccaagcactngagntcaaggaggcnttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggcca

SEQ ID NO: 618222 - DNA, 670 bp, Homo sapiens
  misc_feature (10)..(10): n is a, c, g, or t
  misc_feature (19)..(19): n is a, c, g, or t
  misc_feature (30)..(30): n is a, c, g, or t
  misc_feature (82)..(83): n is a, c, g, or t
  misc_feature (85)..(87): n is a, c, g, or t
  misc_feature (92)..(92): n is a, c, g, or t
ttacgccgancccaaaacngtttatttttncccgaagagcagaacacacaagaggggggtttttattaaaaaccagaccgcnnannncaagnaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggcca

SEQ ID NO: 618223 - DNA, 599 bp, Homo sapiens
  misc_feature (55)..(55): n is a, c, g, or t
  misc_feature (66)..(66): n is a, c, g, or t
  misc_feature (76)..(77): n is a, c, g, or t
  misc_feature (121)..(122): n is a, c, g, or t
  misc_feature (506)..(506): n is a, c, g, or t
  misc_feature (514)..(515): n is a, c, g, or t
  misc_feature (521)..(521): n is a, c, g, or t
  misc_feature (524)..(524): n is a, c, g, or t
  misc_feature (527)..(529): n is a, c, g, or t
  misc_feature (531)..(532): n is a, c, g, or t
ggagatgtcagaacggctgaggcacagaggtgcagtcagtcattgggaccatatngtctgtggctntcaggacagnnagcttgggactcaggtagatgactctggaagagtccttctcttnnggaactgcagcatcccttcgtcttccccaaggggaatttagtccaggaaataccagatcctcatctcgtctcttctcttgtacaagagaagagacgagatgtgcaagagaagaagacgagatatacaagagaagagacgagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatctcgtctcttcttggatgatgtttgccgtcagcattccccaaataaacttgctttttgggccaanaacaagannaacaanaanacnnnannggaattaaaacccagggatgcgtgacacacaagaaggccaaagaaagggccaaggggacaaaccctg

SEQ ID NO: 618224 - DNA, 201 bp, Homo sapiens
  misc_feature (22)..(22): n is a, c, g, or t
tgctctggcgctcagagacccnctcttatgtgcccccttctgatggagatgacccgaggtggtcctcctcggtgacccacaccaggaaggtcttattgtcattgtgccagataccgcggacgtcgggccagtcgcgggccatgcccgaggccagcagcagccacgacacgggcttgtcgaagaggaagtggtcgtcgatga

SEQ ID NO: 618225 - DNA, 375 bp, Homo sapiens
  misc_feature (282)..(282): n is a, c, g, or t
  misc_feature (290)..(291): n is a, c, g, or t
  misc_feature (297)..(297): n is a, c, g, or t
  misc_feature (300)..(300): n is a, c, g, or t
  misc_feature (303)..(305): n is a, c, g, or t
  misc_feature (307)..(308): n is a, c, g, or t
tcgatctcatagaggatcccctacaagagaagagacgagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatctcgtctcttcttggatgatgtttgccgtcagcattccccaaataaacttgctttttgggccaanaacaagannaacaanaanacnnnannggaattaaaacccagggatgcgtgacacacaagaaggccaaagaaagggccaaggggacaaaccctg

SEQ ID NO: 618226 - DNA, 430 bp, Homo sapiens
tcgtccggtgttatctgttgcacttggggctacgctgtgtgatctccaggcagtgtatccagccagcctggagggtgggagtctcctgtgctcttgacaacccactactcaacagtgggctggtggagagctcctcactagctagttaagacccagccatggctgagcgccgtggctcatgcctgtaatcccagtactttgggaggccgaagcgggtggatcgcctgaaattggagttagagagcagactgggcaatatggtgaaaccccttctctactaaaaatacaaaaaattactggtacgcacctgtaattccagttacttgagatgctgaggcaggagaattgcttgaacccaggaggcagacggctgcagtgagcgcatagatcatgccactgtacctccaggctaggttgcactcgataaaca

SEQ ID NO: 618227 - DNA, 440 bp, Homo sapiens
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaactcctcagtgtggtcatgggcccacagttcttcagctaagagcttccctttatcttcataggccccaaactcaagcaagtctggattagcaaatcccatggatttccttgcttttagtggggagtcatctgtcatctccctgttcggtttatact

SEQ ID NO: 618228 - DNA, 352 bp, Homo sapiens
  misc_feature (50)..(50): n is a, c, g, or t
  misc_feature (52)..(52): n is a, c, g, or t
  misc_feature (54)..(54): n is a, c, g, or t
  misc_feature (57)..(59): n is a, c, g, or t
  misc_feature (63)..(63): n is a, c, g, or t
agtataaaccgaacagggaaaggcacggactctggggagactgggaagtntnanccnnncagngagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatctcgtctcttcttggatgatgtttgccgtcagcattccccaaataaacttgctttttgggcca

SEQ ID NO: 618229 - DNA, 406 bp, Homo sapiens
ttaatttgcagaactggttgaacacatcaaatgtgacattagcccatcagcaattcaatatttaatagctcttcgaacaacttaacaagaaattcagaacatgaacctcttggaaaaagttgggcttttcttgttggtgttgttgtcactgtactgacgacttcacttctcatttttattgctatcaaatgcccaatatggtacaatattctgcttagttataatcatcatcgcctggaagagcatgaagcagaaacctatgaagatggttttactggaaatccaagctctctttcacagataccagaaacaaactctgaagaaactacagtaatatttgaacaattacattcatttgtggtagatgatgatggatttattgaagacaaatatatagatatccatg

SEQ ID NO: 618230 - DNA, 420 bp, Homo sapiens
  misc_feature (60)..(60): n is a, c, g, or t
  misc_feature (190)..(190): n is a, c, g, or t
  misc_feature (236)..(236): n is a, c, g, or t
atatatttaatatttaacatataattgtgtgtgttgcaaaaatttttaatggccacaatnggaaaaactttaaagacccactggattaaaagatggtatttagggccccagcacaatgactcaagtctgtagtcctcagcactttgggaggctgaggtgaggggatcgcttgagcccgggagatcgaganccagccatgggcaatatggcagggccccatctctgcggaaaatacnaaaattagccagatgtgttgcaactgtggtcccagctattcgggagactgaggtgggaggatcacttgagcctgcagggtcgacgctgcagtgagccatgattgcaccactccagcctgggagacagagcaaggccttgcttcaaaaaataaaaataaaagatgacattaagaagaaaaaaaaa

SEQ ID NO: 618231 - DNA, 653 bp, Homo sapiens
  misc_feature (378)..(378): n is a, c, g, or t
  misc_feature (472)..(472): n is a, c, g, or t
agactctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaatgtatattctgttgatttggggtggagagttctgtagatgtctattaggtctgcttggtgcagagctgagttcaattcctgggtatccttgttgactntctgtctcgttgatctggctaatgttgacagtggggtgttaaagtctcccattattaatgtgtgggagtctaagtctctttgtaggtcactcangacttgctttatgaatctgggtgcctctgtattggtgcatattatttaggatagttagctcttcttgttgattgatcctttaccatatggaatggcctctttggctctttgaacttggtggttaaagctgtttattaagactagattggcccctgctttttttggtttctttgctgggcct

SEQ ID NO: 618232 - DNA, 105 bp, Homo sapiens
gaggccacggtggcgcataaacgaatgactagggttatagggggcgcgagcttagagacagtgaactcaaggtgaccaggtgcaatttgcagagctagcagcgaa

SEQ ID NO: 618233 - DNA, 718 bp, Homo sapiens
  misc_feature (59)..(60): n is a, c, g, or t
  misc_feature (107)..(107): n is a, c, g, or t
  misc_feature (493)..(493): n is a, c, g, or t
  misc_feature (683)..(683): n is a, c, g, or t
  misc_feature (710)..(710): n is a, c, g, or t
  misc_feature (718)..(718): n is a, c, g, or t
gagacttatgtaagcgtgattcaaaccataattcgtgttgtaatcagactcagcaattnntgttgtatgattttgtttttttgtaaagtgtaattgtccttgtacanaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagtcattgaaaactatcttaaatgttcttggtaggggagttggcattgttgataaagccagtcccttcatttaactgtctttcaggatgttccttcgttgtttccatgagtattgcaggtaataatacagtgtattcataagaatcttcaatcttggggctaaantgccttgtttctttgcgacctccttttcaagggtcccttacatattaattactaattgtataaagcacgcacgcttctctacataatagtagagaaactgccaccactttttgctattacaatgaattggcgtggggcctgctgctgttgtcctaagtaaagatattctgaattccccattttatcacantaaagcgttgatttaacacaacaaganaaaaaaan

SEQ ID NO: 618234 - DNA, 666 bp, Homo sapiens
  misc_feature (604)..(604): n is a, c, g, or t
  misc_feature (606)..(607): n is a, c, g, or t
  misc_feature (611)..(611): n is a, c, g, or t
gagcctatatcttttgggcacaatctttttaattaagaaagaaaaaatgaatcagtccattgtttgacagccctcactaacgcagcctttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618235 - DNA, 1118 bp, Homo sapiens
tattttggggagggtatggatattatgcgctgtaatgataacagctattggagaactttagaagttcgatgaaacatcttgtagggaattcaagtcatccacgaggagtggaatgatcatgtacatatttgtagatactgaaacatttacctggagccagcctataactactggtaaagcaccttcacctcgtgctgcccatgcctgtgccaactgtcggaaatagaggcttccggttgggaggcagatatcgagatgctagaatgacatgatcttcactatcttaatctggatacatgggagtggaatcgaattaattccatcaaggcatatgcccagttggtcgatcttggcacgtcagtaacaccagtttcttcagatcatcttctttctctttggaggcatttaccactgataaacagccactaagtgatgcctggacttactgcatcagtagcaaatgacatggatacaatttaatcatccatataccgaaacagccaaggttatggtacacagattgtagccagcgatgaaggagaagtaatagtatttggtggatgtgtcaacaaacttgctagtcaatcacagagctggacacagtaatgaaatactaatatttcagttcaacaaaatctctgtacgggtaagcttacgaaacagccattgctttacacactgttagccaacttcatgggcactgcttccacaacacttagttcaacagtgttcatcacaaggttggcacgtaccaccactccgggacctaacggctccctcacactagtgctatctatcccctttgctgtgcacgcacctcggtgtaccctcacaagtgggtacctcattggcaactaatatgcaattgtgtccacacgaccagtgcgatactagtatgtgttatgcgctacacacacacttctgcgccacccccaacatcagtcttcaccgcatccaccaccacaaaacacgtgccacccacgaaataacacgctgcgctcgcatcacaacaattcataatatatgctacacgttcaaccacccagctcactatattctcttatactcagtaacggcccggccacaacatcaccgcacgtcacatacctacaacaccc

SEQ ID NO: 618236 - DNA, 654 bp, Homo sapiens
  misc_feature (592)..(592): n is a, c, g, or t
  misc_feature (594)..(595): n is a, c, g, or t
  misc_feature (599)..(599): n is a, c, g, or t
agagacaaaaactacattacaagatatcagcgatggagacagcccctgtttttttggcaaataatagcggacgactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618237 - DNA, 896 bp, Homo sapiens
ggcggtggctgttggctgtgacaggaggcgcgaagccggaggtctaatctggacgtgtgccgtagcatgtgagcccgcgtgtatgtggacgtgtgcgcgctgcgtcttcctgactgtgggtgcgcctgaaggggctggagttcgtgctctatccaccagctgcgtgggtgttcgtgtgcctcttcctcctgccgctctcgcttatcttcgatatctactactacgtgcgcgcctgggtggtgttcaagctcagcagcgtctccgcgcctgcacgagcagtggcgtgcgggacatccagaagcaggtgcgggaatggaaggagcagggtagcgaagaccttcatgtgcacggggcgccctggtggtcattgtactcactacgtgtcgcggaagtacaagaacgacgcacaaaaacatcatgatcaacctgatggacattctggaagtggacaccaagaaaccagattgtccgtgtggaagcccttgcgtgaccatgggccaggtgactgccctgctgacctccattggtggacctctccccgtgttgcctgagcttgattgacctcacagtgggggggcttgatcatggtgcacaaggcatcgagtcatcattcccaccaacgtactgggctgttccaacacaatcttgacttgttacgacgctggtcctggctgatggcaggttttgtggcgatgcactcccgtcccgaaaactcagacctgttctatgccgaacctggtccctgtgggacgctgcgtttcctgtgggccgtgaaaaccgatcactctggcaagaatccgtaagctgctatcagccagatgggctgagcatttggccattacccgcagtcaggcgagcacctcttgaggcgcacccggaggcgcatacgcggaaac

SEQ ID NO: 618238 - DNA, 682 bp, Homo sapiens
  misc_feature (620)..(620): n is a, c, g, or t
  misc_feature (622)..(623): n is a, c, g, or t
  misc_feature (627)..(627): n is a, c, g, or t
atgtctgggacttaatcataactctttatttttgggtgggcgccttccttctttatcagtcaatattttaccccgcccctgtttctttgccctagtccccttcgccctttattcttcaatttgtttcaattttttcgccacttgggttttgcaacgttaagtcacaccttcagttaaaaattcggggatcccacattatctttctcgcgttttgttttccgtcccataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618239 - DNA, 125 bp, Homo sapiens
tcagtcggtaccggtcccatgcacagttgcttggagcatggtcgtggcttagccacctaccatgtgcggggctattgcttgccttgtggacagaccctgtggcttaggctctggcctgggagctg

SEQ ID NO: 618240 - DNA, 1136 bp, Homo sapiens
  misc_feature (1074)..(1074): n is a, c, g, or t
  misc_feature (1076)..(1077): n is a, c, g, or t
  misc_feature (1081)..(1081): n is a, c, g, or t
cacaggatttcagggcactgtgtctttggaatcaggggattcacccatggcggactgctagactgatgctggagcggtcggcctaataatactcaacaagagcctttttgcggtcagccgtttgaggcgagtacctcaattttgttatggttgtccctattgcgggatatcgtatatcgccttgagtagagtgaagcgggtggcgtagcctaacgaccgagccaggcagtcagttacgagaactcttaattagcctcttctaagggaacgccgcaaaactccccccgttaggccaatgagtccaggtgttttttttaattctcagatttgcattcagttctgcttctgttagggaacattcctttgtcacctatggttgcagtgtttcgatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618241 - DNA, 216 bp, Homo sapiens
agggaacttgtacagggaggcatgcaccgcaatggatgaatacacgtcgaccaggatccagctttccgatcttgggaggtcagcacggtgctccatgtatcaacggaactagtactagggaggcatgccaccgcagtggtgaatacacgtcgcgcagagaagcatgcatgcaatgcttgtggtactggaggctcctctaaaatcgcacaggatcca

SEQ ID NO: 618242 - DNA, 1010 bp, Homo sapiens
  misc_feature (82)..(82): n is a, c, g, or t
  misc_feature (257)..(257): n is a, c, g, or t
  misc_feature (948)..(948): n is a, c, g, or t
  misc_feature (950)..(951): n is a, c, g, or t
  misc_feature (955)..(955): n is a, c, g, or t
acttaaccgtactatagacgtatgtggggcgcggggcggggtgataggggacaggccggcgtgcgacccgcggtagacggtngtctatgaacagatcccgcggtgacggcatccgtggagctggtgcatcccggaacggccaaataaagtggcaaccggagcgcagtggaccagtgacgacgacgcgaaacgcacgagcctcgttggatcgtggtgtggggtaaggaagcacggtggggagaaggaggccgtggagncaaacaaaacgtaattcaataaaaaagatttcctttttagcaggggtaaggcgaacccccggcccaaaagcacagccctcataatttgcggggcagacaccttccaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618243 - DNA, 249 bp, Homo sapiens
cccccccccctaaattttgttttttggggggaaaatagggtcccctgtttcccggcccctttttttgtaaaaaaaaattttaagttgtttttccccccggacccattggcccttgcggggccttgatagtttaaaccccccccccccttaaagattgggggcccccaataggaaaaggggattacccgggttttggggtttaaatgccccccgccttttccaataaaaggggccccattttttttatta

SEQ ID NO: 618244 - DNA, 955 bp, Homo sapiens
  misc_feature (51)..(51): n is a, c, g, or t
  misc_feature (893)..(893): n is a, c, g, or t
  misc_feature (895)..(896): n is a, c, g, or t
  misc_feature (900)..(900): n is a, c, g, or t
ctgggcgggggggcggaacggagtagggtgtgatcagctacacactattanttgggtgggatgagcgggatcacttgtgtatagacgacaaattaaatcgccgttcggggggcgtgttcacaaagggcgatgagtgagggttagggcgtgagagggtggagcagtagtgagatatcgtgtgagtactttaaggtgagcggcggcgcatcatacggtccaccgaccgggggcgcgaccggcggatctatcgtgcgcgggcggggacaggtgagtgagaggttagcggctgaagattgaaagtctggggatgcgcgtggcggatggacaagggtgggcgggagggagggtgcggatactcgggggcggcggggggaggagtggccacaactgagtgggtctgtacggggccctaagagataccaggctacatcaaaagcggcgcggggtgtctgcagtcgggcggacggcgagctgccgtgatacgcgctgagcgatgatgtttacgctaacataaagggccacgaaagctcggagacgaacagaacccccagcggcaaggcgcgcgcgcggcatgaggcggcgtcgcgtaaataaaccgcgatgcgggtgtcgttgttgttagtgtaatggatagggcgagttttccagaaaatgcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618245 - DNA, 295 bp, Homo sapiens
atctggattacaggcgggagccaccatgcctggcaccggctggtatttcttagcatcagtgttgcaattaaaaagcaagcaagagaccgggcgtggaggcgcacccctgtaatcccagacactttgggaggccgagtgggtggatcactaggtcaggagatcgagaccatcctggctaacacggtgaaaccctgtctctactaaaaatacaaaaaattagccgggcgtggtggcggacgcctgtagtcccagctacttgggaggctgaggcaggagagtgctgtgaacccgagag

SEQ ID NO: 618246 - DNA, 927 bp, Homo sapiens
  misc_feature (865)..(865): n is a, c, g, or t
  misc_feature (867)..(868): n is a, c, g, or t
  misc_feature (872)..(872): n is a, c, g, or t
gacctggagatacgcgttcgcacggccgccgcacattcatgagaggacgggagccgctggtctgcgcggtaacgcgcgccacggccatcccccgcaacccttcgcaccaacgcccgcccgctagccggggtgcgcgcgggtcgcacatcctaggccacatctcctccctggcgcccccggatcgcgcggacgcacgcgcaaacacgccgccgccgcgctctccgccccgcgcccgcctgggcgcctcctcgactcacgtgtactatagggaggctgtgcaacactacacgaacggaaccgcgagctccataagggtccggcgagcctcacgggcccaccgaagagcgtcgccccgccgcagcggacctccccctcttccgccgccgggcgttttccaaccgctaggcgcgatcttaaagtacgcatcgcgagcgctcgacatcatccttcgggcctctctcgctcaacccccatgatagctttgttagtaggtggctaaaaagctcgtgatatctcgccgtgatgtaaagcaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618247 - DNA, 897 bp, Homo sapiens
  misc_feature (835)..(835): n is a, c, g, or t
  misc_feature (837)..(838): n is a, c, g, or t
  misc_feature (842)..(842): n is a, c, g, or t
gtgcgggcgggagttattggaagaattataagacgatataaattatatgaggtgactgtcggatatacgattagacgagtatgatcgaagtgggggggggcgtacaatcgggcgacgaggccgcgaataaagcggatgaagtttatacaatgatcgttgtatgcacccttggagagcgttggtataaatcatttatatggggcgtcagtctgctgtcaatgagccggcctatggttagagggtgggccggccacgatgtggaagaagagggagataggcgcagacttatgatggatgtccgctcagtggcgtgtactgggtgtggggtgaagaagaagtagagaagtggtcgcagtgttgggttaaaaaggagaggaataattttgggttgagatatcaagaatcgaagatatctttatggcattttggtttgggttgacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618248 - DNA, 561 bp, Homo sapiens
gcacgaggttttcacggatttgaaaaatgcacctccctatgtcccccaaagatccaagcagccggatggtatgaccatcaaactgctacctttccagttagaaggtcttcattggctaatatctcaagaggagagcatttatgcgggcggtgttttggcagacgaaatgggtatgggtaagaccatccaaactattgccctattaatgaacgatttgactaagtctccgtctttagttgttgcccctactgtggcgctgatgcagtggaaaaacgaaatagaacaacatacaaagggacaactgaaaatatacatttatcacggtgcttccagaaccacggatatcaaagatttgcaaggctacaatgttgtactaaccacttacgcagtgctggaatcggtattcagaaagcaaaactacgggtttagaaggaaaaatggacttttcaagcagccttccgtattgcataatattgacttttatagagttattctggatgaggcacacaatatcaaggatagacaaagcaatactgctagggctgtaaacaacttaaaaac

SEQ ID NO: 618249 - DNA, 113 bp, Homo sapiens
cctgggtcaatagtgacagctgtgattcaactggtctgaggctcggagattttaaacctggaaagtagatccccatctcggagggtggccatggaagttcagtggagatgatg

SEQ ID NO: 618250 - DNA, 845 bp, Homo sapiens
  misc_feature (1)..(1): n is a, c, g, or t
  misc_feature (783)..(783): n is a, c, g, or t
  misc_feature (785)..(786): n is a, c, g, or t
  misc_feature (790)..(790): n is a, c, g, or t
ngttccgttgacctcgtacagtggcacactttgtgtagtcgcaccaactaagtggtggtgggttgtgggaaacctcatgccattcataaacgaccgctcacgcgttcactgtgcacgactcacgatcgcacacgcgcccacacagagtgaatgcagagccagacggcgctccccttcccagccggacagcaccacaaagccctaagacaagtgagcgcgcaaaggggagccactacgttatcatgccgcacatttgtctgtatgctcctgtccccacaaacccaattccacatgtacgaagcagaccactttcaaaaccataggtaagatggtgagccaaagacatgaggacacaatactatccttccggcatttttgcttcaggtgcataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618251 - DNA, 889 bp, Homo sapiens
  misc_feature (419)..(419): n is a, c, g, or t
  misc_feature (422)..(422): n is a, c, g, or t
  misc_feature (425)..(425): n is a, c, g, or t
  misc_feature (434)..(435): n is a, c, g, or t
  misc_feature (437)..(439): n is a, c, g, or t
  misc_feature (455)..(456): n is a, c, g, or t
  misc_feature (827)..(827): n is a, c, g, or t
  misc_feature (829)..(830): n is a, c, g, or t
  misc_feature (834)..(834): n is a, c, g, or t
ccagtaccgagatcatgaataccctcccaaaggaagcggcgcatcgggcttggtttaaatctcaaaatgcatgcaattcccgtttaattaggaacatactaatgtacattaggggccaaggtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctaggtnagnganatggtgccnngnnnggggggggggggaagnngcgccgggggtgggggccttgggcgggggggggagaggggcgaggggctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 618252 - DNA, 452 bp, Homo sapiens
ctaaggatccgggagtagtcattgaaggagagaaatgacgggctacttgacggaaaagcaactgtcttgttctcctgggaggcccagaattggaggagaaaatgtcaccatcttggagaggactgtgacaccagaattgagggcacacaggcagataccagagagtctgactagatgtggcttgcccgccacgtggaaattataaggaagtacgtcctggatgacctcattgtcgccaaaaacctgatggttcagtgctttcctccccactatgagatctttaagaacctcctgaacatgtaccaccaagccctgagcacgcggatgcaggagctcgcatcggaagacctggaagccaatgagatcgtgagcctcttgacgtgggtcttaaacacctacacaagtactgagatgatgaggaacgtggagctggccccgtgaagtggatgtcg

SEQ ID NO: 618253 - DNA, 537 bp, Homo sapiens
  misc_feature (200)..(200): n is a, c, g, or t
  misc_feature (220)..(220): n is a, c, g, or t
tagaatcatggcatgggaggcagcagcttttctgtccaaggactgcagtagctgctcatgagctgtgaggacctggtgggtatacaggcagttcccagggagggcagtgggtacgtctggtgcagaccgtgggcagtgtatagagcagttgggacagactgggggctggctcccagcagggttactgtggcagctggagncccaaggagcctgctagctngtgacggaacagaaaaggttcttcgtttttaaacttttgtttttaaatactcttttttacacctgttgttggtactttttttatgcttaagtcagcattgtcttccagtgttaaaggcatcccttgcctcttcatggaacttatgtgtcaaaacaaaggaacgggcagactgtccatcccaagccagttcaattagatgtaaattcatactgttttaattttttatgcaatctgatgagtagatgggctcagatttaaaatccttaaaagcacgtttattgtaaccagaattgttatgtaattaatactgcagtttt

SEQ ID NO: 618254 - DNA, 269 bp, Homo sapiens
  misc_feature (14)..(14): n is a, c, g, or t
  misc_feature (59)..(59): n is a, c, g, or t
  misc_feature (195)..(195): n is a, c, g, or t
  misc_feature (258)..(258): n is a, c, g, or t
ggagataacctacnaagaccatataacccagtattgatgaggatatggaaaacttgaanccccacagacattgctggtaaaaatgtaacatggtttagctgctatagaaagaagtctgatagttactcaaaatgttaaacatagattatcgtatgactcagcatttccactcctaggtgtatggagtggaaatgnaaatgtgtatgcacacaaaaacttgtacatgaatgtttatagtattgttattcataataaccnaaaagtagacc

SEQ ID NO: 618255 - DNA, 956 bp, Homo sapiens
  misc_feature (414)..(414): n is a, c, g, or t
taacctttccttatgagcatgcctggtgtggggtggacagtgagggtaataatgactggttgggttgatggtagaatatggggcttgtataattggtcagttcaggtgtttataatctgacgcaggctttatgcggaggagaagtgtttacagtgttacttatacataacatatagttcttctatagggtgatagatgggttccaatggtggtggtggaaggatgttcagttaataatgtttgggagcattatttaaagtgtagtggggtagtaggaagacttggaacgctttccttaaattgaggttggacgagctatttaagagccctaactaaagaggtggtaaacaattttataaaatactgcttctagacagaggggggtaaagagaccactatagggtgggtcccaanaagacagcctggtaacacatactatagggagacataccacaaggaaaaaacctgaaacaacacaggggggagactataagagaggggagtcaccatgagtgggggggcaaaagataaaaaaaggtggaggaaagcagaagagatacacaactacatagagagaaaccaaagcaacagaggacaaagatcaacacgacgaagtgacaacccagaaaaaaagagatcgaaaggcaagcgaccatcccatacagcgatttaataacaaaaaatacagatgatcacgaccaacacaaaaagatcggagacaaaaacaagataaacgaagaagggggaagaagaagaaaaaccaataataacacagaacattaggaactacacagcaaagaggatgaaagccgtcacgatacagtggaagattaacgggaggtgagaagactaataaaaagacgtcagagtgagaataacagccaaatagggagaaaagagagagcaaccagcaacacaaaataaacaagtagacagataacatgcagcaagacaac

SEQ ID NO: 618256 - DNA, 231 bp, Homo sapiens
gaaaagctgatcacactagctctgaaatgcagcaaggagggggcttatgccctgcaacgccacaggggcagagctgttcaaggacattggagcccacctcttgcatcaatgtgacccggatgtgagacaaggagtcaaaggaaaccattttggaactttaaggtttaatgactgccctcttgtatttcagatgtgcaaggggcctgtagcccctttgttttggccaatttc

SEQ ID NO: 618257 - DNA, 814 bp, Homo sapiens
  misc_feature (59)..(59): n is a, c, g, or t
  misc_feature (85)..(85): n is a, c, g, or t
  misc_feature (94)..(95): n is a, c, g, or t
tatacccaaagaaagcggtttagtagaaaaaagtgcatcaccctgttctttcttcaggnaaggtctgttctgcgacttaagagcnaggcactanngttcctgtttttaaaaccggcgcggacacatcttatttcccaagttgtgggcctaaggcgcacgaagcgcccaaggagcgaaatttttccccacaagggcaagggtttttttccccaaaagaagcaaacaaacttatggggcgggcaaaagggaaaaaaaaaactttttcccctttttgttgggagaaaaaaccccccccccggaggggggcacgcctttttaaaccagcgaaagaagaataggtttaaaggtttttaacagtttgttgagtggggcagaacacaaacataatggtcgtccccaacaggtggtgggcaaacacacgggcaaacatttacaacgggggggttttcccgttttgtaaatgtcaactagcaagttgtaatcgactaagtgaactgttgggagtgtttactatgatccgggacgccccgttttctgcccgacccggttttataaaggaaagattttcatttgcgggagaagacagggcgcaatttttacccccatatgattggttttcgcacccgttgttgtggggttgtgaggggaaaacaaaggggatgaacaacacaaaaagggcggggtggggtgtgaaatatactccgtagataagagtgtttttgatttatatagttgttaccacgcgtattttggtttttagaaaagatcccctttttgttggggcgcccccaaagggggtgtgacaagtttttta

SEQ ID NO: 618258 - DNA, 316 bp, Homo sapiens
taaaatgggagtctcgctctttggcccaggcgggagtgtagtgggtgtcatctgggcttacggcagcctccgcctcgggggttcgagcagttctcctgcctcagccttctgagtagtagcggggattgcaggggtgtgcccccacacccagctgattttggtattttaaatagagagggggttccacagcatgggccaagcgggtctcaaactctgtgacctcgggtgatccacctgcctgggcctcccaaagcgtgggattacaggcatgagccatggtgccgggcttttttttttttttttttttatttttttt

SEQ ID NO: 618259 - DNA, 469 bp, Homo sapiens
tcggctctaccttgtctgtatatataccatggtagtatatatacagacagatgaattagacacaggcgtaagaagtagggcttatgttgaaagcctcaaatatgtgtggagctcttagtgcctcgtgatttattcacatcatgaatagtgaattctatccatgatgattaatttttttctaaattgccttaaaactgcctttaaaataccaacatcattgaaactgtttgtgataagtacaggtattgggttcatagggtgtgaagtttaagcatggaatgaaggaagatagctactatttattgggccattatttaccagatactgcgctaagtgctttttgtagatgtttatttaatctcaataataaccttacgaggtaggggatatcgtcctgattttacagatgaggggacagtttgaggtaggataagtgatttgactaagacaaggtagagccgaggggtac

SEQ ID NO: 618260 - DNA, 309 bp, Homo sapiens
catatgttttctaggattccattaatctgaccttttaggcccgcaatatagtgcattttgtgtatgtttgaccacacgcagcaaatgctgaaccctttcttattcctgtatctatgaatcgatatggcaagacttatctccaaggcatatcaaggattttttttttttattagcttacttggccaggcgtggtggctcacttctgtaatcccagcactttgggaggctaaggtgggtggatcacttgaggtcaggagtttgaaactagcctggccaacatggcaaaaccccgtctctactaaaaaaaaa

SEQ ID NO: 618261 - DNA, 275 bp, Homo sapiens
tgatctagcaggcatcccttagctgaaggtcaaattattaaatattttctaaatcatcgatggcagacatatatatattcattatgttattctccactattgttcaatgtttggaaactactgtaatactagaataaaccaagatgagcagatgtaggtgatagcattatgactatatgtctttcttcacggcgatgtcatcatttatttagggacttgtaccaacatgcacctgagttgcacgacatgatctgttgagacttggttcattttct

SEQ ID NO: 618262 - DNA, 128 bp, Homo sapiens
gacgcgtcttcccaattataggaaccacctcacaacccactcttcacccccaaaatcacgcatgcatgggacacagagaaagggaagcatgtgtgtgtaagaatagagagccctaactgatagttact

SEQ ID NO: 618263 - DNA, 827 bp, Homo sapiens
  misc_feature (42)..(42): n is a, c, g, or t
  misc_feature (105)..(106): n is a, c, g, or t
  misc_feature (249)..(249): n is a, c, g, or t
  misc_feature (258)..(258): n is a, c, g, or t
  misc_feature (262)..(262): n is a, c, g, or t
  misc_feature (270)..(270): n is a, c, g, or t
  misc_feature (274)..(275): n is a, c, g, or t
  misc_feature (279)..(280): n is a, c, g, or t
  misc_feature (297)..(298): n is a, c, g, or t
  misc_feature (307)..(307): n is a, c, g, or t
  misc_feature (311)..(311): n is a, c, g, or t
  misc_feature (317)..(317): n is a, c, g, or t
  misc_feature (321)..(321): n is a, c, g, or t
  misc_feature (333)..(333): n is a, c, g, or t
  misc_feature (339)..(339): n is a, c, g, or t
  misc_feature (350)..(350): n is a, c, g, or t
  misc_feature (354)..(355): n is a, c, g, or t
  misc_feature (358)..(358): n is a, c, g, or t
  misc_feature (364)..(364): n is a, c, g, or t
  misc_feature (370)..(370): n is a, c, g, or t
  misc_feature (374)..(374): n is a, c, g, or t
  misc_feature (389)..(389): n is a, c, g, or t
  misc_feature (401)..(402): n is a, c, g, or t
  misc_feature (409)..(410): n is a, c, g, or t
  misc_feature (415)..(415): n is a, c, g, or t
  misc_feature (423)..(423): n is a, c, g, or t
  misc_feature (429)..(429): n is a, c, g, or t
  misc_feature (436)..(438): n is a, c, g, or t
  misc_feature (448)..(448): n is a, c, g, or t
  misc_feature (454)..(454): n is a, c, g, or t
  misc_feature (476)..(476): n is a, c, g, or t
  misc_feature (493)..(493): n is a, c, g, or t
  misc_feature (497)..(497): n is a, c, g, or t
  misc_feature (505)..(506): n is a, c, g, or t
  misc_feature (516)..(516): n is a, c, g, or t
  misc_feature (523)..(523): n is a, c, g, or t
  misc_feature (530)..(531): n is a, c, g, or t
  misc_feature (549)..(549): n is a, c, g, or t
  misc_feature (555)..(556): n is a, c, g, or t
  misc_feature (571)..(571): n is a, c, g, or t
  misc_feature (575)..(575): n is a, c, g, or t
  misc_feature (579)..(580): n is a, c, g, or t
  misc_feature (597)..(598): n is a, c, g, or t
  misc_feature (604)..(604): n is a, c, g, or t
  misc_feature (612)..(612): n is a, c, g, or t
ggggtccggtaacaacatggcggcgtccgtgaggggctcttngggcaggggtagtgttggtgtccctgtcttgcgtgatatgacaaatgaagctttcctgcaccnntgacttaaggaagagtgtactcgtaggcggacagctttaggtggccggccgccggttctcatcccccgtaagggagcagaagtccttgtgtactgaccaaagatgagcacacatcttacatccaggagcctcccacgaatggnaaagggttnatgngaaaactnacanntggnngatatggacattagagnnggtgggtcnaaangaaagnttcntaaaagctgggnagaaantttttatccancttnngtngggaangcttantatngacaataccattttncatagagtggtnncctgttnncatangtccaggngggagnatcctannngcacagggantggtgnagagtctatctatggagcgcantcaaagatgtttccatncagnggtgcgtnnaatcggaagngactgtngcatggnnaaatgtggtctcatgatnagtggnngcagttttttcttcnacantggnncgagcagatgaatttanncaatangcattacnatttgtggaacgggttaccggcggtacagcatatacatgtgcggcactggtccgacgttgacctttgtgtgcgaaaggaccctaattcccaaataaaagtggggggttggaaactttggggaacttccagggataagggcgcaaaggaccgcgggggttaatgtaccaggcgccaattgtttcctggggggcgacaaagaaactcttccaggacc

SEQ ID NO: 618264 - DNA, 414 bp, Homo sapiens
  misc_feature (12)..(12): n is a, c, g, or t
  misc_feature (62)..(62): n is a, c, g, or t
  misc_feature (101)..(101): n is a, c, g, or t
  misc_feature (139)..(139): n is a, c, g, or t
agaaaatgccanatgctaataaaaatgttcagatgtatcacatattagcatacatgatctcnaatttttgcctatttatgctatgcatggctaatttgggncgccatgggtggaggcatgttagtctcaattgacaganatctccatcaactgtgcaaatggcaatttaaatacatttaactatgtggtaataatctcataataccattatcatgtagattggcagaagtattatgtggggcaaacagctatttttgtactgttgtaagatattatgaatgctgggcagtgtagggcatggcccttgctaccacttcccaaaaatgtgtaagggttgttgaaggtgccttgttcttcttttttcttcaatataagcaaagctatttatatcataaaactaaaacttgaaattcc

SEQ ID NO: 618265 - DNA, 123 bp, Homo sapiens
gagcctggcgcatggcccgtacttctccagcaggtaggtctcaatgttggcgcccacgatgtactcggcaacatcaaagttgatgcggatgaatttgccgaatcgggaggagttctcattctt

SEQ ID NO: 618266 - DNA, 445 bp, Homo sapiens
  misc_feature (439)..(439): n is a, c, g, or t
  misc_feature (443)..(443): n is a, c, g, or t
aaggctgagtttggtggagaatggttgcttggtgtctccccctctggactctttcccttctccttctcccatggtaaattattcttcccaattctcccctgtgttcacccattataactgttttctgctgccaatctttttctggaaagttccccccttcctacctcctgccccattcctcccaatcagttcagctcttgtgtgtgctggaccagaaatccctcttggcagcctaggcaacatagcaagacccccaactctatatatttttttaaattagccagcatgataatgcacacctatagtcttatctactctggaggctgaggtgggaggatcacttgagcccagaagttaaaggctgcagtgagctatgatggcaccactgcattctagcctgggtgacggagcaagaccctgtctcaaaacaagcaaacanatanat

SEQ ID NO: 618267 - DNA, 164 bp, Homo sapiens
tccggtaatcgcacggagggcacctgtacaccttcagaccagtctgcatcctcaggctgagcagcatgtgaactcaggagcgggagcagctcattcaccctgaaattcctacttggtcactgccttctcagcagcagccgtgctcttctttatcaatctcttca

SEQ ID NO: 618268 - DNA, 277 bp, Homo sapiens
tcttgaaaggccagcctcttaaactagtcttcaggaggtttgctcttaggaactggtgatgtaactgaatggaagtagctgtatgagcagttcaaaggccaagccgtgaaatggtagcaatgggatataatacctttctaagggaaacatatgtatcagtatcatttgatctgccatggacatgtgttgaaagtggataactggacctacttacaatggcttctaccctaaaacgaggagactctaagttaatgtcgttagtatgggccatattact

SEQ ID NO: 618269 - DNA, 411 bp, Homo sapiens
  misc_feature (54)..(54): n is a, c, g, or t
  misc_feature (154)..(154): n is a, c, g, or t
  misc_feature (196)..(196): n is a, c, g, or t
  misc_feature (299)..(300): n is a, c, g, or t
  misc_feature (365)..(365): n is a, c, g, or t
tggggggacaaagtgggcaagccccccctgtccccttcaaggggcaggcccctnggggttttgggtgggaccccttatccctgccccccagggcactgggattgtctccgcccctgtgcctaaaaaactgctcatgatgggtggtatcgatgantgctacccctcagcccgggggtgcactgcccccctgggcaantttgccaaggccccctttgatgccatttttaagacctacaggtacctgacccccgccctttggaaggagactgttttcccccagtttccctatcaggagttcnntgacccccttgtcaagaccccccccaaagtttccgggcagcggactcaggctccaactgggggtncaacatagggtttttatccaagaaaaataaagtgaattaagcgtga

SEQ ID NO: 618270 - DNA, 140 bp, Homo sapiens
atatatttatttttgcaatttgatgtttgttttttaatagatattacaaattaaaaatctcaaaacctgtggaaaaaagtttttaagaacagtctaccttggtaaaacatgcatactctcaccccttctgaagtcttcca

SEQ ID NO: 618271 - DNA, 374 bp, Homo sapiens
ccggtatcctggcagcgggactgtcactaccttaagatgagcattgcccagtgcacatcctcccacccaatcatccgccaaatccgccaggcctgtgctcagcctttggaggccttcggaggaagggtctttcggacagaaacggaggcaagcttgtggggcaaacttgtgccaggagcatattgcgctcgctttccctgcaggtgcgctggaggcaagtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcc

SEQ ID NO: 618272 - DNA, 316 bp, Homo sapiens
gagaatactatagcaggagaatagtctctttacccagcgacagagttcgtcatctatatggtgagacgagcacacaaagtacggggcaaaatggtgacatgaatctatccgctatcaaactgacctcaagtcataaacccgggctcttttacaaaagtattcaacagttgaatctgtgaccagttaattagttgcgaatccactcaatcaaatcatctcaattcactatttcctttttttttttttttttttggaaaattttattaaaacccttttatggttggtttaacctagggaccctcataaaacccattat

SEQ ID NO: 618273 - DNA, 218 bp, Homo sapiens
  misc_feature (85)..(85): n is a, c, g, or t
  misc_feature (104)..(104): n is a, c, g, or t
  misc_feature (177)..(177): n is a, c, g, or t
  misc_feature (215)..(215): n is a, c, g, or t
caagaacatatgcaagttcctcgtaggattggactggctaaggacgctcagctgaaggttcatgggtttaaagtgcttgtggctnaatgcagcttaagtacggntttcgttgcaatgcgtagaatttggatcgtatccattgtaaaaggcttaaaaacctccaacgcttctataatntaccactttggggtccccttataacttggaatcgtgtncat

SEQ ID NO: 618274 - DNA, 810 bp, Homo sapiens
cccattggaaccctgcttgatggtccagggtaatccctcccggtattctgcccagaggcctttgctgagagttggctggttgccacctggaccccctccaattgctggccccttcactcctggacccttcccttacccgatccaggcagccttccgggaaccccggcttcttgtggttactgacccccgggctgacccccagccttttcccggaggcatcttaagttaacctacctacccttgcgctgtgtaaccccgattctcctctgcgctatgtggaccttgccctcccactgccaccaccaggggagctccctccgtgggtttaaatttggtggatgctggctcgggaaattctgcgcacatgcgtggccccagtttcccctggacaccccctgggaggtcactgcctgaatctgtaactttctaccacgaggattttctcgaaagaggagttgtgaaaaagaaagagccacggtctgctgtcctgaggaaggccacgtgaccccaggaggaatttcacgggtgaatggactgctcccgctcctgagttcacctgctactcagcctgaggttccacgaactggttctgaaaggtgtacacacggtgccctctgtgcctattcagccattccctactgaagacctggagcgctcacgcctgccccggaagaactggtctgcacgctccccctgctcacggcccctgaatgggtaggagcacaccccctgactggtcttaagctgttcttgcataggctcttaagccgcatggaaaaatggttgatggaaaataaacatccgtttcta

SEQ ID NO: 618275 - DNA, 1435 bp, Homo sapiens
ggcgcgttggcgcggggtgggtcgtcgtgttgtgttgtgggtggggcgcgggttgagcgctgttttgcttggtgtcgtgctgtgggtggtggggttgcgtcgtggtgtggggggggagcgcgccggcgggggtgggtcgtgtcgcggtgggttgttgcacgttggtttgtgtctcgtggcgggtgggggggcggtgcgttgggggtggtgtggtgggcggcggggtgctcccggggggtgggtgttgtggtgggtgggtgagggtgtgttgttgttgtgtgttcgtgttcgtcctttttactcgtcggggtgggggggttgtgcgaccccgctgggggggtggtgttgttggggatggtcggctcggtcgggggttggggggggacgcgctgtcgtgggtgtggttgggcggccccgctcgtggggtgttggtactggtgggtggcgtggttgatgtgtttgggttcgtctccggtgagctgtgctgcctgggggggggtgggggtgtgtgtgcggcgttgcggggcgggttcgcgcggggcggtggttgctggttagaggccggctctgtgtttgggtgggggtgcgtgtgcctcgtgtgtgcggccgcgcagggtgtgggcggtttggtgggttgggtgttggttcttcgctcttcctttgttgcgttcgctgtggtggggggggggggcgacgcggggggggcggggggcggcgggtggtgttttggcgtttgttgttgtttccccccccccctttgggtaacaccccgcgctcacacactctcatatataacacacagagcactccatcatttgtgttatacaaacacacacacctccgactgttttatgtgggacacacacacactcatgatagaacactctctctcgaaaggagcgcgccacacgctggtgtgtcccgccacaagacccgcgcgcgcgtgtgtataatcagcccgcgcgccccgcgcgctctctaatatacggcgcgctcctctcacgggtgggcgcgtggcgccgcgcgggggggcgatattgtctcgccccgcgcgggggggtgcgcgccacacacacacccgctgttgtgtcttctgtgggaacacacacactcccccccgcgcggagagagcaccacacacacagagcccccccacaaatatactcctgcgtgtgtggcccccggcgggagaggcccccgggttttgaagacaccacacataaccccccccccccctcaaaagaccccccccccccccacaagagagagagagaattatctctctcacacacatctttattccacacagagagaagaaaaaaccaccaccaaatataataccccccccctctttttgtgaacaactactgtgcccctttgtggttacaaaagacccccccctcttaaattataccccccccttttttcccccaca

SEQ ID NO: 618276 - DNA, 102 bp, Homo sapiens
  misc_feature (97)..(97): n is a, c, g, or t
tcattcagcctgagatacttcttcctcaagattatccatcaagcatttgataaccattaatgtgttcctttccaccacagcagcacgcattacgtgnggtac

SEQ ID NO: 618277 - DNA, 167 bp, Homo sapiens
cagagcttctgggtgcatctcagaagggggcagacgcacagggcagggaacacgggggtctaggcttgtggtccgagttgtccccttgttgactgaaaggcttagggggaggctggaagcttatacaggatgcccggtggcttgttgagaccgaatgagctctttct

SEQ ID NO: 618278 - DNA, 362 bp, Homo sapiens
ttctagaggatcccatgcgcgagctccatccactcagctctggggaggtgtccagtgacgtcctctctgcgtgtacaggatgatcccaccccgatcgttaggaagatgtgccccaggaactcgggattaccttagtgtggtgattaggggtgaaatggatcctttgatagggagtttcttgatggaagcgtcgcgcatatgcacgatgctgagattgaaaagaagaactgaaaacgggtgacatgtccgatcaaacccccatgtactcagggaatcatcccagggcagtcttgcaggctgcagtgcgtagcttcaaatccagcactaattcctcagcccctggcctgaggtcatcatcagca

SEQ ID NO: 618279 - DNA, 294 bp, Homo sapiens
  misc_feature (90)..(90): n is a, c, g, or t
  misc_feature (184)..(184): n is a, c, g, or t
  misc_feature (186)..(186): n is a, c, g, or t
  misc_feature (230)..(230): n is a, c, g, or t
  misc_feature (232)..(232): n is a, c, g, or t
  misc_feature (234)..(234): n is a, c, g, or t
  misc_feature (269)..(269): n is a, c, g, or t
atgaccaaagactttgtccttcttaaaagctgtgtggtgggaaccaaaaaacgggtggtccccccccccaaatcctttttggtgcaaaanaaacggcgggctttggaaaaaatttccctttagttcatttacccccccccccagtttggccatggcccctttccaaccatggaggaaaaaaaancnttttttgggcccccttaaaaaaaacccaatttcaaaagaaaaangngntttattcccggaacaaatttttccgttgggggggnttccaaaaaaattttttttccctta

SEQ ID NO: 618280 - DNA, 625 bp, Homo sapiens
ggagagaactagtctcggtttttttatttatatttttttattttttaaaaaaaaaatagaaaaagggctcccattatgtgggccaggagtattttcaactccggggctcaggtagatcctcctatcctgggccctcccaaagggcggggaacacacgggcacatgaagcccacctgtgaaccagctctggaggaaagcccttaggtcagaggggagtacactcccacaagacctctcggtggaacacccaacccagagaggtgcgtcgggaaaaaaaggggagggcgtggaggaggggcggacacagagtggcgcgacaagagcggtctgcctgaggggcacaacagcaggaacaaagcgagagcaaacgacaacacacaaagcaaccaccgaggacacacaccgaggggaagacgagtgggagagacgcaacgacgagcgactggagctagacagaaagaagcagagagaggggggagagacaaagaagaggagaaacgatagcgtgctatgcgcgggcgggaaagaagaaccaaacaccacaaacaagacaacaccaaacgacgacagcgaaaataacgaacagagacacacacgaaagcaaaacagacaaaagatcgaaaac

SEQ ID NO: 618281 - DNA, 241 bp, Homo sapiens
aaacccccaacccaaaaccaaggattttggaatggggcccccttagtttccgagggtgggttgtataacccctatacccttcgaggaccctgtttgggttggtattaatttgactgtgcctgaccgcggccatcttttctttgggcaaagttttctgtttattttgcttgtcctattcgatgtactttaaggggtctttatgaagtttgcttttctggccataaactttttggcttttgga

SEQ ID NO: 618282 - DNA, 218 bp, Homo sapiens
  misc_feature (3)..(3): n is a, c, g, or t
  misc_feature (210)..(210): n is a, c, g, or t
ccnctaaaccttcccaactctgcaggacagacatggagggaggacaggagcagcttgtctggattttatgctccagaggcctgccaactgggacactcccccgactgccactctggacctaatagctgttccttaggccccactccatgccacccccaccagctggaggacccagcctcacagtgtgtcctttgtgccagaccaagcggnccgtgggg

SEQ ID NO: 618283 - DNA, 529 bp, Homo sapiens
  misc_feature (238)..(238): n is a, c, g, or t
  misc_feature (442)..(442): n is a, c, g, or t
tggcaggctctctaccattcggggggtctgacagcttctgtcctaatactcgcatcaaataagaaattctcacttggggttcgggaggaggcatcaggcccagcctgactttttctggtagttccttcggtgcttccctcctggttggtctccgaagttttttctgttccttctgggtaagatatactcccagagtaactggtgtgtcatggtcaacgggaggatggagcggggcggnatgtccaacaagattggtgattccaaaataatcttctctctggggattttcctctgtaagatcaaagccatgggggataatgtaagagtcccaccactcaatttcaggaatatctccttcctttagctccttcttaggagcaaggagggcaagcctagtcgaagtagggatgccggttttacgagcggctggtgaaatctcggnctgtagcttctccagttgagccttggtccgtaatcgctgagcaatcttctcaaatgtgcccttgtcatggaatttacaagtgcgtct

SEQ ID NO: 618284 - DNA, 569 bp, Homo sapiens
caaatgtgcaaaaactgagggcattcattcatcaccactaaaccagtcctaaaatacttaagggaattctacatctgaaagctaaagaataatatctaccatcatgaaaacacactgaagtataaaattcactggtacagcagatccacaaaaatgagaaagaaaatggagacaaatgttgtcactacagaaaaccaccaaaccacttgataaacaagaacagaagaaaaaagcaaaggatgtttaaaattaacagaaaataatgaacaaaattacaggaacaagtcctcacctatcaataataaccttgagtgtaaatggattaaattccccacttaaaagatacatactagctgaatggattttttaaacatgatccacctatatgctgcctaccagaaacccatttcacctgtaaagacacatatagactgaaagggaaggaaaaaaatatctcccgcaaatggaaaccaaaagtgagcaggagttgttattagataaaacaaactttaagtcaaaaactgtaaaaatgagacaaaaaaggtcatttaaattatggattaaaaaat

SEQ ID NO: 618285 - DNA, 169 bp, Homo sapiens
  misc_feature (8)..(8): n is a, c, g, or t
  misc_feature (20)..(20): n is a, c, g, or t
  misc_feature (118)..(118): n is a, c, g, or t
  misc_feature (136)..(136): n is a, c, g, or t
ccgcgaanataaattttttnccttttaatttgttttgtcctaaaataagttaaaggccctccagagcttttcagccacctttgtctcctactctgtgccaaatatttttccctccggncaggggagccagggtagnccaaaggagacaagcaggacctggaaggtgagg

SEQ ID NO: 618286 - DNA, 259 bp, Homo sapiens
aaaaaaaatgggcccccccgggtcaaaggaaccaaaggggcggtttgcccccttttgacattttgttcctttttgagcattaacaaaacaactaggtttactatttcaccccacctacagcggccacgcaaaaaacttgacattctccatcatttttaatgtcctagaaaacagaactcccaacaaatgtttaagattaaagacggaactggaatggaacttaattttacatctaataaactgtcattaggttcctgga

SEQ ID NO: 618287 - DNA, 137 bp, Homo sapiens
atatcagcagcactggcatggtgtaaaccgggactgttgtgtgttaatgcatttaatgggccagagtgggggcaaagaaacatagcagggttagtagagctgacaacgagaccaggtatatcatcaactagccgtgt

SEQ ID NO: 618288 - DNA, 1082 bp, Homo sapiens
cgagcgatgggcatctctcgggcaacaactggcacacagcgccgcaaaacctgggtgcaagagaaagccctaccacaagaagcggaagtatgagttggtggtctgcccacgtctgttcattgcaccaagattgtgccccggacgcatccatcacatgtccgtgtgcggggaggtaatcgaagaaactatcgcagtgtcccatgcatggtttggagcagtaggtggaacgtttctcactgggtgctcacgagatgttacgtcactctgtaaataccaacgtgatcattcgatgattggtactacagatgacagttctaactaacgaggctgtgttcggtaccaagtaccctggatgataggaattgcgatctgtgcttccagtcgaccatgcaacaaccggtaaccctgacgaggtagtgtacagaggtcccactaatgcgctgcccctggcgccgctaatgaacggggagcccaggctgatttccgtgaggagaagtaaagaggaactcttaaaacagcaatacaaaccggatacttactaaaggcaactttccaggacagcaccaacttttgcatagcactaaggggacacaaagcggaaaattagcccaaaaagtccgaggcaagagtcttcccttggcagtggagttcaagataatccccaagtccagtgggacaacgtctttcttggcaggttgcattctgcctttccaaatgggcccggggtaccagggtgattggacgcgcagcccagtcattggccgttatttagttggcctcaaggacgggggcaaggaggaccgtttcgcggaacgtttgccgtaactcttttaatgcgaaaaacactccaaggcggggcccccgcaagtattggggcccggaaaaatttcaccaatgttccccattttggcgtgtacaaaccgggattacgtttatcgaaacccgcccaaagttgggttaaattttcgcacccgggagggtggctataaaatttatgggaacgcaagggggttgcccccccatagcagcacaagagacacattgcaaaggcacactagggagggtggggcccgggagccata

SEQ ID NO: 618289 - DNA, 198 bp, Homo sapiens
tggaggatggtgagactcagactcttaggccctgccgggaccggctgaatcggaaccgtgcaatttaccgaagaccggtacacacataacatgtgagaagcccccccgagagctgtgccacacttgctccactcctctccccaagattcagacccacctctggctctctcatttccagcagacacccatcctccaggt

SEQ ID NO: 618290 - DNA, 122 bp, Homo sapiens
  misc_feature (6)..(6): n is a, c, g, or t
  misc_feature (50)..(50): n is a, c, g, or t
  misc_feature (77)..(77): n is a, c, g, or t
cctctncctaaactgacaatgaattggttatacatcatgcataagctacncttttatattagtttatatttgttatnctaagacttgtgtttcatcaataaagttgtgttttaagcagcaga

SEQ ID NO: 618291 - DNA, 548 bp, Homo sapiens
ggccacacaggcccgcgaccatgggacctgttgtacgaccccgggccagcactgcgagtgcgctcccctggatcctaggggagctgctgggcgctgcactgccagcgaatccgttcacaccgggcgtgcatacctagacacgctgtgtggcctcggccaaacacttggacggcatgtgcctgagcactgactttttgcgcagaacgggttggctagacaacatggaggccttactcggtgcctggagctggcatagagctggctcaagctatctgctcatgttacaagcatactcatttcacaggtgaggcaactgaggctctgcgagtcaggccactagcttatggtaacacctacagaccatcgggagcgaggatctggagagtagctatcagacacatgtcgcgctcacatgtatttgcctgaaccgagcctggtcagagctctttgggctaaacctcataaagacttgtcttaccaagctgacgactgtgcgctagttcttggccaggtcacctccatagcatttgtgctgtgtggggtttgtt

SEQ ID NO: 618292 - DNA, 169 bp, Homo sapiens
ctgcagtggctggtgattccatgggcataagccaccatgcctggccttgtattctttgaagtataaagcgttgagagaagggggaacacaacgctttatacttccgaggaagtcagagaagggggaaggaatcacttttgaccattagctccacgggaaatgggtgtca

SEQ ID NO: 618293 - DNA, 418 bp, Homo sapiens
  misc_feature (81)..(81): n is a, c, g, or t
  misc_feature (116)..(118): n is a, c, g, or t
  misc_feature (142)..(142): n is a, c, g, or t
  misc_feature (149)..(149): n is a, c, g, or t
  misc_feature (161)..(162): n is a, c, g, or t
  misc_feature (166)..(168): n is a, c, g, or t
  misc_feature (170)..(170): n is a, c, g, or t
  misc_feature (175)..(175): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (189)..(189): n is a, c, g, or t
  misc_feature (203)..(203): n is a, c, g, or t
  misc_feature (218)..(218): n is a, c, g, or t
  misc_feature (222)..(222): n is a, c, g, or t
  misc_feature (224)..(224): n is a, c, g, or t
  misc_feature (231)..(232): n is a, c, g, or t
  misc_feature (237)..(238): n is a, c, g, or t
  misc_feature (243)..(243): n is a, c, g, or t
  misc_feature (245)..(245): n is a, c, g, or t
  misc_feature (249)..(249): n is a, c, g, or t
  misc_feature (254)..(254): n is a, c, g, or t
  misc_feature (261)..(261): n is a, c, g, or t
  misc_feature (266)..(266): n is a, c, g, or t
  misc_feature (270)..(270): n is a, c, g, or t
  misc_feature (273)..(273): n is a, c, g, or t
  misc_feature (276)..(278): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (297)..(297): n is a, c, g, or t
  misc_feature (300)..(301): n is a, c, g, or t
  misc_feature (304)..(305): n is a, c, g, or t
  misc_feature (307)..(307): n is a, c, g, or t
  misc_feature (310)..(310): n is a, c, g, or t
  misc_feature (319)..(319): n is a, c, g, or t
  misc_feature (321)..(321): n is a, c, g, or t
  misc_feature (325)..(325): n is a, c, g, or t
  misc_feature (340)..(340): n is a, c, g, or t
  misc_feature (344)..(344): n is a, c, g, or t
  misc_feature (346)..(346): n is a, c, g, or t
  misc_feature (354)..(354): n is a, c, g, or t
  misc_feature (358)..(358): n is a, c, g, or t
  misc_feature (363)..(364): n is a, c, g, or t
  misc_feature (367)..(367): n is a, c, g, or t
  misc_feature (370)..(370): n is a, c, g, or t
  misc_feature (379)..(379): n is a, c, g, or t
  misc_feature (381)..(381): n is a, c, g, or t
  misc_feature (388)..(388): n is a, c, g, or t
  misc_feature (391)..(391): n is a, c, g, or t
  misc_feature (395)..(395): n is a, c, g, or t
  misc_feature (398)..(399): n is a, c, g, or t
  misc_feature (404)..(404): n is a, c, g, or t
  misc_feature (406)..(406): n is a, c, g, or t
  misc_feature (410)..(410): n is a, c, g, or t
actaacgctcttcctagtccccgggccaactcggacagtttgctcatttattgcaacggtcaaggctggcttgtgccagancggcgcgcgcgcgccaccgcacgcacacacacggnnnttaacttttttaaaaatgaaaggntagaagngctcagcggcgnngcgnnngnggcgngnggntcccgntgntgtcccgccgtggnaggtaacccctccgntcgngncgcccgnncccgnnccggngnccgngtggntgggtgnagcgnccgncgncgnnnccgngngntgntgnactgnagnncgnngncgngggtagcgngnccgncgccgtgtcccccgnccgngncccccggnccgncctgnncgntgntctgcgcgngnccggcgnggnccgnggnntgagntnaggnaaccaagg

SEQ ID NO: 618294 - DNA, 610 bp, Homo sapiens
ctagactggacagaccatcctgagagtgaccatgttggatatcacgggctaaatgtttcgttggacggtgctcaggagaccggctgtatctctaagagtgatgcttctgtctactacgagcttatcgctgtatagccaatttggacctgcaccagcggtgccttactgatgcacagacgccgtatcctatactaccttgtttaatgactgtgaataaccctggacagtcagatatttgccaggttaaacactgccgtcatagatagccctgccatttctaccacattgagcgcctgatcagcagcttacacacactgtatgtgcgctctacgtcagattgcatgtacgcagagacatcctcatgcataactctaaggtgctcattcctgaccatctgagcctcattatacttgaaggatgactcacacgaactccccttacacgatctctcggggcattatgctacactgcaattatttgaacgctatagtaaccactgtggggaatccatgcctggatgaccggtcatgctttgaggtcatataccgaggcctatattcaagatcttgccaggcccttctttgcctagcactcgcttgtgccccttctg

SEQ ID NO: 618295 - DNA, 162 bp, Homo sapiens
ataatcagattatcagaagtaagagttaattttgaaagctcaacgctttatacttccgaggaagtcagagaagggggaacacaacgctttatacttccgaggaagtcagagaagggggaaggaatcacttttgaccattagctccacgggaaatgggtgtca

SEQ ID NO: 618296 - DNA, 392 bp, Homo sapiens
tccctggctggcccagactggtcccagcctctgatgagtaatgtagaaatactttgaacgaggcacttccaatgaccagccccacagattgggttaggaagtgttccctctgcttttattttttggacaagattatagagaactggtatcatttcattctttaatatttgacaaaattcattgaaaccatatggagttgatgctttcttttttggaagatcattaactattgattaaatttatttaatagacataagcccattcagattatttaattctctttgtgttggtcattatgaatcagaatcagtcacattcatgtaagttaaaaaatgtgtgagcttggagttgttcatagtatttcttcattattcttaaatgtccttgaggtc

SEQ ID NO: 618297 - DNA, 216 bp, Homo sapiens
  misc_feature (144)..(144): n is a, c, g, or t
  misc_feature (183)..(183): n is a, c, g, or t
tggatcaggaatccgatggtgcagcgctataaggttcgttgttcacgattaaagtctacgtgatctgagtcagaacggagaatccagtcggttcatctacttcaaattcttcctgtacgaaaggacagagaaataaggctactnacaaagcgccttcccggtaaagatatcatctcaacttantattatacccacacccacccaagaacagggttt

SEQ ID NO: 618298 - DNA, 218 bp, Homo sapiens
tgataacgtcgtattctgatcacaccgaaccgggcggtgagcggcaggttttcctggctagacttcacgcaccgcaggcaaggtttcgaggaggaagcggctgggttgtcgaagctgccaccgtaggcatcggtacgctggttggaatgctcagagaaaaagctctggcccaggtagccgtgggcaaagtgcagttcgatccattcaaaagccggcat

SEQ ID NO: 618299 - DNA, 768 bp, Homo sapiens
  misc_feature (251)..(251): n is a, c, g, or t
cggcaaattttagaaagatgcagttctttcctgaccagtttgaagcactctctgaaatgtaaaatcctggcactgtcccaagcagctctttgagaccctgaatggttgcgtgcgagcaggaggaggtgtgggcttagggacagacccagagggcagccgcagaaggagaagggcctgaatttggagtctcagccagtcctggcaagccagggccacaggtagtcttccagcgtcattaggaattctatctntctggccttctgaacctcttcccatgctcttcagacaaggcaggcagagccttgtccaagcccgccgcacggcccagccagaatgggcaagagcttggcctggggctggtggaggcacatggccttttctctagttctttctatgtctgatgtaccaggtgacagcctcctgcccagataataagtgaagtgggaggaagtcagtggatgggggtggaaagcacctggttttcaggagacagcttgccagggaaggccacacccaccccagggcgtccttggcttcaggaagtcctcaacatcagctgctgcttgtcctccatcacttccgtcctagtcacagtccctgctgagggcagtggggtgcttccatcatggagcactttgtcccattttcagtcagattatctcagatgtggctcttcccagctgtccacccagatccaggaggttgaaatagaaagtgcctgagcgccactgcactctagcctgggcgacagagcgagactccgtctca

SEQ ID NO: 618300 - DNA, 821 bp, Homo sapiens
gaagtgacagaagacgtgcggagggagacgcagagacagaggagaggccggcagccacccagtctcgggggagcacttagctccctccgccccggcgtcccaccgctgatccgagggcggctcctgaatgcccatcagcgcaccgatcgcccgggactccccaatggaatgcctatgcatgtgctcccatggaggcatgcaggtaggaggtgagagtcgagctgaaatgcccacggtgacgcccgggggtaaccctctgatgtccgcagtccactgtcgtccatagccgcgacatgtcaccgtaatggtgaccctagtcgactgacgactgaccggccacgggacaacacgagaccctcttattccaccaaaaacactgaatttaccagggtgacaaatcattcaaagcgaccttggcacatgcctgcccgtgcccccccttggaatctcggcctacgcattggccactgcgcatgctacaagcgatggcaaactccccgcaacagcactagaccaagcccgtagccgacacgcacacttgcgcgcgcccaacaacccccggagcacaaaccacttggcccgccgttatacactgggaccaaataaacaacgaagaccgtagcggcgggctggcgtgggccaagcagcacaccccctaaaactaagcggacccgaggcagcgaacgaggacaccaagcccaccacccgggcgcactacccaccaccgtggaaagaccccaaacccgccctccccaaggcacccaccccacacgaccagccacatacgttcgagggcgaacacccacctcgcgccccaaccc

SEQ ID NO: 618301 - DNA, 349 bp, Homo sapiens
  misc_feature (2)..(2): n is a, c, g, or t
anaagtatgacagatgcatatcgcacactacgtgtgatacaccatgaaagctagattaacactctgtagccataaaaaaaaacatggccacacacccatctacagggaagagatggtttgcgggtcaattttcccatttttgtggctgaaattaaatttggccacttcccagtgcatactcatcacgcaaaattagtcaaataaggccgggcgcagtgggtcatgcttataatcccagcgcttggggagactgaggtgggtggaccatttgagcccgggagtccaagaccagcccaggtgaatttctccaaaatccatctttacacacacacacacacacatacgccca

SEQ ID NO: 618302 - DNA, 153 bp, Homo sapiens
aagccctatcatatcaacaatgggtgctacagtcaagaaaggaggtgcctgttcaacacagcaaagaccacagcaacccctgctgtacggacagcatataaattttgcacaaaaatcatgcaaagcttgggactaaaggaagtgaagagtaaa

SEQ ID NO: 618303 - DNA, 1776 bp, Homo sapiens
  misc_feature (339)..(339): n is a, c, g, or t
  misc_feature (454)..(454): n is a, c, g, or t
  misc_feature (456)..(456): n is a, c, g, or t
  misc_feature (831)..(831): n is a, c, g, or t
  misc_feature (995)..(995): n is a, c, g, or t
  misc_feature (1149)..(1149): n is a, c, g, or t
  misc_feature (1302)..(1302): n is a, c, g, or t
taatctccaaaggggttttttattttccttttttggactattttctaagaaaaaggccgggtaagccgggaggtaaaaagagaaccccccggcaagaaagggtaaacaaaggcagagacccctcaagaaatctcccggggcgaggggaggtgtcccctctcccacagatgtgggcccgaagttcaccagggcaaggggctcatcaagctcagagccttaagaggcacttatcacagaggtggacaccccccacaaccctctcacacaatttttctcgcggggataaacagaaccacagagagaatcttccgtcgcggggagaagagagggaaacgcganggagatacaagaagaggagagggggacaccgcgcgagtgaaacacgcggaggataaaccactagagcgggggggccactctctctatagagtgcgccgagtagtgagaagaacananaatctgcgagagacatagcgggtcgccaagagtagagaatatcacgagagctccgcgcgggcctcccccaccccgcgcgagagcgggtgcccagagaagaaaaccgcgccgggggagaccaatatataacacccgcggagagaggaacaacgcgcggggggggggggttagcaacgaggatcaccaccaacaaggggcgcgcgccacctctcttctctcgttctccccacatgtggttggcgccccaagtgggggcgggcggggcggtgcgtggccacccgcgccgccacaacaaagaggtaagaccacacctctcgctccccagcaggggggcgcccccacaaaaaacatccgccaccaccggcgaccgcaagngcgggcggagaccacagcggaggaagaagggccatcccacccccaaaaggcgccccttgttggtcgcccccaatatagtgaaccagccgacaacacagtcgaaataaacaccgccggcgagggtgtaaaatcacagcagacgtgctttcttgtgtccacaccangcagagagagacggggcggacacacaaacccggcgggaggacaacgagtcgcccgcccgggggcaaacagatactaccccgccgcggagagggcgttgcggccggcacacacccaccggcaccacaaaacacccgccaaaaaatacatcttgantgaaaaaaaacaaacacacctctcgtggagcaacaacggggcgcccccagcgaccaacacaagtgcgccccccaagagagggttcaacaacaacgatgtggaaacaggttcccgcggagcgcccgtcgagagggggggcaactccctttcgtncgaccaccacccaagcagagacaacgagccaacaatacgaggaagaagcaagaaacaagacccagaaaaagagacgcacaaagaagggcgcccaccgcatctttatccccacgaaggtagcaacagaaaagtgaggagagaccacgcgagaacaggcggggcaacacacaagcggtccccacgagactcccaaatattaagaaacaggagagcccttcgggtgtatcgggcggcacagagagctactcctcctcttcaggaaggaaagagggccgctccgcccacagcctcccccacccgaggacaacaaacaaccacctcgcgtggcaggcgcgagcgcacctttgacacaacaagtagaagacgaggagaggtacctcccgcgggggaagaaagaaaactcaccccttcggaggaggcgcgacaccataacacacgggagcgggaaggagggcaaccccacacgaaacgcag

SEQ ID NO: 618304 - DNA, 1012 bp, Homo sapiens
ccgtcatctactctaccatcttggcaggcacactcatcacagcgctgagctcgcgactgatttgttagcctgagtaggcctagaaataaacatactagcttatattccagttctaagcgcaaaaaaataaacccttcgttccacagaagctgccgatcaagtatttgcctcacgcaagcaagcggatccataatccttctaatagctatcctcttcaacaatatactcgtccggacgaatgaaccagtaaccgaagtactaccaatcaatagctcatcatgtaataatcatgaaatggctatagcaatagaaactaggaatgaagccccctttcacttctgagtcccagaggttacccaagggcaccccgtctgacatccggcctgcttcttctcacatgacaaaaactagcccccatctcaattcatatatccagatcgtctcccgtcactaagaagcgtaagccttctcctcgactctgctcaatcttgatccatcatagcaggcagttgaggtggattaaaccaaacccagctacgcaaaatcttagcatactcctcaattacccagcataggatgaataataggcaggtctaccgtacaacctaacataagcattcttaatttaactattatattatcctagtacgacggattcctactactcagagttaactgcaggacagaacctagtaatatttcggacctgaagcaaggtaaatgggctggtcgccttttagtttcatgcaactctccttttccctagagggtgggcccggtaaacggggtttttgcccagggggcgcattggaagatcccagaaaaaaatgggtcttttgcccccactaattgggcaataccgcccttacgtatatataatacgaaaatataccctcatagaatccccacttatagaaaaaagaaggtggtaaaaaccaccgctccatcagaaagcacaatcctctttataaaaaaaaagaggggcagggcgagccgagaacagataaagccg

SEQ ID NO: 618305 - DNA, 138 bp, Homo sapiens
gacgatccgggtgagcaagtagcaggctttcggggctgggaaggggcagttgggttccgggggctgaccctaaggccccagcgcagctgcctcccggtgctggtctgtctccccctctctgtttatggtctgggctgt

SEQ ID NO: 618306 - DNA, 527 bp, Homo sapiens
tcgaaccctgacttgtcatctactgctgggctcccagagtgtaggattacaggcatgagcaccgtgctggccctgcgtgtatttctagggcaggatggcctgcccttcttctagtgggaagggcaccagtggcattacttggttgtttgctccggaaagaaccttcaaaggccacagaacgggaccttccccctggtgactcacaggctgtgggcgggcaggggcggcctccactgtgcaagggtccggactctctgactctcattaatgagtgagtacatgttcctgctgagatgctggactggagcccggttgtgggcggcggtgagtgggcaggcagcagtgagtagcagccggggtggggtgagctgtccccaccgtgactcagaaggtatttcttgctgctgacctctgagcttgagtgtcctgagtaatcccagttcccccggaggaagataaaactttaggcagctttgtgtgagtaaaggagtcgtttaaataggaaggaataatagaaaaaaaccaag

SEQ ID NO: 618307 - DNA, 229 bp, Homo sapiens
  misc_feature (15)..(15): n is a, c, g, or t
  misc_feature (22)..(22): n is a, c, g, or t
  misc_feature (78)..(78): n is a, c, g, or t
  misc_feature (123)..(123): n is a, c, g, or t
  misc_feature (154)..(154): n is a, c, g, or t
  misc_feature (159)..(159): n is a, c, g, or t
  misc_feature (223)..(223): n is a, c, g, or t
tgaaaccaataatanttatcanttttcctcacactgttttgcgtatggctcctattgcactcaaaatgtttttgagantcatccatgttgttttgtgtgtcaaaagtttgttcctttagccantccatggaatgaatgtatcacagtttattgntccantcttgtattgatagatatttgaatgtttccagtttttcctattatgaataaaactgctatgaanaaaaaa

SEQ ID NO: 618308 - DNA, 159 bp, Homo sapiens
taggtagtatagcagcttcaacgagaaagttctcttccattacacgcatactggcgtaccagtgcactacatttgttccttacaagaggcatccactatcacacggtgagaggactagcacctagtctcacggatacatcagtggacataccatgctta

SEQ ID NO: 618309 - DNA, 561 bp, Homo sapiens
gacaggtagtgctccctcattttaatctcatccttttaaaaataatcatacccttacttgttagccaggagttcacagtgtatatctgtttgaaaatatgccttcatcttttctacaagggtttagcacatccctataccctcagctagactgtcaaagggctgctggaccaagcctagtcctgaccggggcctggcgctgggcatggcaggccttctgggcaagcaagctgagtaaatggtctttcactagcagtgtcacatgatccttaacctgggactgcctgggctgcaggctggagcctggtctgtttagatttgagtgctctttacattgacagacacacactgagcacttcctcaggcagaatccaatggagggccccagggaaggcagtcagagaaggcttcacagaggaggagatgtctgggctggggaggaagaaagtcactagctattcacagtgggggtggcagggggagcatgggcaagagggcataccgcgcagagaaaatggttactactgatttccctgcctgttacaggcaaagagatacctgg

SEQ ID NO: 618310 - DNA, 143 bp, Homo sapiens
cgatctagaggcatccccttcatcctccaaagcgctgggattacaggtgtgagtcaccttgctcagtctctacctgcatttttgaatctgtgtcttttgtcattacctggctactttttggagactgtccatcattttctagc

SEQ ID NO: 618311 - DNA, 170 bp, Homo sapiens
ctgtagacattcgtacgtcgtgtgtgaagagggtatgcaaagacaagacaggactggagctggggtggaagaggggagggggacactggatgcattcccccgcacccaggaagcacctcatagagccctgagacaccctcgactcaccctgagcccctacagactccatc

SEQ ID NO: 618312 - DNA, 273 bp, Homo sapiens
tacttactcatctgtaactgaaagttctacctttggaccaacatctccctattccctccaccttccagcgcttgacaatcaccattctaccctctgtttttatgagttcaactttcttagattccacatgtaagtgagatcatgtggtatggcttatttcacttagcatgatatcctacaggttcacccatgttgcgcaaatggtaggattttctcctttttatggctgaatagtatttcattgtgtatgcacacacatagttcagcgtctga

SEQ ID NO: 618313 - DNA, 359 bp, Homo sapiens
gatgcagtcgagccagcgcggatcgaccaggctcaccaacatatcgaccggcagccggtccagcagcggcgccatccgatgcgcccacaccgcgcgccgcgcggggcgcagcacctggccgcggcgtcccagccgcagcggcatcgccgccagccaggcggcgccatgggcggtggtgccgcaaccgatctgggcgaaggtgccgagaatgcgcacgcaggcccgcaccgcgcggcacagtgcgcgatggccgccgaacaggcgcaggctggcggtcacgtcgagcgcgacggtggcggggccgagttcctcgtccagcgtgacctgcggcgtgaagcgcagcagggccagcgcggccg

SEQ ID NO: 618314 - DNA, 167 bp, Homo sapiens
aactctcacgaacaggcataggcattcttattctccgaactcgcagcaagctaaatgggtattgtttcaagatctgtagctcctgacttgaaggcgctcagccactcctagaacattgttagagcatctctaactttaccagagactaacaggcctggacatgagag

SEQ ID NO: 618315 - DNA, 640 bp, Homo sapiens
  misc_feature (17)..(17): n is a, c, g, or t
  misc_feature (428)..(428): n is a, c, g, or t
tctttcaggtttttggnccccccccctggttggttaaattgcagtaaagagatgaagccaggtgggaaaagtgtatttgtcaatccttgagtgatgggtatggtagacaagataaagaggctttattgaactcactgaaatcaaatgttaagaaacttaaaattttattgtattataatagttgtcatagaacataaggtatttttcaaattaatcaagctatgttgtgtttttcagcttttatctgactagtatctatgaccattcaatatttgaagcctttaataaggtggtgcagaaactcattccacaactgccgaccttggaaaacctattaaatatctttatatcaaattcaggtattgaaaaagctttctctttgatgtgtcagcaaaatctacattgcaacagacagttccccctgtggnggaattttaaaattttgggcccccaaaaaaactttccccttttttttaaaatttgggaaaacttttgctggtgacatgatcgatgttgtaattgatgtgtcttgtatatatgggtaagttatgtatatattcctgcatatctcagacaggcggaaaactattaacttgattggtcagaagactaattctgaggcccctggcagtggtactac

SEQ ID NO: 618316 - DNA, 908 bp, Homo sapiens
ggaggtcagcagtgccacagaacaaactggcgttaagaacatgtcgttcttcagcatttacaacaccgacaaacctttactgaatcagctgagtgttaataatacgaatttcctttatctcgtgctatccaagatcaaattctgtgggattataaaccatttcagtagaaggcctgcatgactgtcatgacggcaagatcctgaaacaggaacttataaagactgtatgtcgatgtctcatcttgaggaaccaaaagtaacagcaagatgacgaaaccacccacagaaccacgatacacgaggcccacgatgctgggcctgacaggaccctgttcatacaggtgtcactgtcagcacgttcgtctacgagaagctcacaggcacagcaggacgatgctaccgcgcaccaacggtttccagtccctcatggacaaccagaggataccggcacatcggtcacccaagactacccggaagtatcgtgccacgagaatcctcaagagcaccatgaccttgtgcgcatgcctcccccttttcacgaacaaccctacctcgacgtaaccccaggcctagccggtgaggtacttgttgacgacgccctgcttgcaagaatgacgtaaaatccactttctctgcaaacaattaatgcaatagcaccaccaaccaattatttaacaataaccacaaaattgctaacaccgcaaattactacttggataaaacttcctatgcgctaatagagcgttagacaatatataaccataacccccttattcccctctctaacagaggcacgattgaaaccatccaatacattcacactgcaaccgggagcgcccctaattaacagcttaccatgcacagggttagcactcttgtacgaacacgcaacccactttgcgatgacc

SEQ ID NO: 618317 - DNA, 189 bp, Homo sapiens
  misc_feature (93)..(93): n is a, c, g, or t
  misc_feature (109)..(109): n is a, c, g, or t
  misc_feature (121)..(121): n is a, c, g, or t
cagattgtggacttgagtctgactacttgtggtctgacaatttaggaatcacccaaatgatgtccagagttccagaagattctagggtacatnttgaggtgtagtccanggagttgcaacnttcgaaatctcgtgaggtgattccttgtgctattaaagacacatgcatgacagacgcgctcttaccgg

SEQ ID NO: 618318 - DNA, 1604 bp, Homo sapiens
  misc_feature (292)..(292): n is a, c, g, or t
gctgatcccccacgactttggtatgaacgaagcctccgctcctgacacaatgcacgacagtgctgcatggccaagggatgagatagatgcttgacaatcgcttgtctggcactatcgagcgctggtccttacatgatctgcgtcaggaggaggtgtctgattgagtagcagcaaggaatcccattcgagtgtacaactactgtactaagcctccatgatacgtggaccagttcaagtggtgcgtgtggacgagcgagtcattcctgagagacaagcccgtgacagtcgatcnaggtaagatagtgttaagcaacgcacatccatgactaaccactaccactataatgcgttactgtacctatggacatgtcattcgcattactctttctagatgactagcaatgcgtgtacacgggcgatatttgcctaagcgcttaccgaaagcaccatattaacgccagcacttccattacaagccgaaacgcaattttgacctagctaggggcaaccgagcggtacccagaggtgacacgccaaccaaagacttttttcgcccttggcgcgttattccccattaggttcccacaaggcgtggtgccttcttccggcggaaatgtaagaccgcgcgggccaccgttgaaatagttcggactccccgttggaacaatgtgccttcaccatttcgccattctggcggctaataaccacggcgccgaatctccttacctttttcttgaccatggaaaccagctgtgggagtttcgtaccccaaccatggaacgcttgaccccataagacgttaagcgttggccccaagattaaccggatttcttccaacggcggtgaaggaaaccccccgaaaagtaaaagtggccctttctacaaatccaccgttgacactagagacggggcacggtaaacacggttttatggccgcgccctattataggtaaacacacaccgacattggcgttaatatgcacaaacactttgtgacacaagggcgcccaacctgccccttttgccaatcccaagcttaaagttcaagacgctccccacaacaggctattagacacgcgcccaaacacggcgtcgtgccaacaagagccccaaccgacagcctgggttcccaaagaacaggggggctatatcacgagcgcgcccaaacatcagaacgtttaagccgcccccttgtggaatatccccttattccacggcgtttacagccacattttcaacagttcgctagggacagtcggcgctgcgggttacacgaaaacccgggttttggccccctctccttgtgcaggggcaaaccccccgggcggcaccttccgtacgcaaattccctttgtcgcattgcgttgacaaaaggtggaacgcagtacccgtttgtgctttcgctaaccgcattgaacttagcataataacccggcccagggcgtatacgacgtgttgggcgtccacctataaatcagaacacctacatattagtgcccttcaacagggcagcacaacagaactcgccatgcgcagaacggaatatattccttgtggccgtgcggtacaaaccgctggtgtgtcatcaactattcaccaaccct

SEQ ID NO: 618319 - DNA, 1117 bp, Homo sapiens
  misc_feature (173)..(173): n is a, c, g, or t
  misc_feature (353)..(353): n is a, c, g, or t
tctggctaccgggactaaaatggaagcgttttggggggtcggggtccggatcttggggcgggggggtccgggccccaggagacaggtttataccggaattctccggtccacctcccgagatctccttcaggggactccgggcggtctggcacttttatacagagaggtgtccnaattcacgcgcggagaccacaagacaccccattgggtgacacgcgggaactctctcagagtctcctctgacgggcgtgtatagagttctcgagagaggtgcggagagtgtgtggtgaagtgtgcgcggcaagaacagtgtgcgcgtgggaactccctctgagcgggctctctcttgtggnctcctcgtttctccgcggaacaaaactctctctctgcgcacatatatatgtgcgcagaggtttcacacacaacacaggtactcccccgatgtgtgctgtgggtgtgccctctctgtggggcaggaactatacgcgcgcgtgtattctctcacaggtatatctttgtagaaggacagaagtgtttcgcgcgcgccacacaaatgtgggttgaagtgtggacgtgggaggggaagccttctgctgtggggacacacgagtgggccccaccgaggactatatataagtgtccctatagagagccatattctcaactctcgagtgggcgcgtggcacccgaggggggcccagttgtctaacagcgccgggcgccctcgaaaagaaattgtaaaccccttttttgggtggtgacaacaccccatgggggctccactccggggagggggcatactcgcctgagaatgggaaaaaagagggcgtctcccctcgcgggatacattgggtggcgaccattcgctttgggggtgggatacgcctatattagaaaggcgcccctttttcggtgtggggcccaacggggggtctcacggggcggcgcaataactggggggcccccaggcccttctggtctgggcgaaacatgtccctggggacgcaaacgcagcccggtggcaaaagccccaagacctgggggccccgggggatctataggtaaaaaccgcgtgcctttcgacaaggtggcgggcactaacccggagaatgcccgg

SEQ ID NO: 618320 - DNA, 121 bp, Homo sapiens
ttttttttttggggggggccggttttaggttttaggtttttaaaaccgggcctttttaaggggaccccctggccccaaaattggcccccaaattttgggcccccttaaaaaggtttatgga

SEQ ID NO: 618321 - DNA, 744 bp, Homo sapiens
gtaccgaaccccagcagttcgagcctctggaagagcgtctaagcactggggatatatatttactggagaatgggctcaaccctcttcctctgggtgggagcaagcgtccaacagggtgtttgtccagagccttttcagcgtctcctccttacagtcagatcaccagtggtttgagtgttctgccagttctggataatccacctgtccaagaaggttcagaggcctcatagatagcttacgggcacagagatcccaggtacatgaacgacttacgcgtggtgacaaccacggacacgaccacacgactggagactgactgtcacaagcacattcctggatggaaagaccaacgacgtctgacgatgggggacgcaatcttactgtggacctattctctgatcatactgcacacggaagattcgagacaaggacattacgtgacgactaccaagcaacggtgggtcacaccaagtggacatacagggcacccaagaggcatacgactttccagaacaagacacagccccaggactgatcagaagaccaatataggaggaaccaggtacacacatactcctaccaattgatttaaaggccgtgaccaccctccacagatacatccatcattgaagagagcgacgacacggagagaagcacacacaaacggggcacgaaaaacacaaaccagaaaaaggaggaaacaaaaagagacacaagagaaaaggacaagacaagaacacaaac

SEQ ID NO: 618322 - DNA, 189 bp, Homo sapiens
aatggtgattacagtagagagaatcggatgttctctagcatgaaccttcctgaagacaggttggccaaacaggtattttcctgttattgtgaggccaccaagctcattcaataacagggctttcttctcactcatctccaccaggcggggctctccaatctcaaggaagaaggtcttgttttctcatac

SEQ ID NO: 618323 - DNA, 352 bp, Homo sapiens
  misc_feature (10)..(10): n is a, c, g, or t
  misc_feature (325)..(325): n is a, c, g, or t
  misc_feature (338)..(338): n is a, c, g, or t
ggggccagcnactctctccaaagcatagtcatgggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacgaaaaattagtcaggtgtggtggacgcctgtgatctcaatctcagctactcgggaggctgaggcaggagaatcacttgaacccaggaggtgttgcagtgaaccaagatcacaccactgcactccnagcctaggcaacnagagactctgtctc

SEQ ID NO: 618324 - DNA, 134 bp, Homo sapiens
tgttgctgcggtcgctctacgacggctcccaccctcaacgacggtgccactcttggtcgacctcactttccggtctgcacaccaccggggccgggctggcttttccggtctggacgctctcccggtccttccgg

SEQ ID NO: 618325 - DNA, 665 bp, Homo sapiens
tataggtttgagggggaatgctggagattgtaatgggtatggagacttgtcatataagtaatgctagggtgagtggtaggaagtttttccataggaggtgtatgagttggtcgtagcggaatcgggggtatgctgtccgaattccataaaaacagggaggttagaagtagggtccttggtgacaaaattattgttgtgtagagttccaggggagagtgcgtcatatgttgtccctaggaagattgtagtggtagagggtgtttattatcaataatgttggtgtattccggctatgaagaatagggcgaaggggcctgcggcgtatcccgatggttgaacgcctgagactagttcggactccccttcggcaaggtcgaagggggtccggtagggcctctgctagtgtggagataaatcatatttatggcccagggtccctgatgcgcggagtaatccgagggtgtccttgtgtcgtcgatacgggtggagaggttaacaggagcccccttatttagatacatgttcgacttgtcagaatcgatggctagggatgacttcattttgacattgttgtgggcaaactgccccaatggccccaataaggggtaaactagatttgatgtccccccgtatcaaggatgggtaaccgcgagcaaaaggggcaa

SEQ ID NO: 618326 - DNA, 147 bp, Homo sapiens
aggtctctactacacattcccatctgacctcgtttcgttttggttcttttttggttttttggagacagagtttggctctttggtggtgtgtgtgtggagtcagaatctggttatgtcgcccaggctggagtgcagtggcacaacctc

SEQ ID NO: 618327 - DNA, 1473 bp, Homo sapiens
gtaagatggggtccgaccccgactgcagactccccatacacgcgtaaacccagagccttgtcttcagtatgtcagttgagggcagtgcagaccccatgggcctcgaagagatggtgtcctgcgtcccactcctgactggctccccagttagtgctctggctcgtttactgggcaggtagtgagctatgcaaatagacattattgacacagtcacaagtcgcgcacatcctcatgtcagagatgaagcaacctggtctgaactggttgtaatgacctagcttctagtgtgagtgaccatgcgagtctgtcccatacgttacaatatgccagtgcctcccttcacccacagggtactactagagctagttggaacgagactactcccttcagtttcttctgctaaagatgggagactgtgtcatgagcttagcatttggagcgtcccacggtcaccacgacaacaagctcacgagtcctccgggtgtccattatgcttcttggatgaattctgtctgtggggtctccatctacgtccttcctactgggaatggtcattcagactatggaacttggggcgtccccttacaattgtgatttgcggggcattttgggtgtggctctagagctacgcgagcctgggagcgtccacctggattcgtagcctttgtctatcgaggttccaggtccagggtggacacatagctcatggagccgtgagtctgcttcgttcctttcactagagcgcctactgatgaaaccattggtataccccaaagtgaggcccctatcaaggtaagagcagcgacttcccttttggaagggcttttgagttgggagccagggaaactctaccttaacgagttgtgcctcggttttactcgaagattccacggttcgagctagggccacacgcggagtggcccgcggccaatcctcggtgacctttgcgaataccttttgatttattaagagacccgaattcgggacccgtttggcgcacggttccaaaaaataagcaaccccttggttgaacccttggcaaagcatttcgacttgggtcccccaagctgtcccccaattaatacctgccatttgtgcgtgtacaattctccaatggcgctatttccgttggttacatcgttgagaaaacgcccacaaggggttccaccacaacgactgttcgcaatggtgggagcgacacaagccgcttccccaagggggacgaacagattagccccttctccctggggaaaacaaaacagcgcgggggcacgggcggcccgcatgtcgacactacgtcgcactagccgtgacagcgcgggagacgacctttccaaaccacatgtaggcactagtcagtccagactcgactcgtacggcaagtacacaccccagccagcggcggctcctttgatacgaaacaaacacgacgagggtcagcgcggaacagacgctacaacacctcctccaccg

SEQ ID NO: 618328 - DNA, 450 bp, Homo sapiens
gaggtatccccgccacccaggcgcacttctggggcagtgggcttaggcttgttcagacacagcactggatgccgtccgaaagatgctgtggatgctctttctctcgaggtgaatagctgacgcctccctagagtagcatttctggcacccagactgtctttgcgtattgcacaacgcctgtcttaataggatgatgaggcgcctgctttctggttgggacagcctccagtcagagtactcatggtcatgttcgcagagtctggtcttggcagcacaatgagccaaaacgctgggtgcttgggacaataaatctaccgatttcttgtcctctcactatcttgaagtgcgcttgtccatctgtctcctggacaggtctgattgtcaaaacaatagtaatatctgcatccagagtctgctgtagacagatgtgcacggacattcatcgtagta

SEQ ID NO: 618329 - DNA, 307 bp, Homo sapiens
tgtcatttgaaattacaggccccttgtaataaaagtgctgggaaaatccagcactttgggaggccaaggcaggtggatcacttgagctgaggagtttgagaccagcttgggcaacatggtgaaaccctgtctctactaaaaatacaaaaaattatccaggcatggtggtgcatgcctgtagtcccagctactcagagtctgaggtaggagaatcacctgaacccaggaagtcaaggttgcaatgagcagtaatggcagcactgcactccagcctgggtaacaagagtgagaccgtgtctcaaaaaaa

SEQ ID NO: 618330 - DNA, 891 bp, Homo sapiens
  misc_feature (35)..(35): n is a, c, g, or t
atgccgcgtgtataagacacctccttctagaattntcctctcgcggacttctcaaggcgtgtcgcaccaacacaatgggtgttccctaaacacacgagcttttaaaggagcgccccctcatgataatgcgcttggaaatgtgtttaagcccccgttaatattctccttgtgtctgccgcgagtaatgcacagttctaacaacccgcgggggccatcactttcccccttccggaggatttcgcccccccccaccagacagaaaacgtgggtggtaaaccatgctcgccccaccacctggggagcttaacagaatgttcgccgcaatcgttggtgccccacgaccccagctttaacaaaaatttcccctgtcgcaagaaacattccaaatgcgcccccctttcccacaaagtgagtctccaaataaaaccccctcggcgttaataatatttccctccctcgaggacctcttcctacacattccccctcgatacctccgtgcgaatatccacccaaaagcccatctcatatttgcaaaacgacgttcccctttcacgccaatcgccaccacttcattcaacatttttttgggcagaacccagcaacccatggtgtgcaatgtagactatgaattatttcccgggtggttctccacatggcacccattaccctgagtaagttcttcctttcatgttattgaaggcagcccctcctcgtgggagctctgcgattgtgtaaacacacgcctaatgagctgcaaagcagcgagagacaacagaatgttgtttcatgggcaattacgaggccccccacttttttacaagcgatataatcgccacacctctgttaaaaggaggaaaccttaaaaaaaggaatttctcgcccaacataaca

SEQ ID NO: 618331 - DNA, 429 bp, Homo sapiens
tagtagagatggggtttctccacgttggtcaggagtggtgtctttgaacttcccgacctcaggatgattcgcccgcctcggccctcgccaaagcgctgggaataacagaacggctgatgccacgcggagccgtgcgccgaggacataccattatctatgtgacgaaaccagaacatcaacctcacacacagcagtgccccacgagctgagaaccacgagtccgcacccgcagcgacgccccaccccccccctgctacccacgcacggcacacttcataggagcaaccaccgcagacacagcgcggaaccataccacctgaaggactaggcaacaacgccaagcaacacaccaaacggagaacaaccggtgcacgaaacacacccaactacccaccgccaacaaacagcaaccaaaacacaaccaccgcg

SEQ ID NO: 618332 - DNA, 394 bp, Homo sapiens
ctgactcagaggatccccctcacggattactcaactatacacacagattaagagtttaatgcctgcgaaaaataaaactgaagttgcaagacaatctgaattgaaaccatcttcactaatataacttgcaacaaaatcattttggatgaaagattacaatacattattaacttactttttaaacacagagtaacagttactctatggtaaaacattatactcatcccacattggcacaattatttattgcaagtatgttccacaatacacaacttgtacacaagaatcacataggtacaattaactcttgagcacacttctctagccttataaacatctagcgaatcactggattcattactgtagcaatgataatacataatcgatgttctag

SEQ ID NO: 618333 - DNA, 104 bp, Homo sapiens
gtcggccaaagatcgctcaaagaaataaatagaaatggaaacgtatgctaccattcttttcttttttattttctttgagacagaatctgtcctgtgcccaggct

SEQ ID NO: 618334 - DNA, 280 bp, Homo sapiens
tggccggtccccagtatgcccaccctagtgcactcccacctttctttctgcagcagctgaaggaaggaaaggtgggagctggcactcagtgatgggcttaactgggactgtgcggtgcacgagtcgtgtgccttgtcgtggtggcgtctgctgtaacgtggcctggggtgtggcggagtccgtagcatggcctggggcatggcagagttcaaagtgtggtgtggcgtctgtaatgtggcccaaagtggcagagtccgtggcatggactggggcgtggaag

SEQ ID NO: 618335 - DNA, 259 bp, Homo sapiens
acacgaccggtgggacgacgcttcagactggtcctcactactctttggactccactcacgcgacatcaccacggggacgacaaacccactaccagactgtgacggacggtgtgggacacgggctaccactgggtacacgtcacggtcttacacctgtgccccacgacgggtccactaccgggacgacgacgacccttactacatggtacacggactgactcgggccggtacgggactgctcggtgccgggtacccgacg

SEQ ID NO: 618336 - DNA, 392 bp, Homo sapiens
  misc_feature (8)..(8): n is a, c, g, or t
  misc_feature (10)..(10): n is a, c, g, or t
  misc_feature (107)..(107): n is a, c, g, or t
  misc_feature (193)..(193): n is a, c, g, or t
agccacgntngcacacacacacacacacacgcacacacacacacatgcacacacatagagctagtaggaaaacctgggggaaaatctgtctgaatctataggcaccntccatcatccaggctgggcgtggttgctcacactgtaatcctttgggaggcgaatgggcggatcacttaagccccaggatttgagnccagcttaggcaacatgccagaccgtgtctctataaaaaatttaaaattagccagacatggtggctggcatgagcctgtagtcctagctattaggagggctgaggtgggaggattgcttaagccagggaggtcgaggctgcagtgagccacgactgtaccactggagtccagcttgggcgacagggcaatactgtctcc

SEQ ID NO: 618337 - DNA, 343 bp, Homo sapiens
  misc_feature (55)..(55): n is a, c, g, or t
  misc_feature (132)..(132): n is a, c, g, or t
  misc_feature (207)..(207): n is a, c, g, or t
ccaacccggcgcaatagcttcctggcctgggcctggcctggattattgggcgagncctttacgcatatggctactacacaggagaccctagcaagcggtatcgaggaccgtgggctctcttgccctcctttncctgatgggcaccaccgtgtgctctgctttccagcatctcggctggatcagaccaggcttaggctacgggtccanatcctgccaccactgaggtgtggagggccttccgactctcactcacctccagcgactcaccctgatttccagttgcactggttttttttttttttttaatataataaaaacttatctggcatcagcctcataccta

SEQ ID NO: 618338 - DNA, 289 bp, Homo sapiens
gcctccagaaatgggaaagatgaaacaattattacctaatgcatatattgcaaggactaacccctataccttctgctatatgaatttactagaaatactttgcaaggagagccaaagctaagacccccgaaaccagacgagctaccttagaacagctaaaagagcacatcccgtctatttagcaagaatattggtaagattttatacggtagagcgcgacagaacctaccgagtccttgtgatagctggttgtccaacgatagaatcttatgtttaactttgaagtttg

SEQ ID NO: 618339 - DNA, 862 bp, Homo sapiens
atttcacctccgctaccataatcatcgctatccccaccgggtcaaagtatttagctgatcgcacatccaggaagcaatatgaaatgatctgctgcagtgtctgagccctaggatcatctttcttttcaccgtaggtggcctgcatgcatttgtattagcaaactcatcactagacatcgtactacacgacagtactacgtatgtagctcacttccactatgtcctatcaataggagctgtattggccatcataggaggcttcattcagtgatttcccctattctcaggctacaccctagaccaaactacgccaaaatccatttcatatcatatcatcgggtaaatctaaatttcttcccacaacactttctcggcctatccggaatgccccgagggttactcggactacccgatgcatacaccaaatgaaacatcctatcatctgtgaggctcattcatttctctaacagcagtaatataataatttcatgattgagaagccttcgttcgaagcgaaaagtcctaatagtagaagaaccctcaataaactggagtgactatatgggatggccccccaacccttacaaaatcgaaggaagccggataaataaaatctaagacaaaaaaggaggatcgaacccccaaaggtggttcaagcaacccagtggctccatggattttctaacaacacacacacaaaaaaacacttgggggggccggccgaaaattcaaccatcggtgggggcgccaagagatgaactggacaggcaagaaccggcgaaaggggtccaaaacccggccggtgaccggtggttgcacatctccccccccgccgcacaaaccaaagaaccaacaaacgcat

SEQ ID NO: 618340 - DNA, 161 bp, Homo sapiens
tggaccacttactcgattggacgaaataccttgtgaaactatcagattttgagtcagggagcactatagtgaagtgtatgtggatctgaaatggtgtgaaagcaaagtaggtagcaagtacctcaatgaagcagcatggtgtcgcagtataagaagccagg

SEQ ID NO: 618341 - DNA, 587 bp, Homo sapiens
gcctttggcaccatggagtgcgtaacctatattacccttctttgtctctgtagctcggcttattccagggccgcgtttcgacgggatgcacacatgagcgaggttgcccagtggcttagacgagagcgagaaggtccagagccttggagctgacatgccttcgctcagcctcttcagcagtgtacatcaggcgagcatagtgcaatcagtgaatgaagtaactgaatttgtacagtcatgagctgctgatgagtcacctgcaactctatgggaaacctatgatgaaatggatgactgctgtgcataacaagaacatgcgagcaacgcatgcttattgcagcacaaagatgacaacccatagctcccgcgactggcgagaccagaggatgacgttatgtcactgcttttgatgaagcttgaaggacattcctgatgaatacttgactgaaatcgtgagaagacatcctgactttatgccccggaacttcctttctttgctaaaggtataaaggtggctttacagaacgttgccaagctgctgataaagctgccttgctcgtggcacagctcgatgacttcggtttggg

SEQ ID NO: 618342 - DNA, 303 bp, Homo sapiens
gctgactcctacttttccaatttggatgccttttgttttttcctcttgcctgactgcgctgtgggtacttccagtactatgttgaataacagtggtaaaagtgggcatcctcatcttgttccagtccttagaggaaaagctttcaacttttccccattaagtatgctgttagctgtgggtttgtcatagaagacctttattatgttgaggtatgttctttctatgcctagtttgttgaggattttcatcatgaagtgatgctgaattgtattgaatgcagaaatccttgacaaaatacttgca

SEQ ID NO: 618343 - DNA, 356 bp, Homo sapiens
ccctgcaccgtctattgccagactcatcttcctaaacacaaacccagctgtgcccctgcctgagtgcccttcacctgcaggatagcccaagccctcctgtgttcagccctggccttctctctggcagtgggggtctttgctgtggaccctccaccccctggccctgtcccacacctctggagcttgccgttcccagggagcctcactaaagcctctccctctcagccaagagtttgtgtccgtctcaaactcctcaagaaaacaatgtcctggcacatttcacttggcagttactcccgagaccacccctgcccccgccctgacgttctcgttagccacataaacactttattctc

SEQ ID NO: 618344 - DNA, 234 bp, Homo sapiens
  misc_feature (1)..(1): n is a, c, g, or t
ncggagtgcatggctattgacatgcaggtgagatagggtatacaagggtaaaagcgaatactctcacccccagaccccctgttaacacaagtgaagaccgctttgacaccaacctgtccagtattctgtgattggggatacagggaggaggatctgctccccttttttgtagatgagtagccattcatcattagtctgtataacctttctatctttaaataaaaatatttggag

SEQ ID NO: 618345 - DNA, 963 bp, Homo sapiens
cacagtgtcaagcccacagctcttcaaggaggaagatggtccaggctgggagcatccccttagcagcagcctctgatcccattggccaagcaggagggaaccattagcagccatgaggagctggctggctgggcagcctcgtgggacctgcccagccttgctcccagctcacccacaagatgtggacgagctcttgctgctcatttggattttctccttgtacttatctgaacagccatgcggcatccaacgatccacgcaactttgctccctaacaaaatgtggaagggcattcagtccacagcaggcaatgcatctgctggcaacacgagctctgccatacatcacaacacgtcctgcaggcatgtcaccccatgcgcacccagccttcatccatgtccaccattgcacacaaaaggcgcactctcgcgcctagcccaaccctcacaacctcctcttgctacagtccacaaaccagcagcgcacaccaacgccaggcaccagcactcgtgcagttgaacccgagccacacctatccaggcagcgtcgcaacgctgactcggcatgcatgaaccctcaacactctggcatcacacaacgtgacatgctcggccactacccacgataaacgacactgcggagaccgtccccactatacagcagattggcagtagccattccccaagctaatgtacatagtggagcccctacccaagctagactaacaccaaccagcacccctggaccaggacactcgcccatgcttaaccaaccatggattacggcccacaaacccaagtaaggccttcacaacacgcaaccttaggcaagagaccgtcaccaccgttacgtgatacatatgccgccgccctctccaacgcccagctaccacacacatcgaaccacaatcaaggacaacccttacacccacaggcagcccccaatactgagtttccaaacatt

SEQ ID NO: 618346 - DNA, 1917 bp, Homo sapiens
  misc_feature (1250)..(1250): n is a, c, g, or t
aacaccatgaatcacacatgtccaaaccattcttctctcctgtcaacagctggccagccccccaacgatgagatgctcaaggaggagcacgaggtggctgtgctgggggcgccccacaaccctgctcaccccgaacgatccaacgtgatccacatccagcagacgagacctccgctgcacgacacatgtccgtctggtccctgatacaaccacccatcactatcactgaacctccatgcctgcactggcgcatttacactacgccattcagacctagctccgatagaacgcacctgcgcccacccacaacgccctctcaccccataaacagatgcaagaaacagcgcacacatccatcaaggcgatgccacatatacaccaccaccacatgacactcgagcagtcactgtacaactacgacccataggaaagacactaagaacactgactaccaaacgcgcaccaactacacacgcaacgaccagcacatgcaacagaccccacaccagcacccgacgaaccacacaccccctgcgcacaccgcaacgcctcaccaccgcacacacacacaccacgcgaccaccccagacgcgcgcgcctacgcacacacgagactagacagaacagagccgcaaaccacgacacacgagcaacacatccctgcacacccaccgccaagcaaacaccacaaatgagcacaaaccctagactccacccaacacaccacgacacacgaacacccacaagcaaacgtacaagcatgcaaagacaccaattacaactggccgccgacccccccacgcacccaaccaccctccgacgacatccactcgcgcccaccaccgaacaccagcacgactcacgcacaaaccccactctcaccctcctctacacccccaaaaccagagataacaaacaccatacccaccacgacaggaaccaaaaaacacagcaacattcaatcaaaaaccacgatctcaagagtacgcacatccaactgcaccaccaaggtagacacgcacacgcagcaaagcgatacaagcgcacgaacacaaacaactaagaaacacgacgacagacaacaaccaactccaacacagaataatacagcaaacaccaaactaacaccctcttagccaccaaccacacaactacacgagcacacacatacatacagagacgacaccagagagcgagagcagaccacacgacaacacaaagatgaacgtctgagagcatcagatacaaanaagcggacgccgcgccaggcaaacgaccaacaatagtagcatgaagacgagccaacgacgaagatagcagcgcgcgcgacgcaagaaccgaccggcgcgcaccgacgttcacacacaagccacgcatagcaagagagagaatacagacacacatcaataaccgtgagatccacgccgagcgcatacagcccagcggacgacaacacgagaggcacacccaaagagagcagctagagcaaccatatcacatggcatgatcagcgacgatacatccacgatgaagcaagacaacacaaggagcacggacaccaccacgcaccacgcgctcagaaccccagacacgcatctgcacgcacgatccagcgtagcaaccgagcacgcgactacgaggaccagcaacgacgatagcggacgtatacgactacggcacgccgaacaaaggatagatacgaacactcagaagcaaggctgagacgcgaccagagtacgcgatgtccctcaacagaaagatgctacagaactagtaaacgcaaccgatacgtacagacggagcaggcgccgaccaagcgcgacagctacacgccaccagacacgcaccagccgccgccatagcacagggcgaatgataacacgagagctagacacacagacacacccgagcacgcgc

SEQ ID NO: 618347 - DNA, 450 bp, Homo sapiens
aaccaagccacttcctctacactttgcttagaaatctcctgagataaatagccaatttcatttctcacaagttttaccttccataagatactagaacacagccaagttctttgccactttatactaagcaccagctttccttcagtttccagtaacttgttcctcatttctgtataaatcctcaccagaatagccgggcatggtggctcacacctgtaatcccagcactttgggaggctgaggtgggcggattgcctgaggtcaggagttcaagaccagtctggccaacatggtgaaaccccgtctctactaaaaatacaaaaaaattagctgggtgtggtggcgtgtgcctgttaatcccagctactagggagtctgaggcgggagaattgcttgaaccagggaggtggaggttgcagtgagccaagaacgcaccactgcactccagcc

SEQ ID NO: 618348 - DNA, 126 bp, Homo sapiens
gcacaaagcccagtgaggactgaacgaagctacactccctccagttgagcgagtttgcaatggacgggagtgaggtcacgggcagcacgggacaacgttggcgaggggccagcactcccaggggag

SEQ ID NO: 618349 - DNA, 210 bp, Homo sapiens
atattggaatggtgtggattcagagcaggaagtggcgcgaaggccatggtaaaccattcccttacaggagacctccctgtacacacagtgaccgcctgggcgctaaacggaaatggacaatgcagagacaggtagatgtttctaggatacagcaaggggacctatcttcagattgtctagaaagagtgggtttaatgccactacagtcat

SEQ ID NO: 618350 - DNA, 335 bp, Homo sapiens
  misc_feature (189)..(189): n is a, c, g, or t
acacacacacacacacacacacacacacacacacagagctgcagctgcagcactgcctagctggcccccaaacactgtagcgctgaacagaccaaagatggagacactaactgtgatcatcataaccagtgtgcactgaacactcagcacgtgccaggctatgctaagcccttccatgtgaaaaagaantttccacttgattcccacgacaactcaacaaggtaggaactgttaaaagaaaactttagacgaattaagtttaaattaatctagcatcaattgagtttcatttgaaatgaattgagttttatcaagcaaaggattcgaagatgaga

SEQ ID NO: 618351 - DNA, 1382 bp, Homo sapiens
agtctaaggctggaaagaacgggggagccatgtgacattcagtcccggacacttcaggaaacaggacgtggaagatggttaggactaggaggagtcatggctggagcacggtggtacagatccgcagggccgtagtggacaacggaggtgtatcttgtgccagtcgatcggtgcacgagtagaaggaccccaatctagtcctgggcaagtgcttgaagtcccattccactcccacaaggccttcagcgttcccacatggcccttctcgtaaaagacaggagtgtgtagtcgtgtgatactgatggtgcattagtcaggtggacggaaggcatgacagctccatcacgcaatgaaataaagtgggctggtgcaatgcgtggcgatggagtaggtaagaaataggatgacatcttttcatcgtgcggtggtgagtcctgaagaatcttgtcgactgatggtcagtggagggcgattattgggacgcaggtatcgcgaaggtccatcataaggaagacaatgagtggcctagtggtagtgggagtcccataggagatgtgggcaacccagtagggggagtccaagtcacagtagggtgggttgtgatactccgccacgtgggcctagcgcggtcagataccaggtggaacctagttgagtctatgggggggcaccaccaagtggactacgatgtgtggtgttctctctaaaagtttagacaatcgttcgaaacgcactctgccagatgttcgattataagttaaatcctaatgggccacctaatgtggtggcgaaggcatactcgggaggtcaatccggggacgttctttcctaccagtggcccttaaatttggcctccgcgaaaggcccgtcgtactggcggcctgtggagaatgaaaggtctagggtgaaacaggacgcaacaggctaagtgttgccgttcacgacgtgtggaaacagtttaaggcgattacaacacgtgtagcttggttcaaacccctaaagaggcatgtgggtcaggaaaaaagcccggggaccaaactcggggggaagtcgcggagggggcccccccggagtggaaccacattttttgggccggcgcaaggcggaatactggcagagcggcattcgtgacacgcgagggagggcctgcagaggggaccgtgtgtctggtggggaccggcccgcggggttacaccccaacacggagaagcgggcacacttagagacgtggggccccaggggggatacttagggttagacagggcgaacgaaagggggcgccaccatccgacggatgtggcgaacttattggcgcattggaaaccggcctttaggtacttggcgcgcataacaaagcctggcccatcccatggccccccttg

SEQ ID NO: 618352 - DNA, 1121 bp, Homo sapiens
  misc_feature (1121)..(1121): n is a, c, g, or t
gtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactgggaaagaaaccctacaaatgtcaaacaacgtggcaatggcctttaactgggtcctcacaccttgttacatattagacagtttaatactttgagagaaaccctgccaactgtgactactgtggcataccttttaaaccaatcctcaaacctccacttaaatctattagaataatacctggcaaaacattcacaatcctggatcgatggtgccattcatgttgggcaacctcggaactctctcaactgagtcctccgggtgaaaatcctgcaatgttgcaacttcgcagcctctaagggttgccctggaggtgggtcacaaccccacggggagaaaccccgggcacgggtcacaaacggtggcacattcaaatggagcgacccctagtgcaggaaaagcttatcatccaaactggcccacacgcagagggcacagctatcagccgataaaacgagaggcgaacaacatgacaggcgagtgaacaacaccacacgaagcaggcccaacacaggcagagcgaggagccgaccacaatgcaccgccgaacaccgagcatgtccagacn

SEQ ID NO: 618353 - DNA, 196 bp, Homo sapiens
ataaagactcatcctctatcttccaataacctctcctgaagctaagatcatgtacccctgattttcagcctatcctggctcgcttctagtgtaagtacttctagtagataagcccattcattatccccagctactctaacgaccacggttcatccccagagacctacttctatctatcctacttactagccctatt

SEQ ID NO: 618354 - DNA, 154 bp, Homo sapiens
catacatttctactaagtaactactgaaaatatagataagagtgatggaggtaagtatattaaatgataagtgtatctacccagaccaattggctcaaattggtaagcccaatggaccaagattttccctggagacttgttttgatttgtccag

SEQ ID NO: 618355 - DNA, 913 bp, Homo sapiens
ttgcaaatggagacagaagagttgtagaaaaagtagcccttagactttccaagctgtgaaaagtcctaactctttatcgatctgttgtggtcgatcgaggcatcagttagagtaacagggaaaaatttgctaccgaatttaggtagagccacgaatcgttgatcttattaatagtagcagtgttagtttgtcaggatcatagaagtaagtcactttagacatagttatttctgaaataagcggatgcttggtgataggatacatgggttcctgatcttgtctgcacgtgggtatgttgtgattttaacgtaggagagtcgtgagtcggttgcatatcaggttggtgtaatactattctagtatgtaatatgaacaatggttgagaaaatttgatggaagattcagttaacggtaagctaaatgatgaactcattccattagtgttggaccccacgtgaagacgagtagaggcttagtcgagaacatatagtttggtaagggtagattctcgaggcatgatctgtgcttgtggtgatttcgtgacgtgcatgagtagttgggccgattttaagcaattgctggttcttataccaacatacaattggtggaatagcctctgtagtatgcatgtgcgcatagtatgtgccatgtatacacattgtgtatggtagaaagtccgaaattagattggtaagcgcaggtcaaaagggaagtgtggattattgatcgctgtaggacgtgctcataatcttgttacttgaaaggatactacttgacgcgacagattgggcaatccaaggaaaggtgacgtcaatggttaacaattacttaactaaattggtgttagaagaacctagaaaaaattgccaggcattaggagaccgaatgttaaatggggggggaaagggggacg

SEQ ID NO: 618356 - DNA, 214 bp, Homo sapiens
tggattaccagtttattaccaaaaaatacaactcaggaacagccaaatgaggggacatgtaccctcaacccatagggaaggtgtgtggagtttctgttgccctgtgagcataggtcacctctgcactcacgtgtactaacgaatctgacttctgtctctggttgagagcctaccgcatgatatatcatgctatggacatcactactctcgagag

SEQ ID NO: 618357 - DNA, 139 bp, Homo sapiens
tgctgcacagttgctgctggtggcctgctccatttgcctagcctcccttgtgggtgacactaacaacagtcaccctacccaagctgcctccaagggacgcctggttcccctcccattctccatcctttccatgacgatt

SEQ ID NO: 618358 - DNA, 454 bp, Homo sapiens
cacgagggaaaaaccagcattaaagcggcggaggaagatggcggtcctggggtagagtttgcatactttctgactaagctaccctactaattactccagtcaaggtgtcaaactcaactaagtccttcctggcatcagccggatatggcgaacaggaactggatgccaacactgcccttatggaattggtcaaaggcctaagatctggcaaacttggcgaacagtgtgaaacagttgttcgctttcccagactttttcagaagtatccattccctattcttatcaattctgcattcctaaagttacctgatgttttcacagttggaaataatttcctgaggctatgtgttcttaaagttacccaacaaagtgagaaacatttggagaagattctaaatgtggatgaacttgtgaagagaattttttctgttattcatagtaatgatcctgtgga

SEQ ID NO: 618359 - DNA, 318 bp, Homo sapiens
agaaaccattttaatagagtgatcagggaaggcttcattgagaaggtcctgtttaggctgagatgtgaggatgacagggagatcatcagataaagaataaagagagaatattctaaacataggaaatagcatgtgcaaaggtcctgaggcaggaaagtttagtgtcacagtgagaaccatccctatgggaacattccttgattctctcctttccacttgtgccacagaggctaccttttagaaagggaacaggcatttcagtttttctgtatgtgacaaatattttttctcatttctctcttccagaaatggtttaag

SEQ ID NO: 618360 - DNA, 156 bp, Homo sapiens
ggtgtcttcgatttatggcgtactctgcccattcgcctttcctcctcctgtgctctggccgtgccatcctcacacagctgggcaatctggccagcctggtggcgtgccctcggcattcaactttcattttgttccagatggatagccaaaccatgg

SEQ ID NO: 618361 - DNA, 764 bp, Homo sapiens
tggaacatggctgtcgagctggtgttaattggcacggaggcgtcgtcggtgacgctactgctgcgctgtttgcgtgtgcaggcagcggcctggtcgcgaggtgtgtcgcgatgccggagctggcgtgcaaaggtggtggtccaccccctgttgctgctcaggtgtgctggatcatttcaccgatcggccggttgccaagcagaagcgtgttgttggtgtgcttatggggtcatgtgccaaagaaagtacttgatgtatcgaacagttccgcagttccttttgatgaagatgacaaagagcgagttctgtagtggtttctagaccagtgattatttggaagaacatgtatggagactgtttaagaaagtcgaagtggcagtggaaagaatagttgggtggtaccacacaggccctaaactagccacaagaatgacattgccatcaacgaactcatgaacaagatactgtcctaattccgtatcggtcatcattgagtgtgaagccgaaggacctagggtcgtgcctacagcaagcgtacatttcagtggaagaacgtccagtgatgatggcacagcgtccaatctcgaaaatcgattgaaccacgtgaccagtgaaattgcgacgcagaggaagctgaggaagttggcagttgaacacttgttagcgagatatcaatagacacgacggtgggcactctgtcccagcggatcacaaaccaggtccatggtttgaagggactgaactccaagcttcttggatatcag

SEQ ID NO: 618362 - DNA, 208 bp, Homo sapiens
tgcatttaacccaggctatgcaagttgaaaaacaaacaacaaaaaataatatttcttttctttgtttatttttttgagacgaggtttggctcttgttgcccaggttgcagtgcaacagtgagatctcagctcaccacaacctccacctcccagcttcaagcaattctcctgcctcagcctcctgagtagctgggactacaggtgccca

SEQ ID NO: 618363 - DNA, 407 bp, Homo sapiens
  misc_feature (81)..(81): n is a, c, g, or t
  misc_feature (282)..(282): n is a, c, g, or t
  misc_feature (394)..(394): n is a, c, g, or t
  misc_feature (401)..(401): n is a, c, g, or t
aggtgatctagaggatcctgaggtggttgtgggtagctgcatgtcgtcagcaaggagcggagtggagcaggtggttgtggngctgtgctgctcctttccggagaggggctaggtcgagttggagatttcttcttcttggtcttaatcttgtcttcataagggctgctaggctgtttcgtagcagtctccgggctactaggccgttgtgtgctggtagtacctggttcactgaaaggcgcatctccctccccgcgtcgccctgaagcaggggaaggacttcgnccagccaaggcagttgtatgagttttagctgcagcacttcgagacctctgagcccacctccttcaggaagccttccccgattaaggaagccagggtaaggattccttcctanccacaancacctg

SEQ ID NO: 618364 - DNA, 232 bp, Homo sapiens
acgttctcgtgagactaggatgtccacgatgagcgaagtgcgtccaattacacggtagtgctgtgctgatcaccgtcggtggagacgggggctgtgacgcgaggtgcctaggagagcccttcctggaccctgggtagaggcagctccttagtggaaagagccttagactgagtgttaagatagaggctgtcacttcagactccacctgggccactcaaagtctcacggaaag

SEQ ID NO: 618365 - DNA, 118 bp, Homo sapiens
  misc_feature (23)..(23): n is a, c, g, or t
  misc_feature (40)..(40): n is a, c, g, or t
  misc_feature (70)..(71): n is a, c, g, or t
gaaaacccgccacatctaccatnaccctctacatcaccgncccgaccttagctctcaccatcgctctttnnttattgaaccccccctccccataccccaaccccccttggtcaaccct

SEQ ID NO: 618366 - DNA, 281 bp, Homo sapiens
cgtatagctcagagtgggtacagcaaaatcacccagggcatgaaaggcacaccaggcaacggtgaatcatatatggtggtaacgaaaaacggtaaaaactaaaaatgaatttcacgtttttcttctcaatctgggcttattgacgaggaacgacacacgaacaatttaatcctcggctccctagaaaaaaaatagaaacacaacataaatgctatacttaaaacaagtcattttaccattccaagtctccgggattagggatgctgtcgggtaccgagctc

SEQ ID NO: 618367 - DNA, 850 bp, Homo sapiens
gaccagtctgagcaacatggaggaatcccgtctctgctgaaaatacaaaattagccaggcatggtggcacatgcctgtagtcccagctgctcgggaggctgaggcaggagaatcgcttgaacccaggaggcagaggttgtggtgagccgagatcatgccattgctctccagcctgggcaacaagagtgaaactccatctcaaaaaaaaaaaaaaaaaaaatagcccttatgttttaaatgggttcaaagaaaagacttttaatgggatttgaccattgttggttagctgttggagcatttttatatggcgcaactttttaatttcctaattagggtctacacagtcgaccaggctgggagtgcagtgggccacaatcagggctcactggcagcctcagcctccgtgggctcaaggcaaatcctctggcctcgaacctccccaagtagctggggactacgggtgcacaccaagattaccgggctgatttcaatattttgggtaagagacagacgtttggccatgttgctcgggctgatctcaaactctggagctcaagcattctgtctgcctaagcctctcggaagtgctgggattacgggcctgagccaacaaaacctggcaagtaaatttctaaatcttaacctccctggttctatgggcctaagcccgtacttttggaggcttccatgggagctttcgtggggtaactggaaaccacttgggagttgaacctgcaaacttgggagttgaactatatccaacctttctataggtgggtgggcggaaaattcttgtacagcagtggggaaaaaattagcttatagaaaagacataatagatccatatgaa

SEQ ID NO: 618368 - DNA, 102 bp, Homo sapiens
agttctggtccccactcccaactatactccacagaaacgtataggcttagacgaagttctacgctacaacgactgcaagttgggaagtgggggtgactgagg

SEQ ID NO: 618369 - DNA, 87 bp, Homo sapiens
cggtggatttccaggttttgcttgtgcaggtctgacagctgctggtgtttgatcagaacttctttattgggaaactgccttctgcaa

SEQ ID NO: 618370 - DNA, 226 bp, Homo sapiens
ggcgcgggagccgaacccagcctctcccctactcgaacaccgagcctccgtggatccaccgaggtgccgggtctcccagtcaccgtctcgcacgtgcgctcatggctggacccttcatatatagcgtctcgacacttctccggcgagttggcctaggtagatgatgcacacgatgttctagtgatacaccggtgagcgaccgtactcttgcaagtatgcatcaagg

SEQ ID NO: 618371 - DNA, 854 bp, Homo sapiens
  misc_feature (241)..(241): n is a, c, g, or t
ctcccaatctccccaccttgttccctttccctctggatcaccaattttctctgcactatgttaacccctccgccgtttacaacaaaataaccaagtttcctcttccccaaaatgtttcccattaatattgaagctatttacacgctatgaaatccatttaatattcggcccctcctctctcatggtaacccaaacctaggatctccaccagcagatggtactcacccacaaactcctcctntatccctgtgtatgacaaaaagccataccactgtctccctcctaccatataccccggcgagataacaatcgttcatgagaaaacaccccccgaaatatttttttaattatattgttacaataaaatattattctacattcacatgttactcaacagcaggcgttatctcagcatttacgaccacacaaatgggaagaaaccatcccggcgcactactattccactgtgtcaattctccatcaccccccacccccacctcaggttcaaaaagaatgtatactctaaccccccaatcccccctcctcgaataaccgtcatcgagtgtattacctacacacgtacgcccaacacctctccattgtttcaatagggcacatccgacccacaggccctgctctcgtattacctcgggccttctactccacccaccctttactcaatcccccttgtaccccccgtgtcctgtctaatattagattaaaaagggaaggacacccactttacggaccacccagttattctcacaatcctctacatacaccctagatgcctcccccaccctgccaccccctttgaaaatttaagggccccataaaaacccccccacataaca

SEQ ID NO: 618372 - DNA, 250 bp, Homo sapiens
  misc_feature (207)..(207): n is a, c, g, or t
taccctgaaggtctcaacagttactccctggcaggtcttaggctacatgagtccttggggcacacatggagtaggagttctaggactgtcccagtacatctcacaccacagccttttttggcttgattcgagcctcaccctaggccttttggcttcccctgcctgagagagacctgaggaggggacagagctggagacgaagatggnggtgacggaggttgtggagaggtgtgtatgggtgatgatttgc

SEQ ID NO: 618373 - DNA, 1303 bp, Homo sapiens
tttcgttgcgctgacgggccacatctgtgctctagcgtggctcccgcgtgttgttgccgtcgggtttattttctccggatctgtgtcgtgtcgctgtgtgggccgcttgtccactgtttctccgaaacagggtggcccgtcggggtatcccgggttattttgtgcacaactgtcgctcgcaactagttgagatgtgtcgggtgtgccgggccacgtgtcttttcctccccatgaggattcatccctttagggggggggtcaccgttggtctcgcgccgcccctctacgtctgcttctggggggttccccgcggtagtttttctccctttcccgtgggtcaccttggtgggtgtggggcctcttcgctttttttttgaaggtggggcgccacatcgcgcgtgtctccctttctttttcaccgggggttcacctccgctttgtgtgggggatactttatcaacctcgtcgtttattttctgccctatttttttttgggagcgtccccccctctcctgggggggacaccctgggtccccgagagctcctcgttgtccgccacgagaggagtgtgttttaaaaaggaatatccactgtgtttcctccctcatttgttccctggtcgctagagagcgcccctcttgttttgctcctcccccctcccccccccgccttgtatttatcccgcgggggcgccgcgcaacgtctttctctctcacacaacggtttgtccacgctttatagagggctctcaatatctggagttttctcccccccgaggagggtccccctgtgagacaactcccctgttttttctctccgcatctttggggggcgccgggttgcccccacactttctgtgcccttatttctccatcatattttctcctctaaagagagaggtttccggtctccacacaaggagggccacccctcttcgtgtttttttgagatagcccttttttcttggctgcggcaccctctttcgcgcgctgggtgtggacacccgcgcgctttttatagcccccgcgcccgcgcgggcccccccacgcggccccgcgcgctcgtgaggggagatgatccccaccccctctcccgcggccgcgccccccctctacacttttttcctccgtaattctttggcccatacctgccctggggccactcgttttcctctcgcccctctgttgtccctccgtggcccggtcccccacacaccccccccctctgtggcctgttctacaccccacccccttggcctctttttttggggggttacccaagttttttctacccccttctctca

SEQ ID NO: 618374 - DNA, 120 bp, Homo sapiens
  misc_feature (100)..(100): n is a, c, g, or t
  misc_feature (107)..(107): n is a, c, g, or t
tcggagagaacgggagataaggaaaatcagttagtaggtaatcttcaggtcagattgaatatattgagctttgatgtgtctgtgaaacatccaagttatncaatganaaataggtgagtc

SEQ ID NO: 618375 - DNA, 147 bp, Homo sapiens
cagaagataaaagacaagctaggaacacaaagctcgggcaaaatgtacaaacttagaagaaaattggacgatgaaacaagatagaaaatgaaaatattgtcacgacgtttcagactagaaacatgaaagcacaagctaaagcacaag

SEQ ID NO: 618376 - DNA, 210 bp, Homo sapiens
  misc_feature (18)..(19): n is a, c, g, or t
  misc_feature (49)..(49): n is a, c, g, or t
  misc_feature (64)..(64): n is a, c, g, or t
  misc_feature (70)..(70): n is a, c, g, or t
  misc_feature (85)..(85): n is a, c, g, or t
  misc_feature (94)..(94): n is a, c, g, or t
  misc_feature (100)..(100): n is a, c, g, or t
  misc_feature (106)..(106): n is a, c, g, or t
  misc_feature (115)..(115): n is a, c, g, or t
  misc_feature (117)..(118): n is a, c, g, or t
  misc_feature (133)..(133): n is a, c, g, or t
  misc_feature (143)..(143): n is a, c, g, or t
  misc_feature (161)..(161): n is a, c, g, or t
  misc_feature (177)..(177): n is a, c, g, or t
  misc_feature (180)..(180): n is a, c, g, or t
  misc_feature (197)..(197): n is a, c, g, or t
  misc_feature (199)..(199): n is a, c, g, or t
  misc_feature (206)..(206): n is a, c, g, or t
agatgatccagcttctcnngagccacaggatcaagacacccgtggaccnggtttctgcagaccnggaagnggtagctcagaaatncggcttgcnttacanggcccnggttgcccncnncgcgggtgctgctgngctcagttcncggctttccccgtgaacngcgctgatctctacgnggnactgaagacccccactncnatcctgnccac

SEQ ID NO: 618377 - DNA, 731 bp, Homo sapiens
  misc_feature (20)..(20): n is a, c, g, or t
  misc_feature (37)..(38): n is a, c, g, or t
  misc_feature (44)..(44): n is a, c, g, or t
  misc_feature (50)..(50): n is a, c, g, or t
  misc_feature (79)..(79): n is a, c, g, or t
  misc_feature (81)..(81): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (123)..(123): n is a, c, g, or t
  misc_feature (132)..(132): n is a, c, g, or t
  misc_feature (134)..(134): n is a, c, g, or t
  misc_feature (235)..(235): n is a, c, g, or t
  misc_feature (259)..(259): n is a, c, g, or t
  misc_feature (271)..(271): n is a, c, g, or t
  misc_feature (280)..(280): n is a, c, g, or t
  misc_feature (389)..(389): n is a, c, g, or t
  misc_feature (472)..(472): n is a, c, g, or t
  misc_feature (612)..(613): n is a, c, g, or t
  misc_feature (627)..(627): n is a, c, g, or t
  misc_feature (649)..(649): n is a, c, g, or t
  misc_feature (724)..(724): n is a, c, g, or t
tagtaatccaaatttggggnagggcaaactttaaaanngcagcnaagtgnagaagggttggggaagggagaggtgagtnancaggcacattggaactgtggggacatgtnactnancactgtnaaaccagtntnagtttcttggtttctcatggaaaacattttatacacctatttttcttccttccaacttaagttcatcagttttcaaatacgtttgttccattttttgtctnatttttgttgggatattacaacanagttttgcattnactccagtncctgctccatgtgaaaaaattagatgatttcaaatactttcttcagctccacaataagctgccagttactcttctgcatttcatctcttaaccagtttttgagttcatnaatggactgccggctgatcttactaacaagaatatctgtggcttcaaaatgtcttccaaacattttgggtgagtgagcagggntaggttctatttttacacaaacttcttgttctttttttgcaacatccacttgtttatggtttatttcaatacttgttactattccgatgtgaacaaaatttttgcttgggacagagatgggtgttccctgtttcacctgnnctgctttcgccgtnacccccatcactataggatctngagaataaaaaatgtactgagggaggatttttatcttgcagggaaatactgctatgtgcttaaattcttcttgtntctgtat

SEQ ID NO: 618378 - DNA, 244 bp, Homo sapiens
gatgctgagtagtatcgatggatatggatgtactatagtttgcttcaacctcattcaccctactaaaggacataagcagtgttttcagattttaagccctaataacagctgctgtgaacattcatgtacaggttttcatgtgaacatacattttcattttctgggatacaatgctcaaaagggcaactgtagggttgtatggtaacaccacatatatttttgtacagcaaactcaccctactct

SEQ ID NO: 618379 - DNA, 177 bp, Homo sapiens
tgtcgggtattttagaatcttcgtaccagagaatgtagaactccttcagccccagctggccactcccgtcggaatctagcatgtcaaccataaatttggcatgtctcgatgctgaagccatctgacttgatatctgggcgcttggctagaccccttctcagggcagcgtaccacaag

SEQ ID NO: 618380 - DNA, 1006 bp, Homo sapiens
  misc_feature (47)..(47): n is a, c, g, or t
  misc_feature (114)..(114): n is a, c, g, or t
  misc_feature (116)..(116): n is a, c, g, or t
  misc_feature (160)..(160): n is a, c, g, or t
  misc_feature (167)..(167): n is a, c, g, or t
  misc_feature (175)..(175): n is a, c, g, or t
  misc_feature (184)..(184): n is a, c, g, or t
  misc_feature (186)..(186): n is a, c, g, or t
  misc_feature (189)..(190): n is a, c, g, or t
  misc_feature (214)..(214): n is a, c, g, or t
  misc_feature (217)..(217): n is a, c, g, or t
  misc_feature (229)..(229): n is a, c, g, or t
  misc_feature (236)..(236): n is a, c, g, or t
  misc_feature (239)..(239): n is a, c, g, or t
  misc_feature (241)..(241): n is a, c, g, or t
  misc_feature (243)..(243): n is a, c, g, or t
  misc_feature (252)..(252): n is a, c, g, or t
  misc_feature (264)..(264): n is a, c, g, or t
  misc_feature (277)..(278): n is a, c, g, or t
  misc_feature (291)..(291): n is a, c, g, or t
  misc_feature (300)..(300): n is a, c, g, or t
  misc_feature (311)..(311): n is a, c, g, or t
  misc_feature (313)..(313): n is a, c, g, or t
  misc_feature (322)..(322): n is a, c, g, or t
  misc_feature (334)..(334): n is a, c, g, or t
  misc_feature (377)..(377): n is a, c, g, or t
  misc_feature (401)..(401): n is a, c, g, or t
  misc_feature (424)..(424): n is a, c, g, or t
  misc_feature (442)..(442): n is a, c, g, or t
  misc_feature (449)..(449): n is a, c, g, or t
  misc_feature (488)..(488): n is a, c, g, or t
  misc_feature (511)..(511): n is a, c, g, or t
  misc_feature (594)..(594): n is a, c, g, or t
  misc_feature (609)..(609): n is a, c, g, or t
  misc_feature (612)..(612): n is a, c, g, or t
  misc_feature (661)..(661): n is a, c, g, or t
  misc_feature (774)..(774): n is a, c, g, or t
  misc_feature (776)..(776): n is a, c, g, or t
  misc_feature (810)..(810): n is a, c, g, or t
  misc_feature (863)..(863): n is a, c, g, or t
  misc_feature (885)..(885): n is a, c, g, or t
  misc_feature (932)..(932): n is a, c, g, or t
  misc_feature (935)..(935): n is a, c, g, or t
  misc_feature (1004)..(1004): n is a, c, g, or t
gaaggaaagaggtgagtgttcactatagaggttttatcagcaaaggntgccttcatattgataaaaataccttatctaatttgtaatcataaacattattccagtagaagaggnanattttctctcctttttgtcttcttgcctgtttaatcaccataanaagtaanaatgaaanagctctaananaannaaaggagaaaagaaagaaaaaaanaanatgcaaaagccnagaaaanacnancnagcactgcngcatccagaacngtatactggctcnntccacccagcacngcggcactnggatcgatgtntnctggctctntcctcgccccantccaataaatttagcccccaaccccatcctactttgtgagggnggaggggcaccaaaagaaggggcnggtgcagaagagaaaaaataaanggtcagtgcaagtagaanagaaagnaccaaaaggtggagagggctgcgcttctcttttaatcancaaaagagggtaaactaaaactnaagagtgtacttaaatgactgaaccctgaacaaggctttggccctgcaaactgctgcggtacaaaacgtgaaaggattatgcngaatccatttttgangtntctttttagtggtctgctcattagtggtcttctcttcaaatgggttgtnttctcactaggaaaaaaaatgtaccatctctggaatcaacgttgatggtgtgttgctcattctgaaagtttttatcctcccttctcaagcatgctctgtttggcatgattgananagtgcatatactgggtggccagagcggagatttngagggtatggtgggtgttctcacggtaacactgaagaattttggcctgcagancagcacagactggatgagattnatatagcttgaactttgcttccacctctccagcagcctcctgacatngtncagtggtgactttgtagaactctgagcccttctcctccagtctagccagccgtcctttgtagaatgcantc

SEQ ID NO: 618381 - DNA, 238 bp, Homo sapiens
tcgctttttccataagtattttaaccctgggggctacaaacaaacctgaaagtagatgctgaagagaggtagcgttacgtttcagaaaatcctcattaaaactttccaaatcctttttgacaaatattttctgcatttcttgagatagaactttgctcacaatgtctggaagattactatgattagacactattaaaacaaaaacatttggattttttgtttttgatctgtcctttga

SEQ ID NO: 618382 - DNA, 349 bp, Homo sapiens
tggaacttgatgcctgtccccgactctagaggaaaaccggcttatcgatgccatcacgcccagctaattttgattttttttttgaagcgactctggcccaggttgtttttgaacccctgccctcaagggatcctcctgcctcagcctttaaaagggctaggattacaggtatgagcaacatcccttggcctcaatcacctttcacctaagggtaagggcactatgtacccccaactatgtaacctgagcactgtcttctttgttcagtaccacattctctttggttttttcctttcctggttgagcctgattctaattttctctgagaggaattttcagagaggaaaga

SEQ ID NO: 618383 - DNA, 297 bp, Homo sapiens
aggatttcgcttcccctccaaaacgctgggggttttggctgctcccttacttcccaaaggctcctgctgacttcggaggggcggatgcaaagcccagggccccccccggaaaatgtgtacccctggtttttactccctcgggcggggcccgagcccagggaccagtgacttggcctggccctcccggtttccctccagcatctccccaggcaaggcttgtgggccccggagcttgaaaaagggcgggagtgggaaggctaaaaatttgcttagtaaatggtttgaactttttcccca

SEQ ID NO: 618384 - DNA, 553 bp, Homo sapiens
  misc_feature (79)..(79): n is a, c, g, or t
  misc_feature (144)..(144): n is a, c, g, or t
  misc_feature (186)..(186): n is a, c, g, or t
  misc_feature (371)..(371): n is a, c, g, or t
ggggccaagggtttttgtccttggttaaatgggattcggctttccggggtttttctcggcaaacccttgtttggggttntgtgggtttgggtgggaaaagggccttttgcttaaatgtaacctgatagttttccaaaggccctnggggcctggtttgtgtgagggtgtggaaagtgggggcccccntgggcctgtttgggttgccaaaatgtcccggggggttgggggggggtttaagccggccccccccccttgtttaaaaaagggcccttttgccctttttaaaaaaaaaggggggggggggtcttgggcctttggttttttggtaaaggggggcatcccaaagggttttttgggggtggattgaaaantggggggtgggggttgaaaaattttttggggcccctttgggcccccccgtttttgtcccttttggggtgccgggggacagcaagcaaagcccgcgggacatgaggggggttttaaaggggttttgggttttttgttttgccctaaagtttttgggttttaccaaaaaaattttgttggccca

SEQ ID NO: 618385 - DNA, 412 bp, Homo sapiens
  misc_feature (3)..(3): n is a, c, g, or t
  misc_feature (156)..(156): n is a, c, g, or t
  misc_feature (161)..(161): n is a, c, g, or t
  misc_feature (185)..(186): n is a, c, g, or t
  misc_feature (188)..(188): n is a, c, g, or t
  misc_feature (195)..(195): n is a, c, g, or t
  misc_feature (199)..(199): n is a, c, g, or t
  misc_feature (229)..(229): n is a, c, g, or t
  misc_feature (300)..(300): n is a, c, g, or t
gtnagaaaagcgggtgccacaaactatggtttaatagtatgcaggccctgtacctgtttatctaactatacctgaaatttgctgataccccaagccagctacttacactaaaggcatctctggggggcatcatctagatgaagtcttttaatctgntgggnaattatctggtttttgtttcagtnnanataggangtgnggcttatgcttttgttcagctgactggtgnatgggaaggattaaagcccatattcttaacttacagcagtgtcttcaagcttattatcctgtcatgatgtncataaagtatgacaaactcattcatttgggagctataaggtcaaaagtggccagaatgcaactgcgctgtttacactgtgcaaaatcaagtcaactgtcttgtaggtccttg

SEQ ID NO: 618386 - DNA, 725 bp, Homo sapiens
ggacgctcgcagctgactttgtcttctccgcacgagtgttacagaggtctccatgagccttctctctcctgtgcaaagatggcgactcttaaggaaaaactcattgcaccagttagcggaagaagaggcaacagttccaaacacatcaaggatcagctgtagttggggtgttgggacaagttggtatggcgtgtgctatcagcattctgggaaacgtctctggctgatgaaacttgctcttgttcggatgttctttggcaacgactacagtcttacgaggagcaatagtgatgtgatctgcagcgatggtgcagcttatcttcgttcatgactactctaagaagttagtgtgtcatgcactgaagtatatagtatctcgtagacactgtcatacgttctagagcgaattttggcttcaggttagggctaacctgccagggcagttccgatctagcgaatgcagagggtgatgacgtcgagctcaaagtactggagtgacagtatgaaccgtgtctacagtggtcctgtgcgaagtattcagtttgacttcccatcaggatgcgtgcgaagctagcagatcctgatttgcactcgatatatctgtggtattccacacccatgtggaacattcgttgacggtagtagttaaccgttggagaacttaagatgcgatttacgccaagacaaccgtgtcgcatggcgaacgtgggactgtacacgtctgg

SEQ ID NO: 618387 - DNA, 596 bp, Homo sapiens
  misc_feature (29)..(29): n is a, c, g, or t
  misc_feature (70)..(70): n is a, c, g, or t
  misc_feature (117)..(117): n is a, c, g, or t
  misc_feature (247)..(247): n is a, c, g, or t
  misc_feature (292)..(292): n is a, c, g, or t
  misc_feature (327)..(327): n is a, c, g, or t
  misc_feature (332)..(332): n is a, c, g, or t
  misc_feature (367)..(367): n is a, c, g, or t
  misc_feature (397)..(397): n is a, c, g, or t
  misc_feature (399)..(399): n is a, c, g, or t
  misc_feature (431)..(431): n is a, c, g, or t
  misc_feature (449)..(449): n is a, c, g, or t
  misc_feature (476)..(476): n is a, c, g, or t
  misc_feature (481)..(481): n is a, c, g, or t
  misc_feature (483)..(483): n is a, c, g, or t
  misc_feature (568)..(568): n is a, c, g, or t
ctcgtgccgaattcggcacgagtatatanaaaagtttcatttattcgaattaaattatggtatgagtttnatatacaaataaattctgtgtaaataatacaaaatgctacaaatttnaatcttgtaaaaatgcaaaaatacttgtaatactatacatatataattcctttcacatgaccaacatgtacagtagttgacacgatgcacacgcgcttccccccacagctgaagctgctgagacagcatnaagccttcgcttctgtgacgtcagcgctccttccgcggctgcctnacggttagccagcaaggccttccccttacaccccnagctnaagatgcttcagattatgagccatcatcaggaggnaaagctacctattctctggctagttagaangnactgtcatggggaaactgggtccttctacagncttaacaccagcctgctnaactgagaacacgcctctaccgtgganaagcncnggtacatactggctaactcggtttcattctgcaccgcttcatcgctagcccccaaagagtcatgcttgagactgccctttgagtnctatagtggtggggatgcttcgctggcc

SEQ ID NO: 618388 - DNA, 583 bp, Homo sapiens
  misc_feature (299)..(299): n is a, c, g, or t
tggtttgggaaaaaatccgggggcacccaggaaggattggaaaaaaaatccttttctctacagcaatttaatgtgaggaagctcctccaatcctcgggctatttaagggttcaaaatcaagtgcctagggaaatatcccaagggatgattttctggggagctatctggtctacctggaggttcctgaacaatgatatccccattaatggagcagtcttcagtataaaaaccactggtctggtcacctcatttggcatactggtctccggggaatgttccagttcacacccggtactgtntatttatagaaacacactttatcccattaaagcataacctaattcttccaactatttaatggaataatctatggtccatatttgggtctggccatatgttttcggtacaactagggctggatactacggtcagggttgggggtctggggtcacaaggtgtataatactccctggagagttctataacctggcattcggacagaatcccctttatggtacctataaagatttggcccaaacggtccctgtcacagaaatctgactcctgcgcaactcgccattgg

SEQ ID NO: 618389 - DNA, 585 bp, Homo sapiens
taaaaggttaaaatagattttatggttacaaggggggaccccaccaagcagggtcagtgacccccaaggaggtcaccagggagacttcaaaaggtcatgatggcagaagaggtgacgggaatggaattgacatgatccaggggaggccggccacaaagtgcagtaacattgaccaggagtgggccggtggggctggctcaggtcacagctgtgagggacagaacggaccccttcactcgtggccctccgtgataggtctccaggtgtgacaggatccagcccgctggcaggaggaaggtcacgaagcaggaggtaagcccaagggccaattccatgatcccaagtttcccctcgggggggcaacgaagggatctgggccgcgcggcactggggagccgccgggccgagcctggtcaagccccgaagacagcagcggcgtacaggacggacatgatgggcccggaggcacgcggacatcggtcaccaccattactcacaagactcttcgaggggccaggtcagggctcatcttctaccggaacacggggtgaaggctggggaccccaagacggccgggagatccct

SEQ ID NO: 618390 - DNA, 1007 bp, Homo sapiens
gccctcatgtgccccagttttggatgagagactcggggaggtgctgtcctgaggctgctgtgcgggggcggtgtgtggcctcagggtcccttcccctatctgcagtggtcgtgattgcttcttgtctgtatcagggttcaggcagccgtgggaattgtaggttgctacgagaatctggtatctagtcgcagtgcgcctcgtgatgcgacgaggacccgggttgggactccccagtctcgcatatccagtagggcacagagaaagctggggttctaggaagatggcccttccctaggtctttatgtgttcccctcccactcataatgactgactggaacaatcgattgcattgcatgagtggccattgctcggattgatgcatgcgcagccaagtcatggtggtagaagagtccggtcgaggaagcggcaaggcacttgtaggcactgtggcgtggggaattatggggtgtatttgacctgcactttgctcattctgctgggctacgcaggaggtaatttgggcactgttttggaatgagaatcaatctgttatgtttgctagagggtgtaaatttctcattatgaatagggtggaactctgaagttgggaggaataatatacgagtgtctgactggtaattgctggagatgacaatgattagctaggttaagaaggattacctaaggagggtaggggaagcatattgatgatgccccctcagaggtgggtcctccctgcaaggccagcgaatatgcgggggcgaggcctagcgcaccgaaccacgctcgcggcaagcggtggggtgacactgccgcggttcccttcgcgccctgggcgcgagggattaagcggagggccacagggcctggtggtctcaactaccgcgggaagggaaccacgggcggtcgggccggggcacggcgtgcacaaggagccccaggcgcccagggcgggctaggcgagcccaaagcgtagacgcgcccgggggccacacaccgcgggcaag

SEQ ID NO: 618391 - DNA, 1274 bp, Homo sapiens
agcgggcggtcggatcacaatggtcggcggcggaggaggcccagaagaccggagcgcggacgacctcatccagcggcctacgtcccatggccttttcgtgccatcggggtgtatcgagtggaaccagtaggtcattcagtcaacgaggatggttactcagtgcctcctgctgcatccccctgtcatgtagcgcggccccagcactcgcgtgctggcaggttgctcgtccattccattctctcacttcccatcgtcgctcatcctctttttcagctcgcagttctcggcagtccatatcgccattgctcgcggcaacttggacagtttcactctgacggtggcactggcacgagttggggcatttgcaagcaacatggggctgtataaggctaggactgtgccacctctctctggtcggcacctcccttccactcggccgggccccgcctggcgtagtctggggcgcgcaaggaggggcgttcggtgacctttgacctcgagtcaccccgcgatattaggaaggcacttgacacatattgcgatttctaaaggaggcttcaacccggaggtagaaaagggaaaccttcgccaccgatacaacggtaaggaagacactcgcatcggggcaatgcgtatcaaggacagggagattgagttcgcctcggaagagtaatatccaaaggccaattcgtaagagtcttttggcaaccgacggcgctcttttaacaaggtggcgacaaccgcaccggaactcttcttggcgtcacagcaacgttggcccccttgttggcagtagaaattgccgaccccaaaacaataccgcggcagatgttgccaacggtcatggtaagctagtggtgccctcggtgatattgtagggcaaaccgcgggctcacgtgtgccatatatatggagagtctgcattgtagaacaccacggtgaattttccaccctgtgaattgaaaccccctttttggctacatgggctccggaagagcacttatttgggagcggccggatattactccggaagagtggagacatcttggggcgatggtaccttgggtggacagcctgtaggggtttttatccgagagacaccctatagtgaggggtatacggttatatgccggacattgagcacagttatccgcgcaataggcactaaacatactctgcggacgacacaggaccttgacgcaactgtggggacctccatatgggtccccacaaagacggaactatatgggtgcccctaaaagaggtgcgcagaa

SEQ ID NO: 618392 - DNA, 327 bp, Homo sapiens
agcagatacagcaggctctcaggcacttgagtggctgccgttctacaacggcgcgactggtgctttgggagggcgtccaccccgcattcatgtcaggagtgagtcgcacgtggctttgtggtcatggcgacttaatccgcctggacggtggctccgtctccctgcgcttagacgaccttggcacttctggagataagcccatggctcccaggttgcgcacatgtgacgtttccttgagagaggttctggctctgcgttttgtctaggagtgtcacaggatggacactgcctcctggcaggggctgcccaatgcagatagcctcctgc

SEQ ID NO: 618393 - DNA, 191 bp, Homo sapiens
accgtactatgtaggcaaaatagtgggacgataatataggtagaggcgacaaacataacgagactggtgatcgctggttagtaccaagatagactcttagctcaacgttaaaatttagcccagagtaaacgctccaaactccccattgataaatttacactgtaagatccaaagtatgcaccgctactttg

SEQ ID NO: 618394 - DNA, 592 bp, Homo sapiens
  misc_feature (592)..(592): n is a, c, g, or t
agggtggcaagatggtgttggaaagcactatggtgtgtgtggacaacagagagtatatgcggaatggagacattttacccaccaagctgcaagcccagaaagatgctgtcaacataggttggcattcaaagagccccagcaaccctgagaacaacgtgggccttatcacactggctaatgactgtgaagtgctgaccacacttaccccagacactggccgcattctgtgcaagctacatactgtgcaacccaagggcaagatcaccttctggacgggcattcgcgtgggccatatggctctgaagcaccgacaaggcaagaatcacaagatgcgcataaatggctttgtgggaagcccaatggaggacacatgagaaggatctgtggaaactggctaaacgcctcaagaaggagaaagtgaatgttgacattatcaatattggggaagaggaggtgaacacagatatggtgacagtgccttctgggcccagatttggtgatgctctcataagagtttcgaatatgggtggtgaaggtggtgccatgctgggtcttggtccagggattttaatttggagtgtccgctgcctcn

SEQ ID NO: 618395 - DNA, 1069 bp, Homo sapiens
gctttccatagtggagcctgggctactctgaaatagaagcacctctccttcctttggacccctggagcactgtgttctacagttcttagctacttatttctgtgtgcattatttgtatgtcattatccttggtggtcaaccacttcaaggtgagagactggggtggtggttcctttaaacttattttctaatctcaccctggcccatctttctctttcccacttcctatgttgactgacaaaatcttcgtattatcccagagtaccagagttatttctgtgagaggctaggtcagatgtttcataccccaagcagaggctcaagaagtacctgatgcagtcatataattttcagaatgtgtgtagatagaactaccagcggatagcctgggcagctggcgatgtgctatcaggggaaaggtggtccataccacattaaacctgaacaggctgtgcatgcagccttgacatagcacaagtctgcaggagcatgaaagaactgaagatacagtattcgacttccagtattactaatcactttagagacaggatgacgataggtttagaagagaccagggatgactaaggagcacaatgtaaaacaataatgttacagaatagaatataagatatctgataggaaaaataaataaaaaaatcaatgaatcttatagacagaaaatggaaagaaagcatcaagagataaagcatcgaagaatgaaggcctacacgtggtggtcgcaaagggaagggcatgaaaaaaaggagaaaaagaagaaacacataagcagagcataaacagggagtgggacacacataaccaacagaaacggaagcggaacaagggaaacaaaagggcatgggaaatacaatagggatgacacacgacaatcaagaaatagcgaagcacagaaaacaggatagacgaagagacacaggacgatacatcaaaaaaaaacactcgcacaaaaaagcagagcaacacgacacagaggaaccacacgacaacgaaaggaccgcaaaagacacggaacaaaaccggcaacacggaagacagaaagacaagaagg

SEQ ID NO: 618396 - DNA, 159 bp, Homo sapiens
cattctgcttctgccatggggataagttttttgatgtgctgctagattcagtttgtcgcagttccagtagtgacgtgcttcctgcttctgccaggctcttattgtgctccattaactctcaacagaatatctcatctcttacatgtgtgcttcctgctt

SEQ ID NO: 618397 - DNA, 310 bp, Homo sapiens
ccgcattctcatctcaatagatgcacagaaagcacatcagttcatgattttaaaaattcagaaaattggccgggcgcggtggctcacacctgtaatcccagcacttggggaggctgatgtgggcagatcacgaggtcaggagtttgagaccagcctggccaacatggtaaaacccattctctactgaaaaaatacagaaattagccaggcatggtggtgggcacctgtagtcccacttactcgggaggatgaggcaggaaaatcgcttgaacccgggaggtggaggttgcagtgagccaagatcatgcca

SEQ ID NO: 618398 - DNA, 828 bp, Homo sapiens
acctagtggtcgctggcgacattgccaaacgtaccaagaaagtctgggatcgtcggtaaatacgtggaccctgctatgtggtgcctccctccgagaaaatggtgaagaaaattgaaatcatgcagcacgccaatgtacacttgctacttatctgtgtgcaaaaccaagatgaagagacgagctgtggggatctggacactgtggttcctgcaatgaagacagtggctggcttgtgcctggacagtacaataccactatcacgctgtcacaggtaaagtcctgccatcagaatgactgaaggacgttgaaagaccagtagactgctccatctactcttatgagacatcacatggacctataactacaatgggttaatagaatgtaacgaaaaataagaccaacagcaagtgtggtgagccacgcgatcgataaaaaagtattcccaaatagaagtgagtgcaccagagagagttacaacgacatataccagagggatttctagtgagataaacaaaagagtggagtcccccagtagcataaggcagaaggtctgaatataatttacataataacaaaagagacacatgagtaccgcggacacatgtatataaccaaaaccacagactccggtgagaagcagttgaggaagagaaacacgcggtaggctataaggaccaatagacgatagcaacaacaaccgtaacagttgagtgagacaggtggggagcgacgtcatattagaaagccatgcccacgagctggggctgacgaaaaggcaccgagatatcagagaggccgacgcagaacaaagagcgatgaaactacgaa

SEQ ID NO: 618399 - DNA, 153 bp, Homo sapiens
actgaccgttcggggctcgcgggtatgacgacgtaagaccacggcccgggcggcgacggtgtgacgacgtggtgcgccgacggacctggactggccgacggggcgggtggagacactactggacgtcgtgtatgggtacggggacgggacgga

SEQ ID NO: 618400 - DNA, 343 bp, Homo sapiens
gagttcacgacagccaggtggtggaggccaagtcccccaggattaaacagcgtaagtattgaaacacaggccctcctgccccagttgtaatcaatatgagggctccttcaagcaacgatgctgctctgaagcatatatataggaatgcctccttttaatatactgaaattcactttcttgatcgtaagtcccaacattcattcaaaaatattattaaattaacctaaacacatgccatttctattctatgggttaagcctgttctgagttgtcgagactgtgtattggatgggctcactggctcacacctgtaatcctagcactttggtagagctaacgtacg

SEQ ID NO: 618401 - DNA, 269 bp, Homo sapiens
tggccaggcttctctacctttgcagggggggggggcctaccaagtggcccccccggccccccaaaaaaacagggccaccggaacacagtctcggcttcaggatcccttcacctacctcgggtctctccaaaaaagacacaattcttccgggacactctcaaggcttcctccccaaattcattctggcggcacgacacacacaggctctccagtccggggagggcacctccaggagccagcaccccctcctcaaattcctttctcagtct

SEQ ID NO: 618402 - DNA, 301 bp, Homo sapiens
agatgtcaagcaacccaccagaactgaagacacagagcttgaatttctcagcgttgcatggctggttaccggccaagttgggattagaactcccaagcgtcttgttaaaccaagctacctgtcaggtactgaagcaaggcaagctttacattaggaaaagagaatatttgctctttatgtccttagctttttctttcttgaaaaagataaaaacattgaaagatttgttatactttgatttaccaatcttacacttgtaggaaaagacaaagtgaatcgtaaataaagcagtgattttctt

SEQ ID NO: 618403 - DNA, 183 bp, Homo sapiens
atgctcgtgtagtctacgataaatacctactgttaaatatatggtgtgctcacacgataaaccctaggaagccaattgatatcatagctcagaccatacctatgtatccaacatgttctttttttccggagtagtaggtaacaatatgggagattattccgaagcctggtacggctgccattg

SEQ ID NO: 618404 - DNA, 752 bp, Homo sapiens
cggggaatataatcctgaggtgtttgactatacataccaattctcgaatgacatccgtagcgtaaagagaaagagcttgtgaaaaaacagttgaagaagcacctttcaggagaggagcatcgacgctaactgcatgcatactgcttcagcgtaatggagcagccaagaaatcggcacagcaggaaccgaaagcaacagcaggagctgcacctggccctgaagctaagaacgtcgggctcaggcccagcagggccatcggccgatactgtccgtggaaaagaatctgagcagcgccagttaggcactagctgcacgaagttgcaaggacgctcgaaactgcagcaagaaattcggagaacttcattgagtcgaaagaggcagacgaaatgacaggcaaggtacaggagatcatcgtccctttgacgcaagagagtaataaggaactatcctctgctctgccactgccccagggagacatggatgctgtgacggatcagagtttggtccacggcatggtttccagttccaagggccaaggatcacagctgcccgtgaatcgtgctattgcctacagagatagactagagggctctgtggactatccctcagggctacaacaagaatagttcagccttctgccatgccacacagcctcagattgaactctggttcattgcgtcctcgtgttcttctctcatccttgccattaaaccagggattctgataccgaagaagaggggccaatgaaaacc

SEQ ID NO: 618405 - DNA, 799 bp, Homo sapiens
agcggagtgtttaacagatggcggtggagcgcaacctcagcctgctgaagcaggactcctcttgggcagcgcagtcccggaagcgtgttaaacctagtaactgcgtcgctactgatgataggccgactcatggcatcacgcagtgaccgcagagttcacgtcaacgaatgcattgccgtgtgccacgtagatccgcatctgcgctgatctaagcatgacggactagggacgtcgtcgtcgagtctcctatccaacagggcacgttgatgcgtagaaggagtgacaagaacaagtacgtaattcgagaccgtagaggaatcaagaagagaactcttcctagcaaataatagttcctctgctagcaaattccagtcgacatggacgctaatgagccgctttggacagagtcaatagcttagttatcttaactcgagaggtcttttctctcgagactgtgcatcctcatcgtttggcagaatcgtgcgaactttggcgatagcgagcttgaacatagccaacacggagacagctctggacagagactgagttttcacaacaggcataagtttgtcgatgcccgatagtgcacgcaaaccggtgacatgatcccgtgggttgcttctcccaaggcgggccattatctcactggaagtatacggcattactttgcagcgcattgtatacgccactccaaacatcgtttacgaatgtgcaccccttgtaattcgaaagcaactggctgagtaggaaacgcaaagacacttcttgcttggggccgcatcacttgccgtgggcccca

SEQ ID NO: 618406 - DNA, 850 bp, Homo sapiens
gagggatcgtaagccggttggggtgtgagaggtttgctcgctctagggagatacttcaagcaatcactatgtcaacgagacacaggtgtctcccttccttcatagtgaggaagatcagggatcaaacatctcattcgaaatagctaaagaggcaccattctgtacccgttgtaatagcgggttaagcagcgaaatgtagcgatatggatttatataaattgaagagcaggggaaatactaaaatgtccattcatctgatccacatggcgttgttggccagcccaaggctttgttgtaggagcaatgacttgtgtggtatggcgctattcccagtgtagtcgggaattctgtgggcaaaacctaagcccttagaagaagagatgctgtctgtggtctttgttgggcggagctttgcatttaaggttagatgtcttatttattaaagttaacctatggatttgttcggaaaataaagtaatatgtatggggttcagatggtcacccatgggcatttgtgaactatttggttcccttttctttgcgaggctcttgattgtgctttggtggacccgaaattaactagtagacttaagtttacgtaagctcaaggttcatccccagggaagtccatgtgtcactttaaaaacgatgttgactaaattgcccttggatggtcggttgacatgtcccacctttcttaaaattttaagaatggaattaagccaaagagaagagaaacagcgccaacctcgaaggatcccccgggttgggggcggccacggccccgcatattcggggtgcgcaaaaagccaagtgccccctttaatcaccattcgtcgcccctcacggg

SEQ ID NO: 618407 - DNA, 130 bp, Homo sapiens
tgtaacctctaggtccatgaatgacccttatcttctgtaaaagtggatgcacgctggcaaagtatgttttgttttattgtgactcatggaacattctggattgtggtgattaaaatctaacttaaattga

SEQ ID NO: 618408 - DNA, 136 bp, Homo sapiens
tctgtagtcgatgaaaccgcgatcaatctcaccagccctaaactcgcacctgaaacaagctaacatgaataagatccttaattccatccaccctcctagggagaggagggtggatggaataaagggggtaccgagc

SEQ ID NO: 618409 - DNA, 1231 bp, Homo sapiens
  misc_feature (873)..(873): n is a, c, g, or t
aatcgtaaggaggggcccgtggttaatatctgacgagggaacggcacggcgatttgctgactggtcgcagcaaagtccaggctgctgctgcggtgtgctgtgtgctgtgctggaagctggtcggtgactgagtgatagagagccacagcacgatggagctgccagtgcctgtgacatgccatgtgtgctgccatgcatactgaaaactgtgctgcagagtgtgtgctgagaactgtccactgctgggcctggctgaaagctggttcctctgtggatgaagcactggtataagcagttgtggatgtgcatactgtgcatgggactgggtgaccatggactccagacaccttaccctgtgctgcatcaacaattgccacaactctttcaagatgagataaacttgtgctgcctcaaggagtggactggtggaatgtgctgagtgattattgttgctgctcccagcagctgctatgtggattaccttggtcagctggtattgtgtctagagcatggacagccacccattgaacgcaaggtcatagagctgcccaacatccagaacggtcgaagtgtacccagtagaactgctgcttgtcctggcacaatgatttgggcaaatctcacactgtacaggttacagacatacctgattctattggcctagtattgagcacagctcgggagcggtttcttggtggagccccagtgaagacactcggctttgggccaaggaactcagaaggctctctgggatagggttgtatgacagcacacattaccgggtactcgaatgcggcccttgagaattgggcagttgatcatcatggcagcaccgcaagacgagatggcacttggcccagatgcacagcgtgnatgtcaatgcaacacacacatgtcgcaacacgatcaggaactccaaggtcaacaaggcatttgtggctaaccatatgggcaacaagtgaatatcatgaaactcggcccttgcggtgctcaggcaatgtccacagacgcagaggaactgtgttcaaaaagtgaacattgtagaagtcaagattgtgagcaggtggatgaagggtgagaatgaaggcgattagaacattgtgagaaagattatatgaaacaagagaatgttgagatgttttaataaagggttatatgtagcaaaatgggaagcggagtagaagtagagtgattattaggagaggaaatggaacaagtaggtagaaaataa

SEQ ID NO: 618410 - DNA, 757 bp, Homo sapiens
tctgttcttttttttccttttgttttgttccttttgttcttttttttttcgtcttctgttgttataggttttgttttttgatttttggttgtgctagcgtatgtctggggtcctcaggctttctcttttttgttgtacttataccttgctccgtgattttggggtatcggtcgttgtcccgttttgttgtattgggtgtttgtatttgggatgtcatttgttgtttcgtttacactcttagttctctagatatttgatagctggacctctgtgttcgctgtgtttgatgaatgtgttatatgtattgagttcgtgggagttggtacgtatgtgaactgacgtgagggggatgtgactgtgtataaatgattccttgctgaatatcttaaggttttgtgtaagaggagaagaaaaaccggacttaagaaagcttattttcacattaataatggaacctctgtttgcgagcgtaagaattctatggaaaagcagtttttatcatattttgtgtccatgcaccattgttcgtaaaatggcgtacataataagaatgtatatacaatttgtgatctggccagttgtacttgtagctctccagagggagagttggtggtattatgagttgagtaaataccatccaggggaacttgagggagcatgtctgttgctcagtaatgttccttgtgtgccattaataccacctccagatgagtggaggtacatcacttttgatatcttcaagggtatttggaacttg

SEQ ID NO: 618411 - DNA, 996 bp, Homo sapiens
ccttttgatgtaatatagacaactggactaaagagatgatatatatggagaacatgtgattatcatgaaatatcagcatcttctcactagtacgtgtaaaagtagaggtaactcgtctatagtaaatctcctataatcatgtatatacttatttcgtgtaataatctcattcagttaggttcaaacatcatactaaacatgtcactggtatacttagtaacatgctaatatatttctacttctcccctccttttggactgtgaatgggagctattcagatttgtaacctcactatgtaggtattaaactattaatcacataagaagtatccggaaatatgtagtcatacatcatggtcattagctaaatattgtctattctagcaaaattgttgacacgcctatcgctttttcataacatgatatatatttataatagatgatactagggaatgtattgtatgtcctttaatacatttgtacggtaattttcgttgaatattgaaaaggtaagcatagttgtcaggagggtgaaattaattcttatttgacagtagtgaggacgttggtagttgaaagattttgttcccttttatggataatttgtgggaagttcttgacacatgagatcgaccaaggtgtagaagtaaaattagtcggaggttggctcaggtttggtaaaaaacgttggtataatggatgcgaaaagatttccctaagagaattcgagtggggggtcgcggaaaccaaataatgccctggaatgaatacgatgttaacatgacattgccaggctaataaaacgcacgtggcgtgggaaacccggggggatcccgataaaccactgaaggaacaaccccgttgggcgggggcgcaacgccaggcggcccgatgacatcacagcaggggatcgacacggggatgacaccgggcacacaatacgcacagacacatctcgacaataaaggaggggcaacacatctaaccacccgacgct

SEQ ID NO: 618412 - DNA, 499 bp, Homo sapiens
  misc_feature (46)..(46): n is a, c, g, or t
aaaatccatttgaactctacgaatcgctaattcgcttctttattanaactttcctttttttaccccctttatccaatcagttatcagttactgtcttgtctcatcgctacaactcccgtacgggctcgggtgtcacgttctgtccatcgttcgtatgtgttttccttgttttagtgtttggtcaggacgtgagctgggtgggcattctatgttgtgggtctggtttgtctatttctatgtttggtcctgatatggttctcaatcagaggcaggtgttagtcattgtttctgattgggaaccatatttaggtagcctgtttttgtgttgggtttttgtgggtggttgtcttctgtctttgtgtcattgcaccaagacagagctgtttgggttttcagatttgttgttttgtatttggtagtgttcacgtttatcgtctttattaaacatgatgaacatgaaccacgctgcgttttggtcctttccttcgtccgtcgacgc

SEQ ID NO: 618413 - DNA, 240 bp, Homo sapiens
aaagtgtgagcaagagtcttgaatcaacaactctgactgaaaaagaaggtgaaatctatagtaacaggatgctatgcaaagaacttagggcccaagggattaggctatggccaaggcgcaggggctcttgttcatgcccagtaagatgtcaaccctgacctaaacatcacacactgagaatctctttataatctaggcacagatactctctaacactcacctactgtgaaattctaccag

SEQ ID NO: 618414 - DNA, 465 bp, Homo sapiens
atgactattgatgccaatggtacactcaatgtctctgctgtgaacaagattacggaaaacgagaacatgattactatcactaatgacaagggccgtttgagcaacggaagacattgaacgtatggtccaggaagctgagaagtacaaagttgacagtatgagaagcatcgggccaaggagtcatccaggacaagttcacttgagtcctatgccttcaacatgaaaccaactgttgaagatgacaaccttcagaggcaagtattcacgatgaggacaagacagaagatctgtactagtgtcatgaaattatcaactggcttgatacgaatcagactgctgagagaggacgaatttgagcatcaacagaagtagctggagacagtatgccaccccatcatcaccaagctgtaccagagtgcaggaggcatgccaggaggaatgcccgaggttaggaggtgggtaccg

SEQ ID NO: 618415 - DNA, 198 bp, Homo sapiens
atcggtcggtcccgctggcttggcccagaagcaggcgaagtagatatccccggctgccagccgtgggtggtgaacagcgcgctgatgtgccgcgcggtacgccagcatagcgcgagacctcgtcgaggaaggcgtcggggtagcgctcggcgtagtggttgatgtcctgcagctgggcatcgacccagctgtcgccgg

SEQ ID NO: 618416 - DNA, 251 bp, Homo sapiens
ttctcagtgcaggggagtggtgacatccatccacacggcgcgcactttagtgtgtcgtatctaccatccgtgtgccttcgtcaacttacatagtattgtatagcgtgcagcatacatagtctcctcccctcttacagatatttttcgccacacactcccatgctactaatctcatcacttgaagccccatccatcccaccctgttcacatacaccattgataaccccataccccgaaccaaccattcccca

SEQ ID NO: 618417 - DNA, 453 bp, Homo sapiens
aggagtggcttgagaaagtgttaacaaatgttgagttcaatgttagtaaagctcagtgttaggaatggcagtcatttttcagacttccaatgtctctgaactcataaccattggaaaactttaattgggaaggaaaaaacttaaaagtcccctattgaatttgttcattaagtgaaattataaaacaaaggagatggcaaaaggaaatactaaacaatttctcttctaccatgcttaacttttttctctttataaggattcacaaaacagcaaaccattcagaggttttgaacacaagcatgaatttcattttgctctgacttttgtaacttaaataactaagtgattttcaattcagcagttagaaatctttctgcaaaaacatgcgcacaatttttattccaatgtgctgcccccctcttaatactcaccaataaattctacttcctgtcc

SEQ ID NO: 618418 - DNA, 352 bp, Homo sapiens
  misc_feature (10)..(10): n is a, c, g, or t
  misc_feature (18)..(18): n is a, c, g, or t
  misc_feature (22)..(22): n is a, c, g, or t
  misc_feature (76)..(76): n is a, c, g, or t
  misc_feature (168)..(168): n is a, c, g, or t
  misc_feature (190)..(190): n is a, c, g, or t
  misc_feature (195)..(195): n is a, c, g, or t
  misc_feature (198)..(198): n is a, c, g, or t
  misc_feature (200)..(200): n is a, c, g, or t
  misc_feature (216)..(216): n is a, c, g, or t
  misc_feature (223)..(223): n is a, c, g, or t
  misc_feature (237)..(237): n is a, c, g, or t
  misc_feature (276)..(276): n is a, c, g, or t
  misc_feature (299)..(299): n is a, c, g, or t
  misc_feature (316)..(316): n is a, c, g, or t
cacaactagnagatggcntaantgtagaaatctctccgttaattaaatgcctttaagagatataattaacgtcagnttaatatctactaaattaagaatgacttcattatgatcatgatttgccacaatgtccttaactctaatgcctggactggccatgttctaganctgttgcgctgtgtacaatctnatatntgntnctagatcagagaaatntcctagntcacatagacccanaaaggggtgcgaggggagagggtggattaccagtatgtngttcaaataatccaatgggttcnaaggactgtataaatgnattttattttaaataaaagcaaaacttttatttaat

SEQ ID NO: 618419 - DNA, 452 bp, Homo sapiens
cttcaataggctcaattcttatttccgtcatgagcctagcaatccaatccatcctgtgccatcatgaattctgagcgtgcacacttggggacctgcatcagcgttaggtcagcgtagtgggttaatgcattctggaatagtgaatcacttaatcacggtccgcctagtccctgcagctttggggtccatgcagagaccacagtgcaacatacgtggctagccgctgagatccagctgatctgaccggtcagtcacgttgtcactcagaaacagagatgcgattgaacatggggagtcgccggtggtctgccgcggtctggggtggtgctgaatcttgcgcctggaagtcgggagagtcatatcccccgaggatactgccgatcgtggcatattcatcagggtcgtatcccagggactgcacaaagcgggtcggaagcagctggtcccgattc

SEQ ID NO: 618420 - DNA, 1051 bp, Homo sapiens
catgtactttctcagctgtaatggtgcgtctaatgctagtgttggcacctgtgatgtgctattctctctggtcattggagtctcccaggctgctgtccacgatacatgaagcaatctggtacgatacatgtcgtccaagtagccacacgtaagatgcaatgaagcaagcatggagttccacgcttacccggattatcgaaattgaaagctaggtagggtggagatcgatactgctcattggcttctacgtttctcgattcacctacacccttctctattcataccctgggtattccatctgaatgatgtcaacaatgtttcttttgagattgggtcccgagattcggagggtagtcaatgaatatacgtgctgaacatattcgaaggcacgaactagactatttatacttccaatctggatgagacgtctccagtgtaggaccgttgactggttctccaagggtctgctcaaactggtcctcaatcgtactaaggattgttgttaacttattccgcttaggtaacaagtgtctttaactcaagtaatggccagagacagtacctcccaaggcatttagacccgtgttcctgaaatcgctagacgattgggtaatacacacgactttgatgcttttatcgtcctcgcgatgaatcgccttattacctactagatcattggctgggtcagtgatatacccgggtaaaatggacctcggataaatcgaggcttgtccagtggacatcaaaattgttcaacgtccagctctgatatgctttcgctacttgagcactattcacaaatttaggaactgttgacagatggctagttgtaatctttgactagtcttccccggtttgttcaaaacccaatgtggttttgcgctcagtaattcgtctttgccagtcttgccgtagaggcgtatttggtgttcggcccactcgcacaaaggtgtttttgttcttctcaacctcgtttcccacacggaacacttcgtctgagctggtcactttgggccaatccaggggggcaaactttcctttaacgttaaac

SEQ ID NO: 618421 - DNA, 519 bp, Homo sapiens
gattagaggatcccagtagtcggacgtgtagtgaatgagatgatggtctcacaccatcacccagaccaggttatgcacacagggcggtggtcagaaggattggcaggacgttgatatacgatgacatcaggttgtctgacgaaggcaggattcatgataagtactctgacgctgtccgcatcctctcaggttcacgcatgtgtgctgcagctcccatttcatcagcaagtttggaagaaccccacatttttcctgcgcgtcatctctgacacggcctccctctgctactccatcctgcggtcctgagcttaacagcttctactttctgttctttctgtgttgtggaaatttcacctcccagggcgggtgccaggctcgcagtggagctggacatacgtccttcctcaggcagaaggaactggaaggattgcagagaacaggaggggcggctcagagggacgcagtcttggggtgaagaaacagcccctcctcagaagttggcttgggccacacgcggtc

SEQ ID NO: 618422 - DNA, 1014 bp, Homo sapiens
  misc_feature (288)..(288): n is a, c, g, or t
  misc_feature (386)..(386): n is a, c, g, or t
  misc_feature (509)..(509): n is a, c, g, or t
  misc_feature (760)..(760): n is a, c, g, or t
  misc_feature (1014)..(1014): n is a, c, g, or t
agcgggctccgcgcgcgccgcgcgaggaggaagcgcgccggttcctattaggggtccggtgcccggccgggcgcatggattcacagtagcctgagcccgcggtaccggcgtgctcttctgcctgtcttccacgtatgactagctgctgtgtgacgtgctgcatgcttgcacgggtgctcgcggtagtcttggggcccagagccaggccaggaggctgcaggaggaagctggaaatgcggattacgtcctgaccactaggactaaagtgctgaagggtgatgatagaantcatgttagcatgctgtgcaggctgagacgatgatccccatttgcaggggatacccgcgtgaagaaccatacgggaggctgcacttggtcaccgaggnctgtactgggcagtctctggtaaacatcatagggacttcctggcacgtcacacactaacatccaaagatcaggacttgtcggtttatattcgaagatagatgcagtaccaagtgatggctaangaagggcatcgatagggagttgatagagtctgagcagcaagagaggatgaagagacgcaggaagataaatcggaattaggtaaaggggcaactagtaatgacgacgcttatgaagacgtttacatcaacttggagtagacgataagggggtcaagggtcgggtagatggatccatccgacataatgacgactaggtagagaaaccgtagatcttcatcggcggagggttcggcttgacactgcagacgaangcaagtgtggatgtgctgccggggacagaggtacgaaggacggtggatcggagagacatggatacccgtgaacacatccacggaaggataggacccctgagcgtgccgttcccctcttgacgcccaaaccaacgttgcttgagacgggaagaaaagacgaggcgagtaggcctggtgtgaagcacgtgaggcggagcaaggaaggggacaacacatgccttgccttgggaggggaacggacgttcccgaccaan

SEQ ID NO: 618423 - DNA, 156 bp, Homo sapiens
ctcctcccgacctacctcagggagctgagcgtgcaggcgctcacgggcagcgcctgggacagagtcacgcctcagagaataaaggtagctcatcccaccataatactttcattagaatgttctgatgataaaaacaaaacttgttttccttaaaga

SEQ ID NO: 618424 - DNA, 347 bp, Homo sapiens
atgataatataaaaatgatttcttctggctttggaataaggtgtttgtttttataaaagatttaccccatagctgggagtggtggctcacgcatgtaatcctagcactttgggaggccaaggtgggcagatcatctgaggtcaggagttcaagaccagcctggccagtgaaacctcatctctactaaaaatacaaacattagctgggcatgatggcgcacgcctgtagtcccagctgcttgggaggctgaggcaggataattgcttgaactcggaagacggaggttgcagtaagccaagatcgctccactgcactcctacctgggcgacacagcgagactccgtctc

SEQ ID NO: 618425 - DNA, 1185 bp, Homo sapiens
cggtgtatgtggtatcgatgctttctactgtgtgaccggagttgtcggtggcgatgggatgggggcctggtttagtgtcggccgttgtggatatgagtgagtccttttgtttttatgcttttcctgtgggtatgttttgttccttgttgttgcgattgatcgtgttttagaggtgtgtggctgctggtgaagctttgtctccatcttttgtgtttttttatttattttattggttggtaatatttttgtgtggtagtataggtgttattatgatgtgggttggaagtaagtatgatatttgttgttgtgcgttagtgggtggagagttgtgggtttgatgttggtgggaagttgttcaatgcagtgtgggtaagttggttgaggatgtttagcgcgagggctaattatatgtgatttttagattatgatgcgttgttgattgtttcaagggtggttttagaatgggtagtagttttggttttgttgttcatgcggagatgatttatgagaggattggtctgtaagtttaggggtgattgtaggtgttataagtatgcgtggcggtgggtggcatgtttatatatgggtttacgtatttgtagtagtttttagtgtgtccgagggtttgtgtagagtagggttgagttttagtggctattggtgttttggtgttgtgataattagttagttgttgggtgctatttgggtttttgtgtaaatttactgtggtagtgggcttaattggtgttattgtgtatattagtgtatggagggaatacatgtgttggtagtttgagctgttgtagtagtggctttgcagttgtagcattagtagagtgttgtagccagtagtgtggtggttaagtgtagtgtaggagttagggagtctgtgtagcagtaaggttcttgacatatagctatctagtcgttaggaatattatgaggtgtattgactgtatgctttacgtgatactatgttgtgttagtgtagtgttatgttaaatagatactatccttgttcagatattatgctgtgttgaatgtacccttgagattgatatgcaagcatatagtcagtttgtctaattgtgtgtgtgagaattttgtcgttatatacctaaacattgtcatctatatctgtgccttacctatgttataaatgttcataagtaccttcagtacctc

SEQ ID NO: 618426 - DNA, 913 bp, Homo sapiens
gctagaacagcggcgacaggggagcccacttgacgagaagcgaaacttacggtgtggtgcaacgccttagtacagctactggggagctgaggcagaaaattcacctgagcccggaggacagaggtttccaaggagccaagagtgcaccaatggcactccagccagggctaacagagcgagactctgtgctctaaaaagtacgagacaaaaaccacatgggaaacgaactttgaatctgctcaattgataggaaaaatgcaaatcaagagaatcaacgttttacgaatgttacatagactggtctcttatcccccgaatgcatgcatgtcagaggggcacggacatccctgaagagtgaatgaggagcccccactggagggcgggggcagggtgtgctcactggctctttcctttcagcatttggtgtatgtattcaactgacatgggagccgcatattcagtcttgctgcttgcactcaaaacacaagtcggagtcacagcaaaaacacttttaaagttaagataaaatattgtttatttttgttataacctttaaagtgtgtgtgtttataacaaagcatattagtgcagtagttgtgcatatacgtgtaaaatcagtaacttacttggtgggtgctttctgaaagtctaataggggtgcaccattggaagtctggaaattatagttttaaagtactgcacaggttgagcatccctaatcctgaaatccaaaatgctccaaaatttgaaactttgagtttccaaatccaaaaagtttgatatgatgccacaagtggaaaatttcatacctgaccttggtgacacattgtggccaaaactttgttttatgtacaaaattatttagaaatattatataaagttatcttcaggctattactgcaggtgtatatga

SEQ ID NO: 618427 - DNA, 383 bp, Homo sapiens
agctgtaatatgtaacaaacctgcacgttatgcacatgtaccccagaacttaaagtataataaaaaaaaaaaaagaaaatggagtgatcataaaagtttacaaccaatggccttctggtggagtaaactggaggaggaagcagaagaggaggggtgggcttgggggcctcagtggggggagagacacgggaaattccaggtgtaagtggaccatgcgggtaaaactggtgtggtccaggtgatatgagaagaaaatggacattcggtcatgtatgattagacccaagccctataaatgcttgtctaaaacaacaaaacaataattccagggaaaacctatagaaatggattttatgcgggactctaaggtaacatattagggg

SEQ ID NO: 618428 - DNA, 114 bp, Homo sapiens
agaagcggccacacgctttgaatgtcctgtcgactgctgcttccgttctgggcttggcttctgcagggtcagcagtacatggtccagcagttccaggtagccattgcactccgg

SEQ ID NO: 618429 - DNA, 346 bp, Homo sapiens
taaagaagaaagaaggcaggatagtgcttatgaacaagcctatttccattttgaaagtagatttcaggataggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccgtctcca

SEQ ID NO: 618430 - DNA, 403 bp, Homo sapiens
ctagaggatccccatggatcatcatcgctcattcattttcctgagtccccttggtggggttggggggaattctgcctcaggaccctgaggggtcttctgtgagcaagatgtgccttggtaatgcagccgctacgaacaggacttcattcacaggcataatgatgtatccaggtcgaccatcaatgtaccattaaagcaccagatcattgtaggaggcttccttgtcaaagtcgtgactgtggaattcctgcgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatt

SEQ ID NO: 618431 - DNA, 748 bp, Homo sapiens
gcatcactgaactgtttgcagcgcctcaagtaaccagactggtgtcacaggttagtgagcaaagatttcatgtggggactctcacctggctaatcttacgtatactggatagcatcagttcccagagcagtagagaggctcggcaggctatgttacagtgaacatttacgggctgtcacgcctgaaaagagcgatagtgcaactccatgttcccgtgctgaaattagtgtcttctatagtctgcgtataccaagtgtattacatttctgatgtgtagctggggattaggacggaaagggggtatcaaaaagggaaaggacatggtctgcactgtattctaaacctattttacccataactcttatacatccacgaggatacttggaatgctagataccaagacgagtcgctatacagaataggaacacaaactgcctgtcatgtgcagaacatctggactaagaattttcaagccctccattcccagtaattatactcgaagacagggaggctggttaggatccgattgcacgtcaaacaccacaaccgaaacctgaagttgggcaaaacacctgggagacacgaatacaggcagcaagggggcacgggcaaagacgggcgcgaccaaaagcacagggccgaggaaggaccagcgacggaacaatgacaccagagacagtagcgagacgaacgcaacacaaccagggacaattgacacgggcacagctggcgccccccagtgcgagtc

SEQ ID NO: 618432 - DNA, 486 bp, Homo sapiens
ggatctgtatatgttagctcacagcctccatggtctccctgggatataagttgctgctggagatggagggcttaggagtctccactgtgcagaaaacagggtgaagattgccgtgtgtggcgcctttgattcctccaaaggcatttttcaatcagaattggcatttcccacctctcagcccacccaagtccttaaaagcccatggcaggtgtgtgtgatacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctgtgtgtccctccgtctccaactgcctgcctggcccaccttgtggtcctcacttggagcatgcagtgctggaatcttgttagtttcagtctcactttgcccactgaggtatgtttt

SEQ ID NO: 618433 - DNA, 306 bp, Homo sapiens
cctttttttgtttcccccggggggggccccccctcccctggggggtttttttttggggccccccccccctttttgtgcccgcgtgccctttttttcttttccccgggggcccccagggggtggccgggttttttttgggggggactttttttttccccccgcgaaaacatgtgttttttttttcggggcggggggggcgttttttggggattgtccttccccctgtttatgtgttgttttttttttttggggggggggccccccccgctttttttaattgggggatttttgttgttttttttttga

SEQ ID NO: 618434 - DNA, 581 bp, Homo sapiens
acccttcggagaataccttaattgtgatcgcggtttatggggcgaggccacgcaacgacgcgcagggtgaaaccctatggacccacgagtgcggcgtgctgggacaaggatgccggactttaaggaaaaaaagatggtaaatccactgttcctaagggttccaaaaaggacttcaaggtctacctgaggggaatggtgctgaatgaatagggttactcaccgccactctgcgttatataattatgctcttataaagtgtgttttttaaaaaaagtggtttgtcaccatccgaaaccaggaccaaaataagtttaaacccctagtttatatcaattcttagatcacgttcatctctacaactattcaagaaccaaatggaaaagactcataaacctacccaaaagttttaaaattctctaatagtgtgacctagataacggcctcgttatagagaaattcaggaagtatggaaacttaccaagtatatgtcatctattataaaaaactgatttttaattatggatttttacccttaaccccggataagaaaaaatttggaaacaaccaaaaaaaccaaacaa

SEQ ID NO: 618435 - DNA, 346 bp, Homo sapiens
cgcccacaggataccggagctcatggccaaggtctggcacaaggggctccttcccgaagtcccacagaaagttggggttcaacttcagccctcctttaactgtgtctacatcaacttcgagcttcacagacgccttcctttatgagctcaggtgtaaacctgctgtgtcccaggcacgtgtacagcaacgtggtaatgtagaggcgccccttgcctcatagggctctcgtgtctggcacttatagttcctcgtcctacagcacgtgcacagggctctcccttaacaaatgctgcctcagagaaagagctgtcctgtgaggcggtgtctctgtgggtcagatatgtc

SEQ ID NO: 618436 - DNA, 259 bp, Homo sapiens
  misc_feature (189)..(189): n is a, c, g, or t
  misc_feature (201)..(201): n is a, c, g, or t
  misc_feature (209)..(209): n is a, c, g, or t
  misc_feature (216)..(216): n is a, c, g, or t
  misc_feature (231)..(231): n is a, c, g, or t
  misc_feature (240)..(240): n is a, c, g, or t
agccatggattacctggaacaaagtgcagattagggcccccggtcctttccaggtagaacaagctatcgttctttaattttattaaaaaaacaaactttttttttgttttttgctttaagaactaaccccgatcaagagtattttttttaggtagcttaaaaagaaaacatatattttatgtaaaaacncaaacatggccnaatgcaanactgaanagacaatcatcctgnattttttanggtttttcccggttttgag

SEQ ID NO: 618437 - DNA, 238 bp, Homo sapiens
  misc_feature (176)..(176): n is a, c, g, or t
  misc_feature (185)..(185): n is a, c, g, or t
ccagtaaaaatgcgcgagagagtgtgcacgtatcacatctcagaagggcattgtctgagagaattatcactttgggtggaccactaattgcatcttcaaagcctttgctatgatcattgacacactggaagaggacataagcaggtctatgaccaatagcacagctgccagtaganccccggtcnacctgaggctggtggccctgctagtcagtgtggctctctcattggaaaaggtg

SEQ ID NO: 618438 - DNA, 1494 bp, Homo sapiens
  misc_feature (1280)..(1280): n is a, c, g, or t
ggacaggtctgctcaccaggtggccagataccgaccaggtgcccccatcatgctgtgacccggaatccccaagacagctcgtcagggcccactctgtacctgtggaatcttccctgtgctgtgcaaggacctcagtccatggaagcgccgtggcgcgtgaggacggatggagcctcgcgggtgaacgtttgccatgagagtgttggcaaggccctgagtgcttcttcatagcaagggagatgtggtcagttgtgctgacctggatggcgccctggctcctggcttcatcctaacagcatgcgtgtcgttcctagtgcccgtgatgggaccccaaggaggacccttacctaccatgcccctttggtcacaagcactgacctctcgcggctaggctgagtaccaagttaggcgcacaaaggcaaacgactttgccaagatccttcagactcctggtgagtcgggtaacggtcggtagccttggctaagggttagggggaccacacatgggtaacatgcaccagactcattggtggccctccatttgaacacaccgagtgggcatgattgtcatgctgggcacctgtgtgcatagcgtgggagcaataaggcccaatagacccatgcgtatgagccgaatcgagtgcttgggagcgcccaaccccgataatccacacgaggtaggagaaaagggcagcgaaagtgcgtggggcataatgggaggggcctcgcttgcgcacgacgcatagcagatgtgtccacatgccaagtgcgtggaaccaagggtttcctcctgttttggcctggtgctgattagcgtgcgtggaaaggcacgatttatccctatgtagacacttgaagactgtgcgtgtgacacgccacgaggggatgttccaccatatccccttgggtgtttggaccgtttccgaacgcaatcccaggaggcgatgccatcgaagtaaagggggcgcctctatgcgggcacactcggcgcctcgtgcggtccccgagtttgaacacgtcctgacctgcttgcgctccgttggtgcccgtttgacctctggctatccctccttatgcctcctggctacggtgcttgcttcccttggtttctgcgtcacattgggtccttcccagagcacctttacccaggttcccgccatttgtcctcgtgtgtggcaaaaccaagtttaccaaggcccttttcaccatctcccacttattccccccataggtgctcgcgaagatacgccttctagaggcgccgtgatagggcgtattanggagccccatccactggtagtggttccacaggaaaaatacactcaaggtggaaacgtcaagcagaatacaaagattggaccaaaaaagcgcccccgaggggtttttcatatggcgcgccagaaggataaagaggacaatagacaccgcggcagagtgggcagaaatcgtgtttgcaagacgccacagcagtcgtcttcacaggacagatagtga

SEQ ID NO: 618439 - DNA, 632 bp, Homo sapiens
ccactctctacagaactattcatctggcttaactgtgatgagaaaatttacgtgcctctcaatacgaatgccctctctgcagaaaatcatacgatgtaagcagaatccattgggcaaccccaccacgcttctcatgatatacttcctctcgtaccttgtcattctaccttttttgctatacatattgtgtaacttacactgttattaattcaatcggatatatatgttatcagatgctagacttctgctgtgaagtgcaaggtattattttcacgatgagtgccagtcttgtcagcatagtaatctttcaaatatctccagtaatgcttcttgagaataagtgaagtgcaattgaaaaatacgcacttgcttggaaatttattcccttactgtctatctaaaaggaggtatgtttggaaacttgaaaaatcttaactttagcaagtgctggtacatcttatttctaattgtggaccatcaggaaggaagatttattttgatattgatactataaaaggactttatatcttgtaacattgatgttaaccagtttacttagtctaactcagtactttgcatataatcagcattcaaccaaaatttattgactgaaatgaattctaaatgatacc

SEQ ID NO: 618440 - DNA, 176 bp, Homo sapiens
tttttttgggggggggcccccccccccaaggtccctttgggccccggaatggggggggttcccccccccaaaaagaaaagggcccccccaaagggcggggggggggccccaagggtggggggggttttaaaaaaattttggggacccccccccccaaaaaaagggggggcctttta

SEQ ID NO: 618441 - DNA, 228 bp, Homo sapiens
  misc_feature (80)..(80): n is a, c, g, or t
  misc_feature (125)..(125): n is a, c, g, or t
gattgccctgggttcacttatccaactgattccagtgttgaaacccagaatgacgtccgagagtcaattattaatatganggcaactaagcgcctgactgttccggaagatgttgcgggaagcgnggtgttcttggcttcacgactggcgaataatgtaaccgggcagtgcctttatgtggatgggggattggtgatgcattagtggagagagtcatttattgggatg

SEQ ID NO: 618442 - DNA, 787 bp, Homo sapiens
aggttttgtctggcaacatgatgcgtgcattcaaaaactgtattttctattatcctttcatttctacatttatagtataactagtttagagcacaaaagagatatggcaattaatatgggaagtgatagacccaacacatattctatccaattctatccccacaaagacgaccggactaagcagcagccccagggtcttgccgcatcgtttcctttcgggagcactcacccacaatgtgttgggtgccacaatgcactgaaaatgtgaccactgcccttgatcatagaactatggaaccttagtgctagatgagaccttagaggttttctagtccagtggttttttggattagaaactaggaagagcattacttggggactgtcaagtaaaaacatttttaaaaattctaccatcaagaaattacgctaagtgaaaggagcaagatgcaaaaagacactgttttatgattccactcatttgaagtacctagagtagtcaaattcatagaaacgaaaataaatgggtggtgcacaaaaacaggggggagggggaaagggggactattgggtaatgtggtaagggttcaatttgggctatgagaaaagtatggggagggatattgggggatactgcccacattgggaatggtttaaaggcctgaaccgtcccattaaaagggaaatatatatgtgtttggccccaaaaattttgttttttaaccgtgtttgaagaaaaaaattttttcattttaagaaggggaattatagaagatgaggaggggggggg

SEQ ID NO: 618443 - DNA, 114 bp, Homo sapiens
ggacgggcattgtattagcaaactcattactagacatcgtactacacgacacgtactacgtagtaggcccacttccactatgtcctatcaatagatgttcctgttcccacaatt

SEQ ID NO: 618444 - DNA, 1069 bp, Homo sapiens
gctgatcataatattctgtcagataatggctaagattgagcgttgaagaacgttgagccatcttgaggtacccggtctcagatcggtgcatcctattaaagtccgaggtgcagcattgtgagtacgttcgtctctctacgagttgtcacgtcttgcttatgtaagtggaggcttcgagaggattgatccctcaaggaaggtgttccttcagaaacagagactgtagtgttctccttccgtttggtgtaggacttcttgcgtctagatattgagtcgtgcttgggattatgactaacgtccaatggcggcttaccaaacaagtggtgatatctgtcaccgagattatatgcgttgtcccttgtgcacgtaggtagatagcgtcatgaagattgttcttctccactactcttccactaccaatgttcgtatccgtctgctgccgtgtcgcgttgtactcttccgtgttgttcgtgcataacacagtgtccaatttgttcagataatttgacacttgaactaggatactcgtgaagcggtgagttactgctgagaactatgcggtacagatcgctgcgttactgcgtgacgaagcggacacttttcaagttgtattaacgattgacttcagaatgaccatgagtagtacatgatatggtcttcagagtacgagatgtctcgaagcaggcgagttttgtagtctggaacaatgcgttgccaggtgttagggaaagtttgagagagacgttcgataggcgaagtgcttgttgtccgtaatggtcgagcactcattgagtgtcttccctactaagtgccccccaggggaggctgcattgcccgttgtcccgcattctaaggtaattgggagggtggtggcatgggtttgggcaacgttgtgcaaagtggcgagtgcgttttaggacaagaacgtgggtaggacaataacgtgggactgtggctaattgaggttgggtccacagaaaatagggccttcacttgctgatttctgggaagaccatttcgggttgttggagttcagagctgtctttcacaactaaacgggtcctggggg

SEQ ID NO: 618445 - DNA, 937 bp, Homo sapiens
tctgggacaagcaagaaaggggcccccccccggagaggcaagcccgggcttcaccacgcttcatgcgggaatatttccctggtacccacctcccttggccccaaatatttaaggctggcccgggctaatgccccctgtagttggggacgtgccacaaaccggcgttccaccatctcaaagggacacaagtttcctggaaggctgacaaggaaaaaaacagtgtgagtcgccgccttttctgggggaaaaaaaacctgggagaagagatgggcgcccccaaattctcttgaaagtctttggtagatgacgcctcccccctatcccttgaattatggtgtcctgggcaagaagaccccacagccattgttgttgaaggaggcttttctccagaaggctaaatcccacacccctttgggggtttacgcgcatctttgtctgttctgtcgtgtattaatgtaaggacccacgcaccacacattgttcgcggtgtgggggttcaatcaacaaaaaccacggtgggaaacaaaaagaagaggctgcgctgtggagactgggtccaagaggtttcacaccacagattgctcgccccgcaaaagtctcacgaagggcttatatggtaatatttatcccctatacctgccacccccaccttcttaaatcacatggtggaagaaacggtgttcagagactgtgttgtttcaacatgggcacacttaagtttagtagaattaaagactgggtaatgataaccacaagcgcttcgttaatccccttcagaaggaaaggagaaatttttgtgggaccaaccttgggttttttttttggggttggcaattttaagttaattgatttttaaaaccgagacttttttatgggaacaaattggccccaaatttttcccaagaatttggaaccccatttaaaaaatttaatgaga

SEQ ID NO: 618446 - DNA, 467 bp, Homo sapiens
cccaaggtcagcacccccttcataggttggtacccctgcaatttcaatttccgaggcaatcgcccagatatccctaacccccaagatggcaaagagacaaaagcagccgatcccccagttgagaatttgtccgctcccgaggttgagcagggcggggttgagtaaacgccggcttaccatttctcccatcatccggtttagtcatcccacaagaagaaatatgaaattccagcaataagaaatgaacaaaagattggggctgaagccctaaagggcttgctttttgcccgttgcccaaataaatagaactattggcattatttatgcggcagggggtttttattatttttcccaaaaaaggttttttttgggtaaaaccaaaggggttttttaaaaaagccgggtttttcccaaaccccctttaaaggtttttaaattgtttcaaatcgggccaagttgagattttt

SEQ ID NO: 618447 - DNA, 266 bp, Homo sapiens
atctcctgaaaggaaaagaacccctccccattcaacgttacaaagtcacaaggggcccggtgcagtggatcacagccagcacatcctagcacttgaggagagcaagatagagcggctcattagaagtcaggagtcacacggatctaacaaataaaaaagatcaaatagtgcaccagaagtccctgtacaaacctttaagacttcttccccttcaaatggaggcagacattacaaacggataagcatggatatatgttctctctctc

SEQ ID NO: 618448 - DNA, 414 bp, Homo sapiens
  misc_feature (71)..(71): n is a, c, g, or t
tgggctggtaaactggccacctgaacaccgctgaacttggctaaatgctttgcagaaagtgatgaccttanaccacaaccagcttctcccaggtcatatgtgccttacctccagagagtctttttttttttttctgagatggagtttcactcttgttgcccaggctggagtgcaatagcatgatctcggctcactgcaacctccgcctcctgggttcaagagattctcctgcctcagcctccccagtagctgggattaacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcat

SEQ ID NO: 618449 - DNA, 194 bp, Homo sapiens
atgccgtgtgtcctgtatcatcattagcgcatccctgggagtcgtgtggttgtatatgagcgtgagggtatagctggtgccgatgtatgagccccagagctgggacagggccggccggggctccctcctgcactcctacacgcccaagatggctgtgatcccctctactccgccgaactcgcttatattacgtt

SEQ ID NO: 618450 - DNA, 152 bp, Homo sapiens
acccaacagtcatgcagggatgccttctcatgagcatccaggtgagtggcacttgttctctcaagcaagtgaggagtctaagtgcgtgatacctgcttcgggtgataatgcttgaagtgaggttgttcccaggcataggccttcttcctccg

SEQ ID NO: 618451 - DNA, 971 bp, Homo sapiens
cactggagagtgtcatggaggcctacgagcaggtcccaaaagggaccccgtgcaagctgaaaggcgtcgccagcagctgggagtgcaccaagcggcaagaagcaacacacagcacaggcacacacagcacaacagcgcaacactccgtggcacagccacatgggcaacgcagcaaacacagcacaccgcaggcaggcagcacagcgtgccgctggccctggaaccacagcgtgcaccctcgtgaccccagggcggaacattccgcagcacacacatgccaggcagcacagcgcgcacaatcggcaacaggcatccgtaacagcacaggccatcctaaacaaccgacaccaatgcaacgcagcagtgcgcagcgcacttccaagccagcaccaccctggcacaacacctccactgcgcagccattcacgcaccattccgcaacagtccagctcgcgcaacgcacagtcagccagcacatgcacccccaagtactggacgccagacatcagacggagtatcagccaacaacggccacaactcgagcgggtctcgtcgtcgtcgtactccattcagggtatactatcttggaacacacttggcttacaacaacacaccatctgcatcattctcggcctaaccaggacgtggcattattcgcaagacctgtggtacggcctaccatttctggcaaacttgcatctaacacgtaaagactcgatcctaggtacctccaggttcaagggcctttcctttgggccaacaatacccgacagattacaccccattaaccgtaccgggcattggacaacgcctttcctaaacgtcttatcccagcaggcgtaccagacccattcgatgtgatctgagagtcaatgtccaacactggtataaaccccgcagtagccactgtaaacgcctctgcaggcccgaccaagctgtattctccgtggccgcagcaccaccccgaggga

SEQ ID NO: 618452 - DNA, 147 bp, Homo sapiens
agcacatgtaggcccaaaaaacaggaatgcagacaacatgcatcccctgggtccataagttacatgtgtttttttagggtccccgttgttttgatgttattcatggaaacccttttggggtaaaaacagtcccttaattccttggca

SEQ ID NO: 618453 - DNA, 492 bp, Homo sapiens
tagtcccaatttctcctgtactgggagaaacctcctagcagagatcgagaggatcagcgtcatacagataagctccaactggacatctaggatgggtgccgctctgggacaaagcttccagagagaaggaacaggcagcaatctttgctgttctgcagactcagctggtgatacccaggcaaacaggatctggagtggacctccagaaaactccaacagacctgcagcagaggggcctgattgttagaaggaaaactaataaacagaaagggatagtaagaacatcaacaaaaagcacgtccacaccaaaaccccatccgaaggtcaccaatgtcaaagaccaaaggtagatacatccacaaagatggggagaaaccagcgcaaaaaggctgaaacttgcaaaaccagaatgtctcttctcctccaaaggttcacaactcaacaacaagggaacaaaactggacagagaatgagtttgacaaattgacagac

SEQ ID NO: 618454 - DNA, 405 bp, Homo sapiens
ctgatgtttaggccactggcgataggtgatagtctcaccgctggtgatggtctcaccacttggcaatagtctcactgcttggaatagtctcaccagctggtgataggtgacagtctcttcaaagtcaccaaaattagtacggaattgatgggttcttggcctcactgacttcaagaatgaagttgcagacccttgcggtgagtattacggttcttaaagatggtgtgtccagagttgttcattcctctcggtgcattcgtggtcttgctggccccaggagtgaagttgcagaccttcgcggtgagtgttacagctcttaaaggtggcacggacccaacgagtgagcagcagcaggatttatcatgaagaccaaaagaacaaagcttccacagcgtggaagggaac

SEQ ID NO: 618455 - DNA, 957 bp, Homo sapiens
  misc_feature (23)..(23): n is a, c, g, or t
  misc_feature (146)..(146): n is a, c, g, or t
  misc_feature (151)..(151): n is a, c, g, or t
  misc_feature (171)..(171): n is a, c, g, or t
  misc_feature (196)..(196): n is a, c, g, or t
  misc_feature (253)..(253): n is a, c, g, or t
  misc_feature (320)..(320): n is a, c, g, or t
  misc_feature (944)..(944): n is a, c, g, or t
ggcgtgtaccagaatttatcctngaaaagataccagcccatgttgggtattgatggtctctgtgctactccatcactggaaggctttgaagaaggtgaatatgaaactcctggtgaatataagagaaagagaagcacaaagtgtangagcntttgttagtggagcataaancaaatttaaaccttaacagaacacnttctattacacctcaagaagaaagaattgcccagctatctgaatcaccagtgactcntaccccaaatgctaagcgtacatgccagtagattctctcatgtttctcagtagcaaaggaagtccancaagcacaattttaactttgagctgttgccaagtaatctcttcaatagcagttctacaccggtatcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgncttaaaaaaaaaa

SEQ ID NO: 618456 - DNA, 3686 bp, Homo sapiens
  misc_feature (23)..(23): n is a, c, g, or t
  misc_feature (146)..(146): n is a, c, g, or t
  misc_feature (151)..(151): n is a, c, g, or t
  misc_feature (171)..(171): n is a, c, g, or t
  misc_feature (196)..(196): n is a, c, g, or t
  misc_feature (253)..(253): n is a, c, g, or t
  misc_feature (320)..(320): n is a, c, g, or t
ggcgtgtaccagaatttatcctngaaaagataccagcccatgttgggtattgatggtctctgtgctactccatcactggaaggctttgaagaaggtgaatatgaaactcctggtgaatataagagaaagagaagcacaaagtgtangagcntttgttagtggagcataaancaaatttaaaccttaacagaacacnttctattacacctcaagaagaaagaattgcccagctatctgaatcaccagtgactcntaccccaaatgctaagcgtacatgccagtagattctctcatgtttctcagtagcaaaggaagtccancaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggtcatgccattttcctgcctcagcctcccgagtagctgggactacaggtgcccgccaccacgcccagctaattttttgtattttcagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctggctaaatttatattttaaattattacaaattacacatcctttgagggaaagagtattatgaacg

SEQ ID NO: 618457 - DNA, 106 bp, Homo sapiens
tttccccccccccccattggggtggccaatttttcgggtttgcccggggttttttttaaaattttttttttttattatttaaattaaacccccccttgggggttta

SEQ ID NO: 618458 - DNA, 627 bp, Homo sapiens
  misc_feature (6)..(6): n is a, c, g, or t
  misc_feature (478)..(478): n is a, c, g, or t
  misc_feature (485)..(485): n is a, c, g, or t
tctttnttggccagttgggggaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagggggggttgaacaggagaagcaagcaggcgaatcgtaatgaggcgtgcgccgccaatatgcactgtacattccacaagcattgccttcttattttacttcttttagctgattaactttgtaagatgcaaagaggttggatcaacgctaaatgactgtgctgcccctttcacatcaaagaactactggcaacgaaggccgcgcctgccttttccatctgtctatctatcttggctggcagggaaggaaagaacttgcatgttgatgaaggaagaagcgggcgtgaagaagtgccgttgctacaacagtgnaatttanagtaaaaccaagctggcccagggcgtcttgtaggattggaagacaattattgagggggacacgttttagatggcccaaaacaccagaaatatttgacatggcccactattttcaataagcaattaaacagtctaaaaacgga

SEQ ID NO: 618459 - DNA, 3686 bp, Homo sapiens
  misc_feature (23)..(23): n is a, c, g, or t
  misc_feature (146)..(146): n is a, c, g, or t
  misc_feature (151)..(151): n is a, c, g, or t
  misc_feature (171)..(171): n is a, c, g, or t
  misc_feature (196)..(196): n is a, c, g, or t
  misc_feature (253)..(253): n is a, c, g, or t
  misc_feature (320)..(320): n is a, c, g, or t
ggcgtgtaccagaatttatcctngaaaagataccagcccatgttgggtattgatggtctctgtgctactccatcactggaaggctttgaagaaggtgaatatgaaactcctggtgaatataagagaaagagaagcacaaagtgtangagcntttgttagtggagcataaancaaatttaaaccttaacagaacacnttctattacacctcaagaagaaagaattgcccagctatctgaatcaccagtgactcntaccccaaatgctaagcgtacatgccagtagattctctcatgtttctcagtagcaaaggaagtccancaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggtcatgccattttcctgcctcagcctcccgagtagctgggactacaggtgcccgccaccacgcccagctaattttttgtattttcagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatatactatgtttttaaagataatttgcacaaacacgtttgtgtctgttctgtccaatatagatttggcaattatttaaagagggataatcttgaaaaaaattaaccaaggtgatttcttatagtgccagtaggtgtacctgtgtgttcactcgaactaagaacaatggttaaggcagaataatgactaaaatatgttcatatattatgatgtggaaataattgataacttttaagcatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctggctaaatttatattttaaattattacaaattacacatcctttgagggaaagagtattatgaacg

SEQ ID NO: 618460 - DNA, 82 bp, Homo sapiens
agcgagtggggcaggcgcagtcggaagcagtgtacccggcagtgtagcggcggctcctgtacccccggcgcggacctaaagg

SEQ ID NO: 618461 - DNA, 282 bp, Homo sapiens
  misc_feature (10)..(10): n is a, c, g, or t
  misc_feature (177)..(177): n is a, c, g, or t
  misc_feature (221)..(221): n is a, c, g, or t
  misc_feature (249)..(249): n is a, c, g, or t
agaactggtnaaatttttaaaaatgcgaaggaggggaaaagaaattaggaagttgaaaatgtttgttgattattttactaaaattcctggaaatcaagtaatatcattaaagcagatcaaaaaaacctgatagaagtacaaacatagtttacaaaaggttaacaactaaattataangatagccaatagaataaatatgtcacctttcacacatatcagangtatacttaaaacaaagggaagtacacngacaacataatgaaagactgttaagggaacata

SEQ ID NO: 618462 - DNA, 2519 bp, Homo sapiens
  misc_feature (23)..(23): n is a, c, g, or t
  misc_feature (146)..(146): n is a, c, g, or t
  misc_feature (151)..(151): n is a, c, g, or t
  misc_feature (171)..(171): n is a, c, g, or t
  misc_feature (196)..(196): n is a, c, g, or t
  misc_feature (253)..(253): n is a, c, g, or t
  misc_feature (320)..(320): n is a, c, g, or t
ggcgtgtaccagaatttatcctngaaaagataccagcccatgttgggtattgatggtctctgtgctactccatcactggaaggctttgaagaaggtgaatatgaaactcctggtgaatataagagaaagagaagcacaaagtgtangagcntttgttagtggagcataaancaaatttaaaccttaacagaacacnttctattacacctcaagaagaaagaattgcccagctatctgaatcaccagtgactcntaccccaaatgctaagcgtacatgccagtagattctctcatgtttctcagtagcaaaggaagtccancaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcgcctggctacagagtgagactttgtctca

SEQ ID NO: 618463 - DNA, 427 bp, Homo sapiens
  misc_feature (21)..(21): n is a, c, g, or t
  misc_feature (37)..(37): n is a, c, g, or t
  misc_feature (56)..(56): n is a, c, g, or t
  misc_feature (62)..(62): n is a, c, g, or t
  misc_feature (100)..(100): n is a, c, g, or t
  misc_feature (108)..(108): n is a, c, g, or t
cccaaattcgattgaattccntaatattgctaggcantgttttaaaaacggggatnaaatgnaaaacaaaacacaaaacaaaaagtcttcagtccctttnaaaaaatnaaacagcttcctgacacatagttcaccctaccgtagagttcaccatttaaaacgtagcggtgcctcacgcctgtaatcccagcactttgggaggccgaggcgggtggatcacgaggtcaggagatcaagaccgtcctggctaacacggtgaaaccccgtctccactaaaaatacaaaaaattagccgggcgtggtggcgggagcctgtagtcccagctacttgggaggctgaggcaggaggatggtgtgaacccgggaggtggagcttgcagtgagccgagattgcgccactgcactccagcctgggcgagagagctag

SEQ ID NO: 618464 - DNA, 619 bp, Homo sapiens
  misc_feature (499)..(499): n is a, c, g, or t
  misc_feature (572)..(572): n is a, c, g, or t
taagtttgggggtggaatatcagtatgtgaatgaataagggcgaaaactccataaagccagacaaaaaaaaacccaattaccggggaaagaacaaggagggcatgccaaataattctcacatcttacacagagccaggaactattcaagtttctaccagccaaagaacggggacgtcttggaacacatgtgggacatgggctagagaccccagaacagctattcacagagtgaaaccacacggagacaaataacgggtccgggaagccagtggcgagggtgcgtgcccataggcccactcgggaggctgaggcctgagcattactggagaccaggagttcaaggccagccggggcaacatagaaggaccctgtctctaaaagaaagagaaccgggatatgagggaacggcttttaaaggtagttaagggaggtgcctgggagaactatttatgcaaaattagggctacagtctcagtagaagtccacagtagagaaggngttatccaaaaggtttggaggaggctgagacaggcagaccatttgagcccaggtgctggagacctgccagggnaacatagtgagacccgtctccaagggtaccggctcgatcgacgcaga

SEQ ID NO: 618465 - DNA, 2364 bp, Homo sapiens
  misc_feature (23)..(23): n is a, c, g, or t
  misc_feature (146)..(146): n is a, c, g, or t
  misc_feature (151)..(151): n is a, c, g, or t
  misc_feature (171)..(171): n is a, c, g, or t
  misc_feature (196)..(196): n is a, c, g, or t
  misc_feature (253)..(253): n is a, c, g, or t
  misc_feature (320)..(320): n is a, c, g, or t
  misc_feature (2076)..(2076): n is a, c, g, or t
  misc_feature (2098)..(2098): n is a, c, g, or t
  misc_feature (2100)..(2100): n is a, c, g, or t
  misc_feature (2104)..(2104): n is a, c, g, or t
  misc_feature (2122)..(2122): n is a, c, g, or t
  misc_feature (2154)..(2154): n is a, c, g, or t
  misc_feature (2171)..(2173): n is a, c, g, or t
  misc_feature (2185)..(2185): n is a, c, g, or t
  misc_feature (2215)..(2215): n is a, c, g, or t
  misc_feature (2225)..(2225): n is a, c, g, or t
  misc_feature (2239)..(2239): n is a, c, g, or t
  misc_feature (2251)..(2252): n is a, c, g, or t
  misc_feature (2292)..(2292): n is a, c, g, or t
  misc_feature (2294)..(2295): n is a, c, g, or t
  misc_feature (2310)..(2310): n is a, c, g, or t
  misc_feature (2320)..(2320): n is a, c, g, or t
ggcgtgtaccagaatttatcctngaaaagataccagcccatgttgggtattgatggtctctgtgctactccatcactggaaggctttgaagaaggtgaatatgaaactcctggtgaatataagagaaagagaagcacaaagtgtangagcntttgttagtggagcataaancaaatttaaaccttaacagaacacnttctattacacctcaagaagaaagaattgcccagctatctgaatcaccagtgactcntaccccaaatgctaagcgtacatgccagtagattctctcatgtttctcagtagcaaaggaagtccancaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaaaggntggaggggaagccacccccagngntccnaggtggaaatgccttccncccttaaggggcctaaccaaacaaggtttttntaaaacccaggggaggnnncctttaaccctnggattggggcccaaaagggttaaagggggncccccctttngggggttgggcccntgggcccaaaanncccatggggttttagggaaaaaacccccaaggttgggaanannaaccaaccatggggngaatttcctncctggggggaaaaaaaaccaggggcccctaggggggcccaccca

SEQ ID NO: 618466 - DNA, 945 bp, Homo sapiens
ctggatacgcactccacatgtcgctatttgtattttatagagacgggttcacttcctcagctgttcaactccgctcagtgatccaccacctcgcctcccgaagtgctggactacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctggctaaatttatattttaaattattacaaattacacatcctttgagggaaagagtattatgaacg

SEQ ID NO: 618467 - DNA, 894 bp, Homo sapiens
cagcgtggaggtctatctcgacgtgtgatccgccgccctcagcctcccaaaaggcgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctggctaaatttatattttaaattattacaaattacacatcctttgagggaaagagtattatgaacg

SEQ ID NO: 618468 - DNA, 309 bp, Homo sapiens
attgctctatctcttgctcatccctgtgctcctcctcctccgggcaacaaacaggcgatcggccggcgagcgagccgcagcggacaaccatgggggccgtcccctcccttcgcctccgaacaagctccctctcatcggccacctgcacctggtcggccccgacccgcacgtctccctcgccgccctcgccgccaagcacggcgacggcggcctcatgctcctccgcctcgggcagacgcgcgccctcgtcgtctcctccccgcgcgccgccgaggcggtcctgcgcacgcacgaccacatcttcgcctc

SEQ ID NO: 618469 - DNA, 1041 bp, Homo sapiens
  misc_feature (23)..(23): n is a, c, g, or t
  misc_feature (146)..(146): n is a, c, g, or t
  misc_feature (151)..(151): n is a, c, g, or t
  misc_feature (171)..(171): n is a, c, g, or t
  misc_feature (196)..(196): n is a, c, g, or t
  misc_feature (253)..(253): n is a, c, g, or t
  misc_feature (320)..(320): n is a, c, g, or t
  misc_feature (1028)..(1028): n is a, c, g, or t
ggcgtgtaccagaatttatcctngaaaagataccagcccatgttgggtattgatggtctctgtgctactccatcactggaaggctttgaagaaggtgaatatgaaactcctggtgaatataagagaaagagaagcacaaagtgtangagcntttgttagtggagcataaancaaatttaaaccttaacagaacacnttctattacacctcaagaagaaagaattgcccagctatctgaatcaccagtgactcntaccccaaatgctaagcgtacatgccagtagattctctcatgtttctcagtagcaaaggaagtccancaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgncttaaaaaaaaaa

SEQ ID NO: 618470 - DNA, 1151 bp, Homo sapiens
taacaaccagtcatcaacagacatttatggaactcctgatgtgtgccaggccaggccccagggaggagcacacagaggtataaaattaaagtccgggcccttgaggaacttcgggaatggatctggaggaaaaaaaaagtagggtgggccagaaagctcttcgtgtacaatcccgaagggctatactcccctactctcggtggggatctcgaggaaaagttggggagagcccagaaagaggggttacctatgtccaggtgatccaagaacataccagtgccacgaggctacacttgctaccaagcacagtggtgccagaagtttccaccgcacaatataccgagggacccacgtgtgttaccgagcaccacccagaggggtgcccacttagtggtgctccaccatgcgtggggtgggacataccgagtgctggcagacagtgcccaattagtgcagcacaataagcggccacaaggccgccaccacagtgcggcacaacaacagactaccaaatactcgcagcaaaagaatacaacggggcagcaaacgaaagaaaccagcggagcgacacaaaccgcgccaagaggacacatcactacaaagaagcagctacaacaacagagcgaagaagcagcagacaagaacaacaatagacacacacaccaaaacatagcagcaccgcaagcacacagcaacaactacaccaacacgaaagcaacaacactactagcaacaccagcacacacccacaacaacacacggcgacacgcgccgacaacagaacaccacccaaaacgagagacggagcaacaccaccatcaaaccaaacagcacaacacacaccacaccatagaaacaaagacgacgagcaagacacaacaacaacacccacacactgcgcaacaaagcaatagaaaccagagagcgagcagacaacacacaagagaagagacaagcaccctaaagcaacaacgcagcgaatgacaaaaaacacacacagcacccaaagaggaaataaggacaccaacagcacagacgaatcaaaaaagggaataagacgcagcccacaatcacacaacacacaagacggacacaagaaaaagagagaagagataatcccacacacagaagagcaaacacacaaacaataa

SEQ ID NO: 618471 - DNA, 114 bp, Homo sapiens
gtagtcttacagctgtgttaccgttaaaggttttttttttaatatgtattaaatcaattaatcactgttaaaagctttgaatatctgcaatcttggccaaggtacttttatttg

SEQ ID NO: 618472 - DNA, 409 bp, Homo sapiens
  misc_feature (189)..(189): n is a, c, g, or t
actcccggagggggttcgatcctctgaagcttgagatctatctcaccgacgaagacttcgagtttgcactagacatgacgagggatgaatacaacgccctgcccgcctggaagcaggtgaacctgaagaaaagcaaaaggcctgttctgagttgggagacggcaaaagagcctacgggtcacgtgcaanaacaccactttaccagggaaattgggaatatattttggggctcgggtttttcacaaaggatttttcaatcagaggtttcaggaccctacattgttaaaggtactcctttttcccgaggtggtgattttgtaaatgtcaagggacctcttttggaacttctttcaccattcagggggtgtaggattaataaaggaccttttatggcactcagcggacgcct

SEQ ID NO: 618473 - DNA, 627 bp, Homo sapiens
  misc_feature (36)..(36): n is a, c, g, or t
  misc_feature (38)..(38): n is a, c, g, or t
  misc_feature (583)..(583): n is a, c, g, or t
tgagattattcagctagcgttagggggcagcgtgtngncccacgccctcaacgcctctgtctggggcgtcggctgctggttttgtgtccacacaggaagacagaattagggaacttgctccccacggcatgattcaacaggatgagagacgcaggcacggatgtaggaggtggtggtgctgttgatctcattcaggagagcccaggcgttggggagccccgtgacgccggtgttccctcccgcgtggatgggcaggggctgaacgtgagtctccatggctcttctcgggccaagcccatctccaggacatacctttctcctgtcgcttgttagacgctgtgcactgaagacctagccttacccaaagggaagtcttgccttgggtcttggctggagggtggtgatacctcaggtcctggaatggcccctggtagtatctttgctggcctgggggctttggatggttcaccgtctaacaatgtgatttaaggtgagggtcttggaacaagtgagatcagttccaacttccaggagggagcctgagaaatagcagatagatcccaaatactctctgtctgtctgnctggctatctatctatctatctatctatctatctatcatctatc

SEQ ID NO: 618474 - DNA, 649 bp, Homo sapiens
ggcgcctaatctcaggtggtccacctcgagaccccttgagcaccaacacctgagtccccgcgacgcggcccgttattcggctgccgactagatgatgaagagaaacaatcatgaaccaggaaaaactcgccaaactgcaggcacgacagtgcgcattggtgggaaagggaactgctcgcagaaagaagaaggtggttcatagaatcagtgcacagcagatgacaaagaaacttcagttctccttaaagaagttaggggtagaagaatagtctcgtggtattgaagaggtgaagtatgtttacgaaagccaaggaacagtgatccgactttaacgaaccgctaaagttcaggcgatctctggcgagcgaacacttgcaccattacaggccatgctgagacaaagcagctgagagaaatgctacccagcatcttaaaccagcttgagtgcggactcgtctgactagttcaacggagactggccgaagctctgcaccaaacaactctgtggatggaacaagcaccacttgctacctgggagcaggcatgcactgactgactgacagttccacgatctcgtggaccactcactgcatgcggcttccacgaatgagcgcacacctgaccttgacgtcaactttctgcaccgata

SEQ ID NO: 618475 - DNA, 136 bp, Homo sapiens
cgctatatacactgcaagaacatacccgattgttataccatcgacactataaagaaactgcattcactaatgtgaacgctaaaccgttatacaacatcatgacaggataaatttcacatgtaacaatattaacctt

SEQ ID NO: 618476 - DNA, 107 bp, Homo sapiens
ggtacactggggcgaggtcggaaagcagaggcctgagaagccagaggcaggtggtatgagagggtggaaagtgagcagcgggtctgggcttggagctcgcacacgct

SEQ ID NO: 618477 - DNA, 237 bp, Homo sapiens
tacagcacgtacgcacacagacatggggaactataggatagccgtcacaccgagatagcagcaacgacgtacacgggccatagtacgacgtaacacatataaatagtacacacagacgcggagataggcatacacacagacggtgctagcatgtaacacacagacacagagacaacacacaccatgacaacgacacctaatagataataggcaccaacatacacataggcacgcgac

SEQ ID NO: 618478 - DNA, 460 bp, Homo sapiens
atttatgtgggctcttacatctacgtctgtctatcctgtcttgaacgtgatctaataatgggctctactccatgtgtaaagatatgtgctactatatccttctagaatgggattttgagctagacctggatttagagcgagtatgggaacgagatcgaccgccttttctttcattgcacatttccagactctggttcaatagctgctgagataaatgactgagcttctcgtactcgcttcattacttcttctaactccttagctgcagcctgcggtgtcatctcagggggttttactattgcattgttggcagtgatttattttcagtggcctgtctccaaacataactccattaaaagcaagggcccttggtacagaattttggtctgccaattccacaaacgcacaccgagttggctgagtctcatcacctgccatccgcacaaacttcacttctcca

SEQ ID NO: 618479 - DNA, 597 bp, Homo sapiens
  misc_feature (409)..(409): n is a, c, g, or t
  misc_feature (516)..(516): n is a, c, g, or t
gtgtatttaaatatatcatgaccctcaaacaaacgtaagatgcacatttgtcaaaattttatttaactccctaattaatgagggaaccagtaagatgttgcaatgagttcaaaggcaaattcaaagtatcacacatatataggtcaaccatgaatgctaaaatgaatttagaaagagatgcaaaactggcttcttttgaaaagaaggggaatcaattgtccttacacagattttacatttacattcctatcagttgtctacaaatcagagttataaaattgttcaaagacaatgaaagtcacagaggtcccatagaatcagataatccagaaaggtgtgctagataaaaataaagacactcagtaatctttcggttcattttaaagtcttaaacaatttttcctcgcanatctctttgggacactgatattgtcctaatagaattctactgagagagggcattaagggccccggaagtctcctttattattattattattattatactttaagttntagggtacatgtgcacaatgtgcaggttagttacatatgtatacatgtgccattgctgtgtgctgcacccattaactcgtc

SEQ ID NO: 618480 - DNA, 328 bp, Homo sapiens
  misc_feature (26)..(26): n is a, c, g, or t
  misc_feature (35)..(35): n is a, c, g, or t
  misc_feature (38)..(38): n is a, c, g, or t
  misc_feature (56)..(56): n is a, c, g, or t
  misc_feature (71)..(71): n is a, c, g, or t
  misc_feature (86)..(86): n is a, c, g, or t
  misc_feature (104)..(104): n is a, c, g, or t
  misc_feature (118)..(118): n is a, c, g, or t
  misc_feature (130)..(130): n is a, c, g, or t
  misc_feature (172)..(172): n is a, c, g, or t
  misc_feature (180)..(180): n is a, c, g, or t
  misc_feature (196)..(196): n is a, c, g, or t
  misc_feature (199)..(199): n is a, c, g, or t
  misc_feature (208)..(208): n is a, c, g, or t
  misc_feature (217)..(217): n is a, c, g, or t
  misc_feature (238)..(238): n is a, c, g, or t
  misc_feature (242)..(242): n is a, c, g, or t
  misc_feature (268)..(268): n is a, c, g, or t
  misc_feature (320)..(320): n is a, c, g, or t
tcagggacacagaacaaatctgaaanatgtttaantanagacaactattgacttanaaatggaagggaganaaaagaactggcccnggagaaagtttacttggngcttctgaaacccncgtgcagcagcnagtcagcaaacaagccccgagagaggctgggggctggcccanaggcttgnggctggggtcttttancancagccaaanccagctttnttcaatgagggtcagaggacnccanaacctatcttaaattgtgtgagtttncccctggaaggtttcaagtccaaagtcttttttttttttttttttttttganaaagtttt

SEQ ID NO: 618481 - DNA, 546 bp, Homo sapiens
ctatagaggggctcacagtgttacccttaactacaatatttaatgagcatttcccccccatcccctggagagagaggaatcaaaaaccccttcatgggatattcgcccccctcacctctttcaattgcccctttctctttttttgaatttgaactcgggagttactgttttccagtttggcggggacggggcttggggggtttttcttttggtgggtcccccttcttttccccttttttttttttttttggtgggctttgggttaggaggctttgatttgccatttgacatgaccccaaagttggtaaatgcttttgttgacttcccgccaatgggatgggggaaacacaccagttcttggtaaagtccttgggaaaaaaagttggatttttttatttcgagagaatctttccttttcccagggaggcttttttccttttttgccccgtttccttatcccttgcggtagagggctttttttgcattcatgcagactatgttgcaagtttgtttcctttagtaaactgaaaattattgtttaatcca

SEQ ID NO: 618482 - DNA, 207 bp, Homo sapiens
cttatatttagcgggcgacggatctgacggtatagacacccccgggtaggaagccgaaggcaggagttgttgttgctgaggggctagtcgcagccgccggaggcctccggacagacgccagagcgaggagggcgctacgcgacctaggcaagatgacccagttcctgccgcccaaccttctggccctctttgccccccttaaactcg

SEQ ID NO: 618483 - DNA, 411 bp, Homo sapiens
tctggttgatcgagacacttgacacatggttcacgtcctcactggataacctcctcacaatctaagccagacgtagcagaaatatcgcgtctaacagtgcatgtggtaccacaatataccgtttgagctcagacatcatgttctatcttgtgtaatttgcgtcacaggttccacaggattgagcttagcacgcgaaggttagttagcatattccgattgtcagtctcatctatatatgattggtgctcttccagttatgaggagtactcattcgttacgagtccaatatcggggactagcctctgccgccagtgacaccggtcttccagcaactacatgtcctgtaaggaagaagacaacgtctgggaaacagtgtcctcagtgttctttacctcatcggctcgatatcag

SEQ ID NO: 618484 - DNA, 204 bp, Homo sapiens
gttacgggctacccagagcgaggaggtggcgggcaggactccgggaatgcgagcaggcccttattctcccagtggcctcggacagaatgcttgacctccaagctgttttaaatctagtagataagccagatcctgtgttgccataagcccgttggccagcatttaacgtgggaatgcagctagctgggactgtctgaacacttt

SEQ ID NO: 618485 - DNA, 578 bp, Homo sapiens
  misc_feature (207)..(207): n is a, c, g, or t
agggagggtggcccccccccggtccccaaagcctgcagaggttcggggaaggagttggccatattttccgttggggcccccaacatcaagggtggcccgtgaaggaagtctccctccctccctcggccccccgggtagggggttattgtagccacccaccccagcttttcctcctcttttataagttccggccagcagtttgcaaantggggaagggggatgccttcctcgaccagttccgtaaggaggacattttcaaggccaccttttatgaaatggcccggtttaggggggttgttcagaggcccttttatgagtcccctgcggccccccaaccaaaatactttttttgggggccccaggagcagtattttccccccccccaaccccttttccttttagatgggaaccacagcctgggccaggcctgttccctttgacccagtttcccctcatgggcaaccctttttggtttttttccagcccgtgagggggtcctgtttccccccttccaagccccaacttttaaaaagcttgttccgctctaaaaaagtaaaaaaggttgggggtcggtttta

SEQ ID NO: 618486 - DNA, 298 bp, Homo sapiens
  misc_feature (247)..(247): n is a, c, g, or t
gagtatagggggagggacagatagcttcggagactgtctctcacacaaggactagtcatctcagcactgagcctccctcacttggacactcaggggacgcacagtgaagtggatggacacttcgccatccaggcagaactaagccaggcataaccacagccaagcagattaaccccaggcagaccgattaaaagacctccagataggcagacagacagattgtaccacctacctgggcagacagccnaagcttcagagatacagtccacaggtggacaaagggatccccagccagaga

SEQ ID NO: 618487 - DNA, 943 bp, Homo sapiens
atgaccctgatggagataaatatcatactagcattgaccatctcacttctgggaatactagtatatcgctcagaccgcattatgggctccctaagctatgcctagaaggaatgaaagtgatccggcggttgcatagcatcagctcacgctcgatgaacgccatggaagaacgaatgccctcttgtagcccaatgatggtcgcctgatggccatcacttgaggtccttaggcccgctcgtgttgaaaaccgaagagggtggggcgctaggcccctgaacgtagatcgtcatttcttccgaaggcagttatggtgcctcaggaattggccgtactttttgggctgtaaatacccctatcgtacgcgttgtggctcagacaataggtgaacctcaggtcccccgaaagcatatttgacgcaagttaactttagccgaactggaacggggtgaagcttgcgcgaagagagacataccacctatttaacgtttggtcctcttcaaaaagagaagactcacaatcaccacgagctcgtaaattttagttgacggccattcgactccccgcttcctaatctcaattttcattgcaaggccaaatgattctacaaaaggacaaaccctaatattggggggtgtgttcaacccccatatggcgtttattgacctttcgcagataagcccgcgagaaagaaacacggcactcctttcgcataatgtaactgagaccctgaaacgtggatttccgctagggccctgcacagatgtgctagtggggcaaaggccaaaagagccgggaaggttgagtgccaaggtggaaatgccaacttatgtccgagggggaagaaacaggagggcttcttaacagtcggcgtaagtgactaaaattctttccccttaaaaaagggtcgtcgcttcagagtggataccccgtgtcagagagcgaa

SEQ ID NO: 618488 - DNA, 172 bp, Homo sapiens
atctgaggatccctgtgacgagacgacctgaaggtggagctgtccagctgcgcgtcgccaaagtgacaggcggtgcggcctccaaggctctctaagatccgagtcgtccggaaatcatgccgtgttcacagttttaaccagcacttccagggaagaaactcaggaattctac

SEQ ID NO: 618489 - DNA, 1229 bp, Homo sapiens
  misc_feature (523)..(523): n is a, c, g, or t
  misc_feature (540)..(540): n is a, c, g, or t
ggcttgtccacgcctgtactccaggactaccgcagaccgatgcatgggctgtctagactagggccgttcatgacagaggcatcattgaccagagatcactgggcgagtctggaatcttgcccgcgagtgggggcccaatgtattaccacacggtcctaactgatggtctctgcacagtaccacagtctgcgcagtgatcaagtctctcatgaatcccagtcgtactgtacgatgtgtgctatgcactccttactatagctccaagctcacatcagactggagcatcgatgtggagtactgacaccctaggcatggcccctgcaagtgccgtccgcaatctcctcgcgtgcccacctggcatcatccctcatcctggggaagccagcgccacttaattgactcgccgctcaatggaacttcacagtccctgcgatgaaggagcagaggggtgttgtgatgcaactgccaagagacagacaacctgtggtgtgaggggacacctggctccatcaggtcccgtcgnagcccgtgtcggctcgnctcatccggggaccttcctctcgcacgcgtcttcgacgcacatcggcggcatcttcttgtatccttctatcgaagtaccttctgcattgaccatctttcgccgggcgtccatggcccagcggcctctttcctacgtacctcggactgacggggcggtctgacaagtgccgtgggttgggcttcgccgggcttcaatttggtggcgtgtgacgaaggggatcacccatgtgtaaaggccccattgtaacgcaaggtgccattcccgcatactcgacattactcttgcctttgctcgctttcgctccgcgttcgcgctttcgaccagaggggggggggcgcacctcgcttaccgaaagtgctatatggccaccttatttaggcggttgccaaatgagttatgctctttggtggtgtcccctccttcaccaaggccaagggggccccgttggggagaacacaaaccaaattgggtttcccccggcggggacctagtataacgttcccccccgtgggacgaacggggttgtccctaggacagacggaaaagtgttggccttcccgaagagaccccggagtaggagacaaagggagatttggcaccccccttgtgggcgtttaatagaaacgcctggaaagggggccttaaaccgttctcaaacttgggggtttatattccacaggggtgtggg

SEQ ID NO: 618490 - DNA, 431 bp, Homo sapiens
  misc_feature (252)..(252): n is a, c, g, or t
  misc_feature (360)..(360): n is a, c, g, or t
  misc_feature (419)..(419): n is a, c, g, or t
  misc_feature (422)..(422): n is a, c, g, or t
gcacgaggcgcccccaggccccggtgtccactggcatgatgggggcatggacctggcaagcctccgcgccgcctaccggcgcatcgccccccacacccaccgcacccccctcctcacctcccgccttttggacgagcttttgggcaagcggcttctccttaaggccgagcacctgcagaagaccgggagcttcaaggcccggggcgccctcgccaaggccctgaccctggaaagccccaaggggctcctcgncgtgttcagcggcaaccacgcccagggcgtggcctacgccgcccgggtgttgggcgtgagggcccttctggtgatcccggaggaagcaagccccctgaagaaggcggnggcccgggcctacggggcggaggtggtggaacggggggtcccgccatcacccccacccnggngggcgaggg

SEQ ID NO: 618491 - DNA, 780 bp, Homo sapiens
gcacgagagaagaggaagccgcagcagccccagcgccgaccagcagggggcacaggacagagaagaggaagcggctacagccccagcgccgaccagcagggggcacaggacagagaagaggaagccgcagcagccccagcgccgaccagcagcgggcacaggacagagaagaggaagcggctgcagctccagtgccaaccagcagggggcacaggacagagaagaggaagcggccaaggccccagtgcccgaccagcagctttcacaggacagagaagaggaagccgcagcagccccagcgccgaccagcagcgggcacaggacagagaagaggaagcggccaggccccagcgccgaccagcagcgggcacaggacagagaagaggaagcgcagcagccccagtgccgaccagcagcggcacaggacagagaagaggaagcgcagcagccccagcgccgaccagcagcggcacaggacagagaagaggaagtgaggaaatggaagaagagggttgacctgagctgaaggacatgaacttccacgtgaaatagccccagggccgggcacacgaggtcaggagttcaagaccagcctggccaagatggtgaaaccctgtctctactaaaaataaaaaattagctgggtgcggtggcaggcacctgtaatcccagctactcaggaggctgaggcaggagaatcacttgacccaggaggtggaggttacagtgagccagatctcaccactgcactgtagcctggcaacagagcaagactccatg

SEQ ID NO: 618492 - DNA, 160 bp, Homo sapiens
ccatacgcctgcattcctttccaatactcttttgtctttcacgggatcctcaatacaaacaacccaactaatccacgatatgtgttcataacagtcttttttccccctcaaaaggcgggaaggcccacttcaaacctccaggaacacgaccctattcacc

SEQ ID NO: 618493 - DNA, 106 bp, Homo sapiens
tgacctgaggttccgtgcgatgtgcgtgccatgtccatattcagaagctatcgttataatttgttttataattgagtagtacaagcgagaaaaaaatacggaggca

SEQ ID NO: 618494 - DNA, 239 bp, Homo sapiens
agtggtgggagagcaggcaactatcattgaatatcagaatcttgttgactacaataaggggaaacaaggacagacacaattttatatggcatgcagatgagccttcttaatgctacacagattcactaaaactagttgtcacaacatagagacaaacagtaacatcatgaagacagccatcatatgggcatccatctagtagatcgaccatgcaaggacatgccaagactatggcaact

SEQ ID NO: 618495 - DNA, 485 bp, Homo sapiens
ctcccactggttgctgtaagcctgtggtacagagaggtgaagcccagctggactttccataggtcgagagtgggacattagccgagctgttctgtctagctaaaggattgtaaatgcaccaatcagcactctgtgtctagctaaaggattgtaaatgcaccagtcagcactctgtaaaaacacaccagtcagcactctgtgtccagctaaaggattgtaaacgcaccaatcagcactctgtgtctagctaaaggattgtaaatgcaccagtcagcactctgtaaaaacacaccagtcagcactctgtgtccagctaaaggatagtaaacacaccaatcagcactctgtgtctagctcaaggattgtaaatgcatcaatcagcactctgtaaaatggaccaatcagcgctctgtaaaatggaccaatcagcaggatgtgcgtgggaccaaataagggaataaaagctggccaccgagccagcagtg

SEQ ID NO: 618496 - DNA, 141 bp, Homo sapiens
ccgtggccaccacgatttgcaaatgttgtctcccaagctggagttgatcttgcctctggaatgcttttattaagggtttttaatacttaatttaattttcgaactgaccaatgcaaggctttattaaaaagaaagtttcca

SEQ ID NO: 618497 - DNA, 360 bp, Homo sapiens
tttattctttttgcatattacaaaaatgtgcatccaataattaaaatcatttgaacaaaaaaaaaaatgggcactctgattaaacggctttacagccggcaggacacctgggcccagctgggtttaactctagaatttcacggtcgtcccaccccacttctcccaccccacttctcccttcaccaacatgcaagtcctttccttcccggccagccagattagattgacagattgggaagggcgggcgcggcctccgtggtcagtagtccttggatgtgaagggggcagcacagtcttttaaccttgatccaccctcttggcttcttacaaggttaaccagcaaaaagaattaaaagttag

SEQ ID NO: 618498 - DNA, 80 bp, Homo sapiens
gtaccacatatgatcttcagaagaaaacctggtatgttgctcataatgaagattaaggatagatggaatcaacagaaaat

SEQ ID NO: 618499 - DNA, 364 bp, Homo sapiens
gggattcgttagtctgccgttgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctattggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtt

SEQ ID NO: 618500 - DNA, 368 bp, Homo sapiens
attcccccacctatccccattttctgcctgtacttaaactgaaatgcaggaagtggtggcaaaggtttattccacaaaaaccacgaaaccggtcctcacccagcctcttaaagcagtttttggggtcccccaaccctgtttccttttgcccctcccccctgtgtgactttgggcaaaccaagtgccctcttttaaccccagtttcctcatttgcaaaatgggaacaatgacgtgcctacctttttaacatgttgtgaggagactatgatataacatgtgtatgtaaatcttcatggtgattgtcatgtaaggcttaacccagtgggtggtgagttttgactaaaggttacctgttgttgtgattttta

SEQ ID NO: 618501 - DNA, 452 bp, Homo sapiens
  misc_feature (392)..(392): n is a, c, g, or t
  misc_feature (433)..(433): n is a, c, g, or t
tgaagactgagttttcagttcatgcgagatctgattgtttaaaagagtgcagcacttcctccaccttgctccctctcttgccactgatgtgcctgcttccccttcaccttctgcctggattgtaagctccctgagaacctcaccagaagcagatgccagcaccacgcttcctatacagcctgccaaaatgagctcctgaatttcacagacaaatccagactcctgtgtgggaaagcctgcggtgggtgttctccgtcttcccacagggactccctgcagccagggaattctaggggggagcacctggacggcgaggtattattgccccagatgggccttgaagtaacttgaaggattcacaaaagaagtggaaaatgttccttggccccgcntttaacttgatggacatttccaccacaaagggaagtgttcnattgggttgggtcccttgg

SEQ ID NO: 618502 - DNA, 400 bp, Homo sapiens
  misc_feature (223)..(223): n is a, c, g, or t
  misc_feature (399)..(399): n is a, c, g, or t
caatgctcaccttatgtgtgatacttagaacatcaccaggaactagacaagtgaaaaatttaggtgttattggaaacaagaagaaatatcctcttcctaaggatacccctcaagatattataataaaaatggcatgaaaaaacaggtgtggctgaattgtcaccactctgaagacaggagggtgaagccaaaggctataaaggagaaagaaaagactgtgtcntatatgagacggaaaaatcaagaagggatgcagagaaaaagagaaaaaacggcataaaaaaggatgcacggaggaaagaagagggacgaaaaccctccaaccacgcgccctcccccgcccgccctcgctgactagatacacacacacgaccaggcaggagagacgaacgccaccana

SEQ ID NO: 618503 - DNA, 251 bp, Homo sapiens
ttatacaactatgaatgtaatgttgcccaaaatccatttaactgatgattaatgagggaaccagtaagatgtacaactgattcaaatgagaagttaaagtatcacatacatttaaagtcaggaaagaagtgctaaatgaatttacaaaaaggtgcataaggctggacacggtggctcatgcctgtaatcccagcaatttgggaggcagagataggcagatcacttgaggtcaagagtttgagaccagcctg

SEQ ID NO: 618504 - DNA, 365 bp, Homo sapiens
gcgcggtggctcacgcctgtaatcccaatacttcgggaggccacggtgggtggatcacctgaggtcaggagttcgagaccagcctggccaacatggtgaaaccccgtctgtactgaaaatacaaaaattagctgggcatggtgatatgcgcctgtagtcccatctactcaggaggttgagatgggagaatcacttgaacctggaaggcggaggttgcagtgagccaagatcatgccactgcactccagcctgggcgacagagcaagactctgtcaaacaaaaaaaaaaacatgcggccgttcgagctcactaggccgattagacctatagggagacggattacaattgactgaccggaagtttac

SEQ ID NO: 618505 - DNA, 181 bp, Homo sapiens
gggcaacagagcaagactctgtctcaaaaaaaaaacaaaagaaaagaaatacacttacatagatgaataataaaaccaggcacggtcggttcatgcctgtaatcttagcactttgggaggctgaggcaggaggatcacttgaggccaaggagggttttttggttagtgttttgagatggag

SEQ ID NO: 618506 - DNA, 155 bp, Homo sapiens
tggtaccaaccacttcgtcgcctaaaggcaactcgtcatcagctctcaagcctataaatcccgggttggcttaatattcaggcctaccacctgaaacctggcaaccaacgccaggctggcctaacccttatcgtccttccatcgcaataacttgg

SEQ ID NO: 618507 - DNA, 810 bp, Homo sapiens
gccagactggctggagatgacatggaggtcatcgccacagaactcatgaacattctcaagaaggttgtgagacgtacaccctgatctgaagactgatggttttggcagttgacacatgtcgcagcatggtggccgctgatggagtagcaacagcacaggcaagctgggctttgaggaattcaagtactctgtggaacaacatcaagaaggtgacatggccagtatacataacagtgtcgacactgaccgatcagggtaccattttgcagtaggtgaactcccagtgtgcctttgaggcagcagggttccaccttgaactgagcatctctataacatgatcatccgagcgctactcagatgaaagtgggaacatggattttgacaaacttcatcatgctgcttggtcaggctggtacgccattgttccgtggccttcaaatctcttgagaaagatggcctctggacaaagtccaggtgaacatccaggagtggctgcagctgactatgtattgcctgaactggagccccaggagccgactcactcaccgttcttggctataggagtcacctggagcctcggtctctgccagggcccgatccctgtctgcccgtcgcatctttgtaggggcctgctgtagccactaacgctttcgtactccccgtgagcttgttacccatgcttctcaacatccagtggtccaatgtgtcctggctggagttccccctggtctaggacactctaagattgctctgtccgcgggtctccccattgccaccaggcccttgccagaccactccgtaacctctccg

SEQ ID NO: 618508 - DNA, 492 bp, Homo sapiens
  misc_feature (14)..(14): n is a, c, g, or t
  misc_feature (54)..(54): n is a, c, g, or t
  misc_feature (273)..(273): n is a, c, g, or t
aagaggaaggctangtggtgttgaagtgcctatgaagtcatccagctaagggtntaccactgggctatggattaagtgtggctgatcttatgaatccatgtgaaaatctatccggattctcccgtgtcaacatggtaaggggatgtatggcttgagatgaagtctcctgagccttcctgtatcctcatgccggggattaaccgcgttatcaaccgaagctaaggatgatgaggttgctcagctcagaaagtgcagatacctgtgggacatccngaaggacctaaagactgtgactagtgagctctaggctgtagaatttaaaaactacaatgtgattaactcgagcctttagcatccatgtacatggatcacagtttgctttgatcttcttcaatatgtgaatttgggctcacagaatcaaagcctatgcttggtttaatgcttgcaatctgagctcttgaacaaataaaattaactattgtagtgtgaaat

SEQ ID NO: 618509 - DNA, 233 bp, Homo sapiens
  misc_feature (35)..(35): n is a, c, g, or t
  misc_feature (119)..(119): n is a, c, g, or t
  misc_feature (155)..(155): n is a, c, g, or t
  misc_feature (198)..(198): n is a, c, g, or t
tggaacgcgacgctcgatcggctggagctggccgnagaggaaaccgcgacccgacctgccgatctgttgatggccggggtccgccgcgtggcagtccgggattcggccgggcactgcangcatgtggcctgcacgccggccttcgacctctattngaaagcgctcgacgcctatacgccggaacatgcggcgacgatnacgggggtcgatgcagccgacatcgtcgaagccgc

SEQ ID NO: 618510 - DNA, 766 bp, Homo sapiens
ctttgtgaaaaaggtgctcgcttttccttcgctttctgccatgattgtaagtttcctgaggtctccccagccatgtggaactgtgagttaattaaacctctttcctttataaattacccagtttcagggtagttctttatagcagtgtgcaaagtggactgttacagcacatattcatttttatatctatattatcatttaacctgtttttgaaaattatcttttaacatgtcatttttctcttgtcttattatcttcttttgcgtaaaacctgttctccagtagcttcctaagaaagggtgcacaggagacccattttttgagcccctccgttatctgacaatgttttgtttgaccctaacctttgattaataatgcgactggatgtggaacttgtgaaaggaacaataaaaagctcaggaccccaattcagtatgtcaaaaaaaaaaactaaaggaaaaaataagaccatgttgtggggcgcgcgccacgggcctccagagaagagttgcctaacaccatccggtgggggccgcgggggccccgtaggttcatgtcgaccagggcacaacgtgtgtcccagaaagaaaaccgggggtcaacggaatcaagaggccgggggaatcctgcccccgaataaacaagaagcgccgcagggggaacaacgcgagatgttttcagaaaaagtcccgaaagagaagatccagagggacaaaacgggggtctttcagagagaggcgtcaaagagacctcgaaataaagtagc

SEQ ID NO: 618511 - DNA, 292 bp, Homo sapiens
ccccactgagggtctgggttggcatcgggctattactctagattcaataatggctcgacactcactgttcaaagtgctattatattccatacacgtcacggatctatcccgactttgacacgaggacgaaactgtaggctaagatcatctcacccttacgtcacgctacgcctaccttgtaatcaggcataatctatgcctctggtgggttctttggctagctgtgcctcttaccctgccacgttgcaagacacctgcctgactctcggaggtcacagccaccaatccgcgc

SEQ ID NO: 618512 - DNA, 483 bp, Homo sapiens
  misc_feature (227)..(227): n is a, c, g, or t
ctgtatagtatgggaattattttctatgttaaatagaaactgaatgtactgggtgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatgngtgcacgcctgtaatcccagcactgtgggagccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaa

SEQ ID NO: 618513 - DNA, 540 bp, Homo sapiens
cgtgaaatatacagtgtggctcatcatataactcacctacagcacagtcattagattgacttgtgcatcttctggtgtcattggaactagtatatgattcctgaagaaattccatttttcagtcacaataatcttctatatcaatatttggatctagcagatcttctccatatgatgaaagattcatttggtttaagattaggttttcaaatgtatcttctaaatcggtttcaccaattaagacagctcccatcattcgtccattttgcatgacgactttgatgtattctcgtccttaggtacatctcagcattaattcatgatctgaacctaagccctgtgcattgtattttcccagcagtacaaccttatagttaaaaaattttgtcacatgagcaaacagttcaaagctgaaatccatgtcaatagagtctcctgaactcgctgcagccatgcactttgctgcataccatcccatctgtctagcctgggtccacagcctcatctgctgccagactgggctcagctgccaggatgtag

SEQ ID NO: 618514 - DNA, 217 bp, Homo sapiens
actgcttgacaccatggtgaacacacaccccacccccgctgtctctactaaagatataaaaacttagctgggtatgttggcgggcacctgtaatcccagctactcagtgaggctgagcgcgggagaatcgcttgaagcctgggaggtagagaggttccagtgagccaagattatgccactgcactccagcctggccaacagtcgtgcaaccggaggt

SEQ ID NO: 618515 - DNA, 110 bp, Homo sapiens
aatgtaggcccatcccatttagtgctgcacagtgcagaagcacaaaaaacaaaaacacacagtctctgacttctcctaagcactttgagttgttgaatagggccaactgt

SEQ ID NO: 618516 - DNA, 431 bp, Homo sapiens
accatagaatgatagatatgtatgcatcactagatctagaagtcttcctaaaaccatcagtgccaagaaatcgctttgtagtatttacttgttactgacaccacagcagtatagcatatgtcacagttcctgtgattcaatgttataaaacaagcagaatttaaaagcagcactaactgactttcctgtattactgctgtatatttatgtttgtgaaaatgtccatatttctaatgatatatttaatctttgctacaatataactgattctctatgctatattgtctctatcaacgttgttaatatgaccttgtacagttatctataattagtgttttttttcactattttgtgactgattactgtcagattaggacacaaatcaccagctattgcctgcctctgggaaattgctgaatcgcacttagaca

SEQ ID NO: 618517 - DNA, 871 bp, Homo sapiens
ccgccctcacgggagggacccccctaggacccaagagtcccggaccgcaaaagcggaatggagaaaactttgcccgggagacgcttaactaacacagcacatttggcccccctcccggatgagattcccaaatatttaggaggaaatggccctgtcaaccctcggggagaaccccagacaccgcgtccaagattagaagggcccctgacactttagattgccaccccaacaccgggaagcttctggaaaggcgaagcgaagacgcacacgagatttttctgtcctgtttgcccacaaacaatgctgcctgccccgggaaccccgaggggaagacttaattctggagattcaactcccccctcctcgggtgagtaaacccccaccccccaaaaggagacaactctcctcgagtttaagacgcggttggaaaactagaagatggagcccgggtatttccagcggaaaacttttttacggcctcacacgaatgagccctggaatataaaaagtagccaccaccacactcacgtgccagccactatatttatccccccaggatttaaaagagaatccctaattttaagaaacacgctttccaatgcgcttttgcacactttttcacaggaggccccaagaatagaatttgggaatatagggataaagctctaagttttttacaacccgagcacctcctacaccacgaatttatgagaaaaaagtttacccaccaataaatcttagtttatcaagaaaatttttgggtaggaaacctttttaaagggattttggaaaccccttgaaccgcctttttttttcccgccaggaacccacccaattgggtttgcttccattaatttttgggaaaaatcca

SEQ ID NO: 618518 - DNA, 301 bp, Homo sapiens
cgggaccataatgttaacctttgataaatctgattaatttagcctagatatgaagatgtatgtctctgctgtaatgccagcaaagcgcttttgtttaaagtctccattcatttacaggctgggttgtggctcatgcctgtctgtaatcccaccactttgggaggccgaggtgagcggatcacttgaggtcaggagttcgagaccggcctggccaacgtggtgaaaccctgtctttactcaaaatacaaaaaaaattagcagggtgggtggcgggtgcctgtaatccaagctactcgggagg

SEQ ID NO: 618519 - DNA, 355 bp, Homo sapiens
cttagtactcagacattgactttccgtcagcaaaccggggaagacaggttctcctaagttatccaaatgcaaataggaatttattttatctttttatttttgaggcagagtcttgctctgtgcccaggctgtagtgcagtggcgcgatcttggctccccgcaacctttgactccctggttcaagcgattctcctgcctcagcctcccaagtagctgagattacaggcacgcaccaccccacccagctaatttttgtatttttagtagagacagggtttcaccatgtttgcgaggaaggtcccaatctcctgacccggtgatccacccgcctcagcctcccccacagagagagcgt

SEQ ID NO: 618520 - DNA, 571 bp, Homo sapiens
agcgagagggctgcctgcttcctccctaattgctttatgcccagatagcaagtgtgggcaggagacaggcctgactcacaggaactgcaggagtctgggcagggtggggcagcactcgtcgggatataacagaaataaaaccacaaccccacagatacctacacaaccccacccacaacccaaaccaaacaaatacgcccttccagtaacaaaaacagatcggctcacgcttcaccatcatgtaggggtcgtctacgatcgggtcacaatgtcaatctgtggtatgaacaaaggcaagcccaccgtgcctaaaaggaatgacacaagtatccattccaatgcctgtggcagcatggccgtcatctcacatccaaaactacaacgggaaagccatttcctatcctatcaccagtgctctggacaggcagcgcatcataagatacttatggaaactgcaggctgccaatgaagccatgtgtcacctatcacgaagcgtcactgacactacacgtgtaacctatccagattaggatggacacatacaatgacactgtaactcatcacgactcag

SEQ ID NO: 618521 - DNA, 332 bp, Homo sapiens
cagtcggtacctgtgggtagcacaataaggaagggtccccaggttggggagagccccaagttgagaacaataatgaacaattattgtatgaacaattgttagaaacagctaatcacaaacaacctgtgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggcttcaccacctgcaaaactgaccctagg

SEQ ID NO: 618522 - DNA, 297 bp, Homo sapiens
ctcatcgcgagaatactccttgtgactgctgcaggagaatcgcctggagctgtcacgagcagaagctgcagtgagccaagatcgcgccactgcactccggcctgagtgacagagtgagactctgtctcaaaaccagacaaacaaacaagagtcaaactctgtaaaatgtttaaagaggtttattctgagccaaatatgagtgaccaaggcccgtgacatcagccccaggaagtcccgagaacatgtgcccaaggtggttgggttacagcttgattttatacgatttaggggaacagg

SEQ ID NO: 618523 - DNA, 805 bp, Homo sapiens
cttctgtgggctggctctgccaggtggcggtggctaccaggagcttgtttgctggccagtggcccagcaggtgcctgcgaagctggctggcttcgcccggcagcttgggcagcccgtattttgctgctggtggagctggctggctggctgcagtgagcatgggtggtggtgacaactcactgctggtgctgggctgctggacctgcttccacctgggcgcttgcggtggctccctgtgggccctgctggcctgctgcctgcggctcgcagacgctgccacggagatcgtggaacgatgtggccctgcgagcgcctggtgccaccacctgcatgggtctccgggcgggcttcctgggctgcctgacagactgtcctgccatggctgctgtgcagcacctcgctgttgtgctcgggaacgtgatgttggccctgtgctctggcctgatggtttgctgtgccaattgaggccatgctcccatcctgagccacattaagtggcctctcttggcaagcatgttgcacctttatcagccgccaagagaggtgtccttctccaacaagcccctacttcctggtggatgagttctggcagtcatgggtgtcctgttgagggcctcatcgtgggccttcggacccactctattgtgccagacggctcagagcttcttgcagacagccctgggtgagaagggggggtgccaaccgatgcatgcctgctcttgtgctctcccgccttctgccttgggagtacgagacggcaaccatctcctacatcctcaactctcactgatgaacaagttctggg

SEQ ID NO: 618524 - DNA, 724 bp, Homo sapiens
ggttctagtacgggcctggaattccgtgatgtaagtgagatgatgctaaggttgctgcttcatacagtatgatatcggaggcaagtattctcactgccatataacaaatagtccgaacgtttccccgccattggtggctaaccgaaggaaaagtccatttgttgttcaccgtccggtcagcgaagctatgaagggtcccgtggagaagttggcttccacatggaggtaatgcagtagacctacagacatggatgatgcagcacatgtctccgggaagcgcatcgaggcaagtgggtctccgtcctcaccaagtggaagttgtctgctgactggtgccatgtacttattgatacgatgggggtctcgctatgttgatgaggctcgggtctcgagctcctggcctcaagtgatcctcgccacctcagtctcccaaagtgctgggattacagagcatgatacattgataactccatttgtgggttataatagaccacaacttccaggcccagccgaatcctgctgaagttaaggatgtattcctggtgcctctggctatttcctgcatccacaggtccatgaccagcattacgtcacacgtcttggtcaccgttttattaatcatatctttgagtacacaaaccctgaagacggtgtcacttaccagatcaatggaatgacggaaaccttgcagtgttggtggctttatcattttggaaaaaaaacc

SEQ ID NO: 618525 - DNA, 113 bp, Homo sapiens
gtgatctagaggatcccttcttgtgttggtgctggtcgggagggatgcttgtttatcgtggatcttgtagtcagacaggtgcgtcatcgttccagctgtttcccagcaaagaa

SEQ ID NO: 618526 - DNA, 355 bp, Homo sapiens
tcctttgtctaaacaatagaactggacacaagctctgtgtgttacacatgcatgtaaattatgccttagtaactaaacacatgcattttctcgttttgaaaatctcattgggagccataaagctacataagtgggatgcaaatttctacaaggcaatgaaaaatttagtgagaatttaaattgtgctatacactctttgaccactcttattttcccttagaagaactggtcgccgggcaacatgtggaggctcaggcctgcaatcccatcattttgggaggccaaggtgggaggatcgcttgagcccaggagttcaaaaccagcccggacaacagagtgagatctcatctctacc

SEQ ID NO: 618527 - DNA, 908 bp, Homo sapiens
cgaagtgaagcggcgccatgtacgccctcgccctcttcgccaggccttctggccaccgctctgaccagccctgtccaagacccgaagacatgctctgggggctcagcagtgctgtgcagagatgtgaagacggcggtggactgtggggccgtgaagcactgccagcagatggtctggagcaagcccacagcgaaatcccttccttgcgacatatgcaaaactgttgtcaccgaagctgggaacttgctgaaagataatgctacgcaggaggagatccttcattacctggagaagacctgtgagtggattcatgactccagcctgtcggcctcgtgcaaggaggtggttgactcttacctgcctgtcatcctggacatgattaagggcgagatgagcaaccctggggaagtgtgctctgcgctcaacctctgccagtcccttcaggagtacttggccgagcaaaaccagaaacagcttgagtccaacaagatcccggaggtggacatggcccgtgtggttgcccccttcatgtccaacatccctctcctgctgtaccctcaggatcacccccgcagcagccccaactaaggctaacgaggacgtctgccaggactgtatgaaagctggtgtctgatgtccagactggtgtgaaggaccaacttcagctttatcagggttcgtggaccacgtgaagggatggtaccgcttggggccggcgtgttgacttgtttggctctttttagcccagggtggtttggtctggctggtataccgaatgtacctccctggcccgggaaggtcccgggtcccggggttgtggcacaagctgggtctgcgtctcggggctcggaaggtttccctgcgttactgtccccacgcggaaccgggggtgcggcaactgggccagg

SEQ ID NO: 618528 - DNA, 249 bp, Homo sapiens
gttgatgggcatccatacggaaagtcataactttattaggatagaaacagtacaaatttcaaaccaagcggcagttcacccctttgagaacaccaaaaaaagtggctgtccataagggtctacataggttgatcccatacatcgctatttacaataatcattaacggtgggtcctgtcaggggctcaaagggcctgtggctctcgaacacatatggctggtggacatgaccaattctatggtccttaac

SEQ ID NO: 618529 - DNA, 686 bp, Homo sapiens
  misc_feature (64)..(64): n is a, c, g, or t
  misc_feature (481)..(481): n is a, c, g, or t
  misc_feature (667)..(667): n is a, c, g, or t
gtggagccctctcaggggcaggaggagctctgtgaagcacaggaaccgaaagcacgtgatgtcnccttagagatggcagagccaccagacccgccccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatggggggagttctgagttgttagaaatgtttctgaatcaagtttgtttgaagacacgtgtgcctttgtacccattataagatggtcataagacccaagaacgtgataagctattggttatttttttgtgtttgtgttgttgtttttatgcttacatattaccccattcatgcgctaggggttcccaattaattggacacccataaggcttggtgggaggtatattttctcattctactcgnctcaaaggttcactccaccacagagtcttgagttttatcaataaaacacacatcttggtgcacctctccggcaataagatgtgggttatagtgtgcccatttcccttgaagactggcacatcgcagaatattgttcaagaataacttctctattttttttaagttagaaagatataatcattcacnggaggaagaaagaaataaa

SEQ ID NO: 618530 - DNA, 117 bp, Homo sapiens
  misc_feature (67)..(67): n is a, c, g, or t
ttggactacacatcaggtgtatgacttggctatggactacactctacgatcacgagctccacatggnaaaatagtgttgcacaatgttgtgacacgaggcgctatgtagtgctcatg

SEQ ID NO: 618531 - DNA, 583 bp, Homo sapiens
  misc_feature (166)..(166): n is a, c, g, or t
  misc_feature (175)..(175): n is a, c, g, or t
  misc_feature (254)..(254): n is a, c, g, or t
  misc_feature (345)..(346): n is a, c, g, or t
gggatacccccggcctgtctgggatatttgcaccccgggggcgagcaccttgttctcccggttctgggagatattctgcgggggtccttaataaagaggggggcgcgatgtctacaccggcttatatatcaaaaatatattatatggggtattataggaccctttnaaattgtgnggataatgcgagagggggcttattgggggcaatatggtgtttgttaatgtgcgaatttttttcaagattatttccacgnggcgggaagaacaccttctcaaaaaaaaaaaaaaaaaaagaccttccgagtttcttgtcaacacttttaggtaactcaattctacaaattnnaaccccccccaggaaggtcttaaaagacccgctagaaataccctactgctttttatgggcccccgcttttttggtgttggaaaaattttaaatccccctttgttaccccacttttttttttccccccccaatttttgtccaagggttttccacggaaaaagaaaagctttttcttttttcctgtttaaaaccttttcccaaaaaaaggccccaacatattgggcccttttttcttga

SEQ ID NO: 618532 - DNA, 884 bp, Homo sapiens
ccacgcgtcgcacaactcactgtagccttgacctcctgggctcaagcgatcctcctgcctcagcttcctgagtaggtggaactatagtctcactctgacgccaagctggagtgcagtggtgtgatctcagctcactgcaacctccacctcctgggttccagtgattctcctggcctcagcctccgaagtagctgtgactacaggccaggtgcagtggctcatgcctgaaatcccagcaatttgggaggccgaggtgggcagattgcttgagcacaggagctcgagaccagcctggccaagatggtgaaaccctgctctactaaaaatacaaaaaattaacctagcatggtggcgcacacctgtagatacagctactcgggaggccgaacccgggaggcagaggtggcagtgagctgagatcgtgacactgcacactccagcccaggtgacagagcaagattccttcttaaaaaaaaaaaaaaaaagagaagggaaaagaaaaagacaacagaagggagaagagaagagacgagaaaaaaaacttcggaaggggggccaatgcctgaaaataccagcattgggaggccaaggggggcagaatcacttgtgcccagggggctcgaagaccagcctgggcaacagcggaaacctgctctctacctaagaacttttcaacaaaaataagcgttgagctggtgacgccacaccttatagttccacctaaccgggaggcggaggtctcgaatcgttgagcctaccaacggagcccggaacgtgcttacgctgggacgaggactgtgttccacaaggtacaaaacaaacaagcaaaacaaaaagggggggctagaaccagcgcagcaacgaccagtgaaggccagggatac

SEQ ID NO: 618533 - DNA, 187 bp, Homo sapiens
  misc_feature (180)..(180): n is a, c, g, or t
ctgtcggacaatggttacccattttccctctcttgggtgtagaaatattactacggtctctgtatgtaatagcacagttttccttttcatcttcattttaatgtgtaaaagtgaactatgcgtggaaatagaaatcttatattcaaactttgaggattatgaaatctataactcagtgtnatttatc

SEQ ID NO: 618534 - DNA, 137 bp, Homo sapiens
cctcttgactcgtttactctcctgaggaatcgatgctgcatggacatgtcttctgtatgcagctggcggcaagaattcgagcaagggatttggcagagttttgctctacagtaggatagagatgagatgttggaagg

SEQ ID NO: 618535 - DNA, 272 bp, Homo sapiens
tggtgctgtctgggcacgtgttgggcttgctctgcagcgactggctgccgtctgggcgtggtgaccaggcacggacttgggcgaggtcttgcatctctactaccctaagtcggagtctcgctccgtcgcccagtcaggagtgcactggtgcgatgtcagctcactgcaacctctacctcccaggtacacgtgattctcctgactcagcctctcaagtagctgggattacaggcgcccaccaccatcatcggctactttttgtatttatagta

SEQ ID NO: 618536 - DNA, 105 bp, Homo sapiens
tatactcttttgccctcctccctgttgccggcatggtgtagtattcagccaccccctccatctgttcccagcacctggagaagggggtgctcaggtggcgcgtgt

SEQ ID NO: 618537 - DNA, 331 bp, Homo sapiens
aaaggcacaacattttttttgcttgcttggaacataatagaggcaacaaaaaattggagctagaatttgttaggcggcattttgatttgcaagctggtttcctaacttggcagctttttgaccttgaaaaaaacaagtgattttggagtctacagctctgttgcaattttctgattatggcaaaggcaggggctcccttgtcagtcctggttgacttttaagtcaggcggatcccaaaaaactgctgcctggacggaaatggaaatatggtctggctgggaggacaaaaagccgcatttacaaatttgacacaaacaccagctcctaatac

SEQ ID NO: 618538 - DNA, 450 bp, Homo sapiens
cctagcctttgtataagggcactgacttttaatatttaacttaccactcagtcagtactgaaacagttcttagtgagacctgacctgccacaatccccactgtcaatttgcacatgatttctatcatgcttgtatatttatttgtcacaagaattgtagggagatggggcattataatctttctggctacttcctgctgagatggggtcgttgttacggagcatcgaacgcagcgctggagtgaaagagttcaatttgttcccagtagcagtctctgttttgggggcgtagaggcagcgcctgctgaaacatagtagtgtgcaacagcaacacatataaataggttgccactgttttcttctgaagtttaagttgtctagtcttcagttcacagggcttcaagaaggcacagcttaggtttcagtggtttcaaattaggaaaaaaaaaaa

SEQ ID NO: 618539 - DNA, 145 bp, Homo sapiens
actgttcccacataaattcagacccgcagtatgtctgggaatgacactgcagaaagtggtgagtgcgagcaaggagagcgtcctgctaagaggctgaggtcgcctctggttccaaggatgggatgtcagccttgaccttccgggg

SEQ ID NO: 618540 - DNA, 978 bp, Homo sapiens
ctcggccacgggcgaatcggcctagtcgtcgctgcacaagtatcgccggaaggtcatattatcgacgccagttccaagcccactagacctaaagccgggcggacatgcggtgtgatccctgatcccatacagaggtgggtggctaatctacacacactatgatgggcccgtgtctgaaagcgtggatcttcctggcatgtctggaagacccccatccctctgctccagttttcgaagtacgcagactccggattcatatttaaaactcgtggaccaccgctctcaatgaaatcacacggactgaaatcatgacgctcgcattttttcgatcatacactgacaagacggagggctgaacggggagaatggagcacagacatatctaagctagccagagaatgctaagatggatagacggctcctaggatgggcacccgtggagtcttcgacaagaaatcaagaccctaattcgaagttgctgacttcaagaagaatcaatcgtctataccatgaagtgactagccattagggctcaaagggcaaggggattggataagatatggtcattagtgcaacctgggggacatcgaaaaaacatagcacactcacgagccgagagtccacttattcattatattccagaataaaactagaccttttcaaccccacgcaaagtgtaggaatgaggatgagagcacggccctcacatgaattgatccatggattccagtttaccagagacagcaggataacaagtcgtaaagatatgtgcgcccaaatattggagagcgaagagtcaataaaccgagacattctcgacctatgaaagctacgacaagcagtaaacaagagggggggaaaagaagacattaagaaggcattgaagacgagaacaaaccacgaagattgtgataattggaacacccgctgcaaaatagacttacaaacccgtaaccgtatcgactagcccaaattata

SEQ ID NO: 618541 - DNA, 386 bp, Homo sapiens
  misc_feature (74)..(74): n is a, c, g, or t
ggggtgggtccgggccctttttcccaagatgactgggtgggggttcccggtttccccgggtttttttgaaaaantccaaattgggggggggaagggttggttttgggagggggcaaattggctttttaggggggtgggggttttgccggttggttttggggggcgggggggtcagggggggtttgggggcccctttcaaaggggggttttattttggggatttgggggggaccccttttttatttttcgggagggtttttttggggggggggggggggcccaaaggggaaacgggttttgggaaataggggggttttgggggggtttgggtttttttttgggggggggtcggggtttaaaaaataagggtttttaacgggccccca

SEQ ID NO: 618542 - DNA, 226 bp, Homo sapiens
gagaatcttttccataatacaaatgtaaggtaaacacaaaaacgtattgagtgcataacaagaatctatggtctcacagacattagcttataatttggaacatcaaaaatcaaaagtaacgggcaagtgcagtggctgatgcctgtaatcccagccactttgggatgcttgaggcgggtggatcacctgaggtcaggagtttgagaacagcctggacaacatgaag

SEQ ID NO: 618543 - DNA, 198 bp, Homo sapiens
tccactcatctcttccccaggaagcctcggccccaagatgggagacagttctgctgaagaattgaaactggccacccagcttgaccgggaccggtcatgccggtccggaaggtctataagagggagaaagctcgagtcatcactgaggacgagaagattttcaaagcgcttcgatagtctccgaattggctcagggct

SEQ ID NO: 618544 - DNA, 186 bp, Homo sapiens
actgtccaccgtgggccaggccggcgcctgtctgacctaccgtggctacgacgtacgcgaactggccgccgacgctacagtttgaagaagtcgcctacctgctgctgtacggtgaattgccaacccaggccgaactggccgcttacagcaacaagctgagcaaattacgtgtgggtaccgagctcg

SEQ ID NO: 618545 - DNA, 328 bp, Homo sapiens
  misc_feature (87)..(87): n is a, c, g, or t
ggagcgggacggcacagcttctctatgtcagggtctcagcatgctgcagaatatgtgccccagtgtctggatgtctgaatgacctanatttgagcggtcatcaatgagtatttattagcacatgctcttaagaagttaataactcggccaggcacggtggctcaggcctgtaattccagcactttgggaggcggaggtgggcggatcacctgaggtcgggagctggggaccagcctgaccagcatggagaaaccccgtctctaccaaaaatacaaaattagccggctgtagtggcatatgcctgtaatcccagctacttgggcggccg

SEQ ID NO: 618546 - DNA, 266 bp, Homo sapiens
ataatgtaaataaatagaaaacgaagcctccacgcgtggtttttaaggggggatgatgaatgtgacgccacccacagaatgcattagaagctggtttttctgtgctttgtcatttgactctgataggaattgttgttgcctgagtttgtgcataacttagttaaggtactgtatagatgaaccaaaactgttaaatatgtagttagtttgttctacttagagtagtcaataaaagggctatattcctggaaaaggaaaaaaaaaaa

SEQ ID NO: 618547 - DNA, 1224 bp, Homo sapiens
ctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacacctgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttggggttcctaaggcccgcagtgaatgttcaaagccacgagcagctgggttgtacatttgtagcaggttacatagactggagatctttagtgcaattgtttctcaccctgctgattctgtggtatctgtgttgaataacacgaacaaggtagcagtgctatctctggtcctcaagagacttggatttaaaggtgtatggaagggactgttagcaccgttatcatcatgataggtaccccctgacactgcacacataaccaggcatgggttaccatctcactgacctccggtgaagcgtctacattcagacttcctcgccctcctccaccgagatgcagagtctctgaagaagaagctagggttacctcagtagattagatcaaagcaacatgtggactgactctgcttcgtgatcagctgttgaagacagtgcaaaagga

SEQ ID NO: 618548 - DNA, 523 bp, Homo sapiens
ctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacacctgctgtggttcccctggatttagtgaaatgccgtatgcaggtggacccccaaaagtacaagggcatatttaacggattctcagttacactgaatctgcttgttgatcagtgttgaaagtgcaaaggaacttttatatatttgacagtgtaggaaatgtctgttcctgatataattactgtagtacccttgcttaaagcaagagtttcaaacttaatgctaaataaacccatctattcctg

SEQ ID NO: 618549 - DNA, 1067 bp, Homo sapiens
gctagaaggtctccagagacgataattacattggcccaaggtatacttcagtggcgtcgaacccggtgaggcggaaatctgctttttaagaaaactgcttgggtgatgcacgagtgtaagcacgattctggtccactaggaatcagccaaggaattggtgaggcgcaggtgggcccctgatttgaggaacgtttgtccggtagcacgttccggagaatcaagtgtgtgaatacacttgtttgctagttggagtggctttgttctaggtataagcatgttgcacgatactgtaagggtgagtgtacgtgtgagtctactagaactagggtagcttcacgccatgtatgggtggcaggggcgaaggacggagataggttttcgccaatcgtccggaacctggtgttcggacgcatgtttctgaccatttgcttgtcattttacgaagattacgtgggtataaaggatctgggattaaaattaaagctctatgtgacgatggggtgggacgtggggtcctggaatttgtcctaagttgacttcggattaaaagtctcgtttagacattttgcatactttcggaacgttaaggtactgtagaagaagtaaaggtttggtggttggggtccggtgacaatggccatggatatgggagtctggggcatgtgagggtcggggggcatacaaattaaaatctgtagttcggtgtggggaagaaaacaaggaaatcccgcaggtaactttttcccaggacatgtccaggtcgcctgggtttcctaagaattgggtgctaacggccaagtgggcatattggttctgaactgtgtgccccccagggtggggcccatacgggccacggcggtcgggttataattggataaggccaggtaacgaggagtccgggataagggttaatgacttggcagaatcttggcccaacgaggacgcattggtttgttgttcactgggcagtgggctcttgttaagcacggctgcaacattttttgacagctggtttgaaaaggaggggaacaagttcgtggggagcaccctattggattacggggagc

SEQ ID NO: 618550 - DNA, 1016 bp, Homo sapiens
gctcactgcaagctccacctcctgggttcgcgccattttcctgcctcagcctcccgagtagctgggattacaggcatgcaccaccacgcccagccaattttgtatttttagtggggacggggtttcaccgtgttggccaggctgatctcaaactcttgacctcaaataatccacccacctcggcctcccaaagtgctgggattacaggtgtgagccaccatgcccagccttcattccttttgtggttaaataatatttcattgtatggatggaccacatttggtttatccattcacccattggtagacatttgggtcgtttctaccttttggcgactgaataagctgttttgaacatttgggtacaagtatctgtttaaagacctgttttcagttctgttgggcatacacctaggagtggaattgctgggtcatacggtaactatgttgaacttcctgaggaactgccaaactattttccttaacaactgcaccattttacattctcactagcaataacgagggttccagtttctccatgtcctgattcttatatttgaagtgttcaattcttgcaaacattttactcatgtcttggtgctcctgcttagctggtgcctgaatctgtgcgtggccacaggttagcctggtgtaggtctcgtggttccaagatggcaacaggaggaccggagaggagaaccaagccagctggggagccccagaggtgggagctagcttgtagggtccgaaggagtctgggcctctctcagaccatctcggaaccgtcgacccctggttccctcggaaggccgatgatacaccaaccacgcacaaccccacgcaagagcaacgacgacacacagcgcacgccgagtgcgcagagcagcgacgagacaacgacaagcgccgaaactccacacagagcgaacaacgcacagaccaacacacaagagccacatctacagaactcgccagcacgagcaagcgacagcagaagcacacacaggcgagaagaac

SEQ ID NO: 618551 - DNA, 496 bp, Homo sapiens
ctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacacctgctgtggttcccccatgcgcatttcaggtgacaaattgcctgatattcgcgagcgtagtggaccgccaccgagagaaaggtaacaaaagggtggcaagtatatatacacatgggcatttcatcgaggttaacaacatttaaagacgcagtgcattgggtagttatcagtatgggatttatgtggcttaaaaaagtgaatttgggtgcatacc

SEQ ID NO: 618552 - DNA, 349 bp, Homo sapiens
ctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcaccctggtgattaaaaagctttattgttca

SEQ ID NO: 618553 - DNA, 139 bp, Homo sapiens
ttgactagccgacggtgttcgatatgttctgtgcctggtatgatctgctgtgacggggtgtggtgatgctgccgtgccaggggcgtggatatgctgctgtggataggggtgtggatgatgctgtcgggctagtcggggt

SEQ ID NO: 618554 - DNA, 936 bp, Homo sapiens
  misc_feature (29)..(29): n is a, c, g, or t
  misc_feature (76)..(76): n is a, c, g, or t
  misc_feature (80)..(80): n is a, c, g, or t
  misc_feature (89)..(89): n is a, c, g, or t
  misc_feature (98)..(98): n is a, c, g, or t
  misc_feature (101)..(101): n is a, c, g, or t
  misc_feature (111)..(111): n is a, c, g, or t
  misc_feature (127)..(127): n is a, c, g, or t
  misc_feature (136)..(136): n is a, c, g, or t
  misc_feature (142)..(144): n is a, c, g, or t
  misc_feature (146)..(147): n is a, c, g, or t
  misc_feature (150)..(152): n is a, c, g, or t
  misc_feature (154)..(154): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (168)..(168): n is a, c, g, or t
  misc_feature (182)..(182): n is a, c, g, or t
  misc_feature (190)..(190): n is a, c, g, or t
  misc_feature (197)..(198): n is a, c, g, or t
  misc_feature (203)..(205): n is a, c, g, or t
  misc_feature (213)..(213): n is a, c, g, or t
  misc_feature (218)..(219): n is a, c, g, or t
  misc_feature (223)..(223): n is a, c, g, or t
  misc_feature (244)..(244): n is a, c, g, or t
  misc_feature (248)..(248): n is a, c, g, or t
  misc_feature (261)..(261): n is a, c, g, or t
  misc_feature (274)..(275): n is a, c, g, or t
  misc_feature (288)..(288): n is a, c, g, or t
  misc_feature (292)..(292): n is a, c, g, or t
  misc_feature (296)..(296): n is a, c, g, or t
  misc_feature (312)..(312): n is a, c, g, or t
  misc_feature (319)..(319): n is a, c, g, or t
  misc_feature (352)..(352): n is a, c, g, or t
  misc_feature (445)..(445): n is a, c, g, or t
  misc_feature (448)..(448): n is a, c, g, or t
  misc_feature (458)..(458): n is a, c, g, or t
  misc_feature (744)..(744): n is a, c, g, or t
  misc_feature (764)..(764): n is a, c, g, or t
  misc_feature (770)..(770): n is a, c, g, or t
  misc_feature (800)..(800): n is a, c, g, or t
  misc_feature (840)..(840): n is a, c, g, or t
  misc_feature (886)..(886): n is a, c, g, or t
ttttaatatcaaaagacaaaagaattggnacgtaaaaagaacatccttcccatcttcaaggtcaagattgaacgcngacncctgccggncgtcttccnggnttcccaggcnggaatgatggctcccngtccctgtngctccnnncnnccnnncntcncgcncnccccncataccagactgantgccggcnggccgcnngaccnnnccggccanccgcnncccnaccacccacaacacgccagcnatcnacccgggtgtgtntgtaggacagaannaaccatgaagggnggangaanacgcctggagcaattngggggcntggagagaacctcttaggagagtgtcaggctcnaggccagtgtcaccagaggaggtcagtctcagtccttggagtggtgggatggaaaccagacgggactggcatggtccacagttcttgccacanganggcttcaggngaggctgagggcccctctgacgcgtgtgcctggtcagggtgagccagggcaatgcagctcatacaagggcccagatggacagacggacctagcccagcccacgcatcggtaccgagcctggctcaggggcaggccgaggcttgtgcagtagacaaacatttacagcagacaccaggcagctcctggaaaccactccccaaaaaacagcattggaatcggggaccccagctgtgaacgaaggagcaaggaggccctgggagaggaggagaaccccagggaagatggngggaggactggggggctganggacgnagggggcctgggctcagaggtaggcgagcngctgctgtgctcctggcaaagggcctctcctccgccaggnctctggccctgaaggtctgccctgggccccattcgccctgggtgcnactgaggttaaaatgacagaggatgcagagtgcctcagggtgacacgaga

SEQ ID NO: 618555 - DNA, 327 bp, Homo sapiens
  misc_feature (9)..(9): n is a, c, g, or t
  misc_feature (99)..(99): n is a, c, g, or t
  misc_feature (126)..(127): n is a, c, g, or t
  misc_feature (133)..(133): n is a, c, g, or t
  misc_feature (161)..(161): n is a, c, g, or t
  misc_feature (184)..(184): n is a, c, g, or t
  misc_feature (305)..(305): n is a, c, g, or t
agattaggnaacgaggtaaagcatctactagtgtcagtagctgtacacttgtacacataaagctgaacaagatgaaaatggcatctcctggctgtgcancacaatggtccgagtgtcaggagccgnnggcggncttggcagtcacctattcttgctatatnaacagaggtactgatgcagaagntaggtaagtagtatttaagagttcacagtaaggtcattgcttttccccattttatgatttgtagtgctttctctgattccatttcctaaatctttcatccatttaactatactatactatnattactataggcagtagtttac

SEQ ID NO: 618556 - DNA, 145 bp, Homo sapiens
ccgcggcgtgttcatgcagagctagaatgcgcccatttcactttgtgttagccaccacagttagccagtgctcataacagcacattgctattcctcctccaactgcctgcccacaagcatcttgcttccacatatgagactgtgg

SEQ ID NO: 618557 - DNA, 771 bp, Homo sapiens
accttttcctcccttaaggagtataattccctccgcgtggaacaattttttcccccctccacctttttgataactgtttccccaaggaccccaatatcaattttgccgccggttcacctttcttgcaggaaccaactccataacccacactttttatccgctgccaagaaaaatgccacaagccaatcacctatttgtgcttcataaaactatacaagattggtcctccttccgccctctacaagaacttgcttgttttctccccacgcgttctacacaatctaaaccacactcgttttgtcgcccaggatccagcacaccatctcaatgctggggcttgtataccccgcggaaacccatgccgtggcaaccctcctttccgggacaggcttttcccggccattctcactgccgttgtgtggcatgcccaccgcggaccgttttgctttctccccgtctttcttcatgcggcaaccccccccgcgtatcctggtgtgcgtgcaccagtagcatgactccttccggcattctttctccccctggcaagcattttaccaatgattcacatcttcttgcaccaaaaatctcttccataattaacaatctatccccaaggctgcccccagctttcctcctccaggatagcaccctctcttgccactctgtctcacactccatgagatatgagccgcctgcagttctcttcacacatgcggcggctcccttcccatagttaataaaagacgaccctttgtcccatcaatagtcaag

SEQ ID NO: 618558 - DNA, 488 bp, Homo sapiens
ttcagatgtttcatttgtagtataatgaaatgtttacagaaagataactttttcattaaaatatttttagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccctggggggggcccccgcccccaaatccccctaaaggggaggaaataaaaaatccttggccccttttttaaaacgcaagaaatggaaaaacccgggggttacccaaataaaagaggtttgaaaaaaaaacccttttttcacaatgggaaaaaaccaaaaaggccccaccccaaacccttttcaaaaaatttgcgcccctaaaagggaaaaagcaaaattgaacccgttaatttttggtaaaaaatccggaaaatttttggaaaaattccccatattttaaaaaaaaggccatttgcatcttttaatat

SEQ ID NO: 618559 - DNA, 360 bp, Homo sapiens
  misc_feature (231)..(231): n is a, c, g, or t
gcttcatcccaggacatcccgtggagtggagacaatgggcagcgggagacaatacaagaccacgcttcccgtggtggactcggcggctcctttttcctttacagcaagctcaccgtggacaaaaacaggtggcagcaggggaacgtctttttatggtccgttatggattagggtttgcccaacccctacacgcaaaaaaaccttttcctgttttcgggtaaattagttggncggccggcaaaccccccctccccggggtttttgggttgcccgaggaattttgggacgtaccccctgttaaaattttccggggggccagcatggaaataaagcccccaaggctgccctggggcccttcca

SEQ ID NO: 618560 - DNA, 453 bp, Homo sapiens
ccctccaggatgggggtgaaagtctgggtccatgtcccagaacacatctatgctgctccaggacagaaggacttcacgtctcctgggggtggatataggagacaatgctgcctggcagcacacgtggatccaacagtgccaagtgatcacgtcttaggcccagtggaacacaatgactatcatactgatgcagacctggcaggtggagagcagctaagtgtgtggcccagagagcctgtctgtgtggagcacgtagtgcacagaatacgtgagagttgctctggcaggggcaggatccatcacaggatcgctgggaggtgaggtgtgtgtgacccactggatgggagggcaatgagtgtgcacatacaaatggggcagtgtgcatgcaacacacataggggaggagtggcccagaatacagagcacacaacacacaagggagagaaccccaga

SEQ ID NO: 618561 - DNA, 930 bp, Homo sapiens
tcccactttccatattaaaggatgggtccagccttaaaaacttcatggacgggagcaaatccagtatccacggatttcttctcaagggcactctaacccatcagaatagccgcggaagttccattctcatgaatactctagccatgaaaaaaactcaatgaggacacagacgaatccaagtgaacagaagagaggaatctatggagttcggggatattggggtgcatctcgatcggctccaggattatgaaacctaaacctcccatggtaaataggaagcgtggatgcaagttccttccataatactatgtggcccattaactcgtgtaggccaagaaagctacgggcctcgtgatgccctatgttcataaaagctcataaaaaccgagaccattgggagaggtctaaagatatacacttcataaatatataatcccctccgggaggataggaggaagtagaaacaaccaccaaaccagagacgttataaccacgagatccagtgggccgaaaggggcttgtgtgcaaaacccgaggggcgagatatcataacagattatagaggaatggggaaacatttcagagcccctaagacaaagggggaaacaggggtcaccaagagtctaccacagtgttgggagtggaacaaccacaagggggcccgaacatagaggcacctacaaagacaaaagatggccagaacggggacaaaagacagggccaaaggggaaaacgaaagggggcggaccccgcggggaccccacaagcgtggcgccgtcgacaagacaaacacaaaggaagggcttacgcaaaacatggttggtagaaaactcccccccgtggtctggcaaaacaagggggcccacagaaacttcgggggcaatagggcacagaaacagttaccgggccaaaaacagaaaacccctaaac

SEQ ID NO: 618562 - DNA, 633 bp, Homo sapiens
  misc_feature (198)..(198): n is a, c, g, or t
acatcgggaggaacgcagggatgcctttcgggtcaagttatccatgcccggcaggaggtgcgcagccgcgtcaccaacatggtctcgcaccagctgtcgttccagcgttagagacggtaccaactatttgggcgtggcgagcaggtcacccaagtgcagagaatagtcaagcgactgtgccgggatgggtccattcgnacagtgtccgtccatatgaaggaatcgtgcttgaaccgttgagtgggctgtgcctttaactttgatggcgaagtatcgagcgaggaaagacatcaagaacaatttggtgctcatagtatgagcggctgggatgagattctagactctggcgtaccgcacagaattccgagacaggcgcgctgaaacagcttcatcacgcagcagggcatcgagaggtcggcatcagacaaaagaagagcagtctacagatcaccagccgaggtaactgggcagattggctgtgcggtgagagggtatcaagtatcgtcggaatgagctcttcctggatgtgcgtggacgagtgtgaacctggtcatgtccccacaagggcaggtgctgagtgcccatgtgtcgggccgggtggtgatgaagagctacctgagtggatgcctgaat

SEQ ID NO: 618563 - DNA, 431 bp, Homo sapiens
cccgctccggagtaggagcgcaccaccagctccagctcgccccgcccgccactccaccaacctcggggccccgccagggctcggccaggcccgactccgaccccgccgcctgcagtcaccctcgcgtcccgggcgccgccacccccaccgccaagcagcggggtccctaccacacctccctccagccgaggcccgccgcctccgcccgcggcagctccgcggcccgggtccagggcctaagcagggcccaggtccgggtggtcccaaaggcgcaaaatgctggcggccgaagccaggtggcggcccgggcctaagctacgtgcggccaccccactagccgcatcgaggcggcggggacgcgcgggggccgccagcaccacccgccctaccaccagcagcatcaccagggaccccgccggcggccgcggcgc

SEQ ID NO: 618564 - DNA, 103 bp, Homo sapiens
ttcggtccgtggccagtgacggccgagtgtggcagatggtgtggagaagtcactgccgaggattgctaggtgcagagtgcctcagtcctgcgacctgaacgaa

SEQ ID NO: 618565 - DNA, 253 bp, Homo sapiens
tttacccgactagcccgacaggcagatctcacttacagaagagcacattccagaaaagcagccagcaggggtagaggcccagtgacagcagtgggaagagcaggcgccgtaggtgtggtgctccagcaaaccctgggctagcgctgccagggagaagcttgcaagcctcggccagtgacagtggcgctccttcaggctccgccacagtaacaggcttgccaaggagcgtgcctgtcgggctagtcgggggggt

SEQ ID NO: 618566 - DNA, 2067 bp, Homo sapiens
aaaggccggtttctacccgatgatctcttgggccccgtcccgagagtgaggcacggcgccaccaggcacccccgatacgcagcgtgttgtgaagtgcccttgtgagcagcgggggatagggaacagaaaaccagctgtcagcgacagcgaggtggtgccccagagagggctgcctcattcgcctggctgcagggtccgaggtcgtcttggtagcatttggcaggaatttatttaggaagcattcagcaaaccgagtgtgtgtggtgctgggagatgacgacgaaatggccctgcccccaaggaagcccctcccctgggggcacaggtggggagggaggtcatgagctttgtgtgtgtgacaactgctgatgggaatgctattggcacgtacgaggggtgcctgtccgtgtcttgggagagcaaggaaggcttcccggaggagttgctgccaagttggcccagaaggatgaggaggagttcttctggtgaagtggggagggcagaggcaggatggtccctacggagcatgtggggacgctcgtgttcttccagaggatggaatgctgggcccgaagcctgaagtattgttagggtagagacaggcgggaggtgcgtggagaaggggtcatggaggtcttgttgggcagatggcggtgggacgtcccaggcagggggagcatcttgggcaagagcccagggtgcgaggtcatgcttatggcacattggaccagctggaggacagccagctcaggagagcagccggctggggtgtctgcccacgtgtggggcagggatgggctgcagcggggagggatttgggagcttctgtcgtagtcctgcagggagtgggagctgtgcaagaaggaagggcggagcggctgtgatccaatgactttgggaaggccactcctgtgatggagtgggggaagacagaccccaggccaggggtcctgagtcaaggcagtggctgaggaggcacctggggaaggtgatttggagaggctttgggggtaggtcctgggggtctggaagggctctaggccaggaattttcagactcctgggggcatcagaatcacctggagggcttgttaaagcaaagcttgcccccagcctcaggcagctgggcggcaggaatctgcatgtctaacaggctcccaggggatgctgacttgctggccagggtcccacactttgagaagccccgcctgaagcttacaggacagggcaggttcttgagccattgagttgggcaatgccatgggaagttgcaggtgcacagacgttgccttcctggctgcggttgaacctgggctccatttgtccccttggagctccaggcggccgggccgacttcgaccctgagctctcctgtctgatttcctttccaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggtgaggccctgggtcccctgcagagggtgggccctgggtctcctgcagagggtgggccctgggtctcctgcagagggtgggccctggttggcatctgaggccttgacctccacttgcaccacccccgggttatggggcacctctggagagttaggacccaggcctgctctcagcacaatgagaggaaaactaaccctgaactccctgccaccccccacccctggcccctggaatgtgttagagtgtagatttggaaaagaaacctgcgccaggcatggtgcctcatgcctgtaatcccagcactttgggaggctgaggcaggtggatcacttgagttaaggagtttgagacaagcctggccaacatggtgaaagcccatctctactaaaaatacaaaaaaaaaaaa

SEQ ID NO: 618567 - DNA, 692 bp, Homo sapiens
tgtccccggctcggaggctcccggcggagcagtgaggcggccctgccctgggcccgggaccccggcgtcgatgtcggcgcccggctcgtaggggctgcgttaggccccgcccggtccaggcccagccgtggtccctggactgtagactgggtcagggcattgttcatgcatctgaccgacctcagtcagccccggcaatgactctcaggtgaacgagaatactcttgcctccagcctatcgccgtgcacgtgccccccatatatggtgagaataacatcaccacaggccagttgtgaaaccccaaatcctgacgcatgttatcgaagggttagtgatccaggagggggctggagcctttcccggtgggacgctcgtccctgctggtggagaatctcaatgaacgaagtatgcatcacggggttcctgccttgagaaacttcctagcatcagtgatcacgaccgaccgaccgacatgacgtcggagatggaggagccctatctgcaagaatccaaagagcgagggtgctcccctcaaactcaagtgtgagctctgtggaccggtgtggacttttgcctataatgttcaagcgttccaagtcgcttctgttccatggcttgtgcaaagaggtacaaacgtgggatgcaccaaacgggtgggacttttccactcagaacggagcaagctgcaaag

SEQ ID NO: 618568 - DNA, 939 bp, Homo sapiens
ggagggacccggagttcagctacagcatagatctagcacctagtgaagcttctcgacggtgtctggttttctgctccttgtgtcctgagtgtcagcacgccgaacgcttctgttgtcgtctccttgagcgaggcttgttcgatggggctcgggacatgtggagagcctactctgacatgagagaagccaattacagtcggtctcagacaagatacttccatgtctcgtgcgggaacctatgatgctgccaaaacggggacctgggggtgcctgggccgcagaagtgatcagtaattgccagagagaattatccagagactcacaggccattggtgcggaggactcgctggccgatcgaggctgccaataaatggggccaggcagtggcagagaccccaatcacttccgatctgctggactgctgagaatatactgagcttcctcttcactctgctctcaggagactggctatgaggccctcggggcagggatagaaagttagtgaggtctatgtccagagaagctgagattatggcactatcataggcatctaattaaatgcttaagaggtggaatttgcgatgtcacgagtacacacgcattggaacacagcgatattgggcgagctcgtggccacatgcagcaacgacgcagggacccgtaatctgtgacgcactgcgggactccataggatgaacggacaccgtggcattccggggcggcacacctggagacaatcagggcctgcaccgaccctgtcgtgcccggcaccttccgtccccttaaatagatatgctcccgtcatggtagcacctcagagtctcttgctcactgacgtcccggaacgcggttacgtgccgcgcacaccacggagccctactctaccacgcagcagcctccacggagcgaccttccatttaacatctccccccgcctcgg

SEQ ID NO: 618569 - DNA, 1122 bp, Homo sapiens
gccagctcccaggaaagctggtctgctgagctggcccctgccctggctcccagtgtccctgcgcgacccctgcccttccctgagaccccatgccttggctgcctgccctgctgtcccgtgaatgctccatgcctgaaccatgtttttcacttgtgtgcccaaatgagtgccatggtggtctccgtgtaaaaatccatggtggcagaacaatggacgatgtttggctggcctgcctgtcagatgttcctgggtgaagacggagtgctgagatttgcccacatttgccctggagacgttagatgggccaccagagggccatcatggcccacatgactgtggaggagatctataaggacaggcagaaattctcagaacaggttttcaaacgtggcctcctcagacctggtcaacatgggcatcagttgtggttagctacactctgacaggacattcacgatgaccaggactatttgcactctattggggaaggctcgaacagctcaagtccaaaaagatgcacggactcggacgaagcagaggccaaggagacgatgctagggatccagggaagctaaagccaaggcaggacacggtgtctgcatcagaacctgagctgacatcgacgatggccaaggcacagcagacgataacgaacctcgacggcacggctgcctatgacatacgcaggtcaaacaccccgacgaagcacccggccttggcccttggcctatccagcttccacggtggacaagactaacgcagcagaattgacggaccacccggctcaagtgtgccgtgcttgtgtgcaccgtgaccccaaacgcgatgctgcacaagcaagcgacgaaggagcaatgcgccgcgtgggtacagaccgcgtccctgggacctgccccgccgtgtccacgcagacactatagctgagaacatccggcgcgccgctccaaagcgcttgacgagacaataaccataagtcagtcagcagtacgagcccagctcacaactatctacgcccgtaggcccaagaacagagtttcttagcacgatctcgcgtgcggaacgcaagcccactgagcacagcgtgcgcagtccatatccatgtgaatacgcacatactcacaa

SEQ ID NO: 618570 - DNA, 714 bp, Homo sapiens
  misc_feature (24)..(24): n is a, c, g, or t
  misc_feature (128)..(128): n is a, c, g, or t
  misc_feature (131)..(132): n is a, c, g, or t
  misc_feature (160)..(160): n is a, c, g, or t
  misc_feature (164)..(164): n is a, c, g, or t
  misc_feature (176)..(177): n is a, c, g, or t
  misc_feature (217)..(217): n is a, c, g, or t
  misc_feature (381)..(381): n is a, c, g, or t
  misc_feature (423)..(423): n is a, c, g, or t
  misc_feature (589)..(589): n is a, c, g, or t
  misc_feature (656)..(656): n is a, c, g, or t
  misc_feature (669)..(669): n is a, c, g, or t
  misc_feature (712)..(712): n is a, c, g, or t
cctgcacgcggtgaccacagcgtnaaacggctgtatggcttcaatggcttgatgaagcatccgttgcaccagatgctggaaccacggccgggttgacgccgttgatcctgctgggcattcccacggangtnncgctgctgctggccctggcgattgcgtncagntgctgttgcagnnttccaatgtcgacatgcgcctggggccgctgcgctgggtnttcgcctggggccggtgcatcgttttcatcacatgaaatatggccgggcgggggatgtgaatttcggcttgtttttcaatctatggggattggctcttgggcaacggcgttttacagccaatgactatcgaaatgggggcagggcgacttggggattggcaagncggccggattttccgccgggagtatgtgggcgcagttgcganttcccgtttcaaggaacggttgcaattgagcaaggaagccgcccggtttccagtcccgtctaagttcgaaggattcgtacgtgcaaggtttgcgcaaacgacgcccccggccgtgacgcccaataagttgtttcaatggtccgggaaaaatgcgcccaaatccganaaccccggcgccatgggagccttccggtcagggtgctgccgcccgaaggccaattccaagcgccaantcgcaaacgccgncaacaaaaaccagggcgaagttatccggcaaaacccagttggntt

SEQ ID NO: 618571 - DNA, 87 bp, Homo sapiens
ccccatattagcataccaaaggctctgagttctacagtgaagtgaaatcaactctttctcaaactcatcgcacaagcgactttttaa

SEQ ID NO: 618572 - DNA, 243 bp, Homo sapiens
tcagctcggtaccagctctgcgacacgtcccccgccgctaggatcagccagtgtgtcagatccgaaagctatccgccagcggccacacactcaccgccgcaaaccccggcatgctttccagcatgctgcacacctggctgatctggcggcgggggacggtgtcgcagagcttgaacagcttcgtaaaactgctggaagaacgcaatttggcagcgccctagatcaagtgtgggagcgggcttg

SEQ ID NO: 618573 - DNA, 777 bp, Homo sapiens
  misc_feature (579)..(579): n is a, c, g, or t
  misc_feature (765)..(765): n is a, c, g, or t
  misc_feature (770)..(770): n is a, c, g, or t
cgaagcacacaacaagaccaccgcccaccccacaaagttctgtattacgcagccaccaccaaccccagcgtttcttttaaagacccaccacgctgaaacacctctctaagagaaccccctcatttatatgtcttatattatataccaaaagacatctagtaaccaacatagtcacccacggtgcagcaaatcacacccggagctagacagccaaaataaagaaccccaccaggccagtaatatagaagcacccccgacacctgttgtttaccattggcaacaaggatactgtccatcccacgaagcctacaaaacgaccatagaaacaccaacatcgttcccccccattatttgggaaaaacagagttataacccatttgttatcccccccccccattagggttatccccccccaatatagggaggccccaacccccccagatatgaaggataaaggcccctttatttaaaagcccacccttttttatttttaaaaacaaaaaaagtttatcttttaaccccccccaccccgggcccccagaggggaaactccaaaaaaaaattgtttgtacaaaggangaagagagctccaccctttttttccccccccgccccctcctgtgtggccaaaattggaaggtgaaaccactaaaatccaagaccccccccccgagaaaacaaaaaaaaacgggggggtttgggccttaattttccccaaaaaggtcccaaaaccgcaaaaaacaccgaaaataaaaaaacttgatnagtgntcccttc

SEQ ID NO: 618574 - DNA, 352 bp, Homo sapiens
tgccagaagttggggtctcagccagtaagggagtttccggtcacgtcttggaactctcctatcttgtagacagaaagtggttatcctctgtaaagctgcctgaacggggcagttcagtagtcctgccggatgatgcccttctgactatttaacccctgtacactttgtaccgctatgtgcacatcttgttaacagttcggtctgaagccgaggctccagctcctaacactgggtattcgcctcacgtcttggagtacaggcatgattcacgtggtgcgcacagggatgtatctagttatatgtacggcatacatggcagtcatatagtgctctagaacacagaacttctcct

SEQ ID NO: 618575 - DNA, 597 bp, Homo sapiens
cgctgttggctggcgggctctccagagtggctgatgctcccacccggccgccgcaggcctgtgactgctggtcgtcttcgtgtggcttctgcttagcacctggtgcacaagctcctgccagtggccatccagtgtgacctgtgtccaacccctaccacgtggtgatcctcttccagcctgtgaccctgccctgtacctaccagataaactcgaacccccacgcaacccatctgtcatcttggaagtacaagtctttcttgccagggaccggaatcgccagatgccttctcccctggacagcgtcagacaaccagctcaatgcccagatggcagcgggaacccaggctacaaccccataagtcgagtgccaggacagagtgcgcaccgtcagggtcgtggccaccaagcatgggcaacgctgtgaccctgggatattactaccagggccggaggattaccatcaccggaaatgctgacctgacctttgaacagacgtcgtggggggacagtgggtgtgtataactgctccgtggtctcaaaacaggaactccagggaacaattgaggcctaagcagaactcatcgtccttgtgtatgc

SEQ ID NO: 618576 - DNA, 110 bp, Homo sapiens
acggacccattcagaactctacccatgcggcgcaatgcctggctgcattctgttcctgctgttcctcgctcacctgttcaacttttttgacctgcacctattccctgcga

SEQ ID NO: 618577 - DNA, 274 bp, Homo sapiens
  misc_feature (1)..(1): n is a, c, g, or t
ntcggactgcgttacttctgctctgactgatcctcacccttcttctcatatttacatatacctacatttcccttattggttttttacactgtcatgcccacctttgattggtgtctttcttttagcttttttgcacactcataaacccaatcagcaggcactcccccattctgagcctataaaagcccagacccagacacactaaggggagaaaaacacccgaattcgggaacaaccttggattcccctctacactgaaagcagaaggtcgacg

SEQ ID NO: 618578 - DNA, 397 bp, Homo sapiens
  misc_feature (165)..(165): n is a, c, g, or t
acttaaggatccggaggttgagtcgcattgcgaggctgaggagcgtgggagctgcgctcaggatctcgtcgcagcaggaggagctgaagccgcctgagcgggccaagcaggatattgcacggcagctgcgttagtacccaggaacttcatgagcgttaagcttgnccttgacatcgagatcggcacctaccggaagcttgctgagggcgaggagagccggttggcttgagattgagttggaaccgtgaatatctctgtgatgattccactggtggcagtagcagtggcggtggcattgggctgaccctcgggggaaccatgggcagcaatgccctgagcttctccagcagtgcgggtcctgggctcctgaaggcttattccatccggactccaagct

SEQ ID NO: 618579 - DNA, 769 bp, Homo sapiens
aaactcccctcggtttttttcaaaaaggggccaaacccatccttttacaaccccccccttccgctaattgaaccccccgagcacctaccgttctattccaaagagaattttgcaggaaaatacttaaacctttgctccccttatgtctgttaaataggagcccttattcctgattgccccaaccccccacacatcgcagtcatgtccccccgcgaccaagtttccttataatagttttcctctcctcccccccctccgtgcagacacaatatacctccgtcaggacaccccatcttcattaaaacacccttcgctccccccactctgttctccgccgcccaaatatatctattataatatcacatctgttttttactgtttcccccgcaatatacttctaggcgaacatttcttttacggattctatatatggggaattttgcccacaatccacattgtcccacccccactctaagatactacggatagattcacatactaagtcggatagagacacctccaccgcgctctctgtgcgcgcacttgctaatgaagcagtgtcgctgagccagcagtgagcgccgcacactggagtattgaagcgcatcagaaacgggtatggaagaaccgcgcataagataaccatacatagaggggggttgaaaacgcttcaattccgggtggagcaaaaatctttttcagggtggttggacaccgcctacgagttattcctgttttctattaaaaaaatggtgcgcccacaaaacac

SEQ ID NO: 618580 - DNA, 212 bp, Homo sapiens
agggggatgggggggggggggccccttttgggaggggggttccccccccccccccccctccccccccccccccccggggggggggggggggggggccccccccttttttttcccccccccccctctttcccccaaccctaatccctcctacctcacccgcagggggaaggaggggggataacaaaccttgaataaaacacaagcctccgtta

SEQ ID NO: 618581 - DNA, 105 bp, Homo sapiens
caccttctgtaccgatgtccgcggacgctacgccgtgcacgagtaaggagggtcgttgcgtgtgagtcactatgacagcgctatgcggcgctgggcccgggtgga

SEQ ID NO: 618582 - DNA, 424 bp, Homo sapiens
  misc_feature (23)..(23): n is a, c, g, or t
  misc_feature (31)..(31): n is a, c, g, or t
  misc_feature (42)..(42): n is a, c, g, or t
  misc_feature (57)..(57): n is a, c, g, or t
  misc_feature (124)..(124): n is a, c, g, or t
  misc_feature (176)..(176): n is a, c, g, or t
  misc_feature (205)..(205): n is a, c, g, or t
  misc_feature (344)..(344): n is a, c, g, or t
  misc_feature (399)..(399): n is a, c, g, or t
  misc_feature (408)..(408): n is a, c, g, or t
cacaggctgggttccagttctgnacctgagncacggtttttncctcatgtgcacttnctgggcaaggcgcttcccttcatctggggccaaaggcaaggcaggcacgtaagacccttccttcagnctggacctgtgtttggggacatgaattctcttccttctcctccttgtctggnctctgttgacaaaccgggacatgtttggncagtaaattgggcaccgtgttcacactgtttcctgggattcaagtatgcaaccagaccacaggagaagaaaagttccagggatccctttccccatctgtcctcttgatgtgagagagactctgagacttcttccatcgnaatgacctgtattaaacacaagccccccaagcaaaagaagaggttgagttttctnccagggttnagattagccctttcca

SEQ ID NO: 618583 - DNA, 560 bp, Homo sapiens
tacgaatcgagctcggaccccggagtgtagaaagtctcaatagcaaagacagtgcttcatatcgaggctctctactgcagtggagactacgggtgaccatgatgcccgatcaacgaagtgaagaaaaagcttgaggatgcatttccataagcttccaagcctcctctcgtatgatgatgtaaacatgagaatagctgctggtgaatcttgggcacttctctttgaatgggccagaggaatagagagtgactttttttatgaagacatggagtccttgacgcagatgcttagggcctgggcaacagatggaaataaacaccgggccaaagtggacaagagaaagcagcggtcagttttcagagatgtcctgagggcagtggaggaacgagattttccaacagaaaccattaaattgggtcctgaacgcatgtatatggatggctgggtaaaaaaacacacctatgacacctttaaggaggccaccgacattggccgccgatcgatcaggtgaatgcgtttgagctggtagatcggcgttccggccgccagctggagctttt

SEQ ID NO: 618584 - DNA, 158 bp, Homo sapiens
agaggagtacgcagcaggacatctatgcagggtcagtgcagcccatcctaaggcacttgctggaagggcagaatccgttgtgcttgcctatggacccacaggagttgggaagacggacacattgcttggcagcacagagcaacctaggtgatcccgcg

SEQ ID NO: 618585 - DNA, 394 bp, Homo sapiens
atccctgatgtatatagaatcggcttcctagctagtacactagtgagcttcctactcaggccaatatacacctatcgaccgcccttactaaccgacacatagtcacatagtcgaatagcgtatacacctgtcacatatatataagcgctcagcgagatttagtcgtataaaccactactacagctagggaagaagccaagcagaaaacggtggagtagaataggaaccctatgatgaaccggcacaaggagaacctgaagtccaagactcaatgataaaaggatgacagaaatatgcatgtggatatagataggagatgtcatcaaactccaccctcctatggagcctctggaccagaaaaccaaagcaggcaacagctactggctgtcgaaca

SEQ ID NO: 618586 - DNA, 244 bp, Homo sapiens
aatctgggggaaggggggggggggggggggggggtttttttgggtcccaaaaaattttccccttttaaagggggcccccgggccccgaggggggtttttttattaattggaccttttttcccttcccctttccccctggggtgggttgggggccccattttttttttaacccccccccgggggttttaaaaaattttttttccccgggaaaattttttaaaaaaaagggtttttttttttttca

SEQ ID NO: 618587 - DNA, 484 bp, Homo sapiens
  misc_feature (115)..(115): n is a, c, g, or t
  misc_feature (125)..(125): n is a, c, g, or t
  misc_feature (194)..(194): n is a, c, g, or t
tcaacccagccaaaaaaatgaggtgccctcggggggggcccctgggactcctttttgatgattttgcctctaaaaagcaagtgaggcggtgctcattgcccccctgaagctgcgnagatcccaanttgttcggggcaggatggacagagattggagcccagagcggattgggctgtaacagctttccggtctgnaagataacagcccaggaggacaagcagggtgggcctagggacaaactgcaaaggctcctgtcccctggggtttttgcggcatttgtgtcatcttgttgccatggagttgtgatcatcccatttaagctgcagcttcctgtcaacacttttcacattttatgttaactgtagataaagtggtttgatggtgacttcctcgcctttccccccccatgcattaaattttaaggtagaacctcccctgttactgaaagtggtttgaaagtgaataaacttcagccccatggcca

SEQ ID NO: 618588 - DNA, 106 bp, Homo sapiens
  misc_feature (23)..(23): n is a, c, g, or t
  misc_feature (33)..(33): n is a, c, g, or t
  misc_feature (60)..(60): n is a, c, g, or t
gtgattatacgttttattagacncgggaggggnatggcagggcttcataagtgttccttnaaattaaaaaaaaaaaatacaaaagctacgtagaaaacgtcagatc

SEQ ID NO: 618589 - DNA, 451 bp, Homo sapiens
  misc_feature (115)..(115): n is a, c, g, or t
caagcagtaaatacatgactcaggttgtgattgatgcaggagcactcgctgttctttcccgagccgtgctcaccgaagctccaaaactaacattcagaaggaagctacgtggacnatgtcaaagatcacaggcgggcgccagtaccaagataccgcaagttgtgaatcatggattagtcccattccttgtcagtgtactactctaaggcagattttaagacacaaaaggaagctgtgtgggccgtgcaacaagctataccagttgtggaacagttgaacagattgtgtaccttgtacaacagtggcataatagaaccgttgatgaacctcgttaactgccacagataccaagattatactggttatcctggatgccatttcacatatcttacaggctgctgagaaactaggtgaaactgcgaaacttagtataatgattgccgaatgtgga

SEQ ID NO: 618590 - DNA, 230 bp, Homo sapiens
aaggctttttttttttatttcccgggaaaaaaaaaaaagggatggggttttttgggattccttgggccggtaggcccttttggaaaaaggccaaagccccaccccaggtttgggtttatcccccccctttctggggaagccccctttggatggggggattccaacccggggttgggaaattttttccaaaggccttttttttgaaaaattaattttaaaaacccttccca

SEQ ID NO: 618591 - DNA, 140 bp, Homo sapiens
ccaccgcgtctgccgatatccgcgcagtggtgtacgacttcagccccagccgctcgggcgaacatgcacgcaacttcctgcaagactggaagggcaagctggtctgcgatgattttggtggttacaaagccagttttgca

SEQ ID NO: 618592 - DNA, 218 bp, Homo sapiens
tctgtgggccagtacacatgtgcatggtgagagcaccgtgtgagtgtagcagggttggagtgatggctctgcaagcctaggaacagcaaggagtctgacatcaccagagagggtcgtagaacagagttctgtctcccagcttctagaagggaccatgccctgctgacacctggattttaggcttcaatgccatcccgaaaaccaggtgatggacaata

SEQ ID NO: 618593 - DNA, 274 bp, Homo sapiens
aacagtatagtgaacaattgttgtactgtaccacttagttacgatactcgttgatcatcaaacgacctgtgtgtaatatttttcactcaaaacgtagcacccttcagcaggaccctataaaactttcctccagcccttgcctctttgcaggtagccccttctctgctgagctgcccactgcaacatattttcacaatttctctaataaatctgcccttctttacctacaactaccttggtaaatggctttaccacctgcaaaactgaccctagg

SEQ ID NO: 618594 - DNA, 136 bp, Homo sapiens
tgggcgtatggaggtggcgagcaagtggatagatgcaggagagtcaggtgacaagaagagagtgcctaagagggttcagcataattacttgcttggttggcaagtttagctctatccttgagtgtttttatgttgt

SEQ ID NO: 618595 - DNA, 144 bp, Homo sapiens
attccataaataaatcttatgttaaatctgaaactaaatggaatacacacagcctagaaacgaggtaaaccacgagcaagatacatatcaaaacactggacatcaagaaattaccaaataacaaagtacattagatagaattac

SEQ ID NO: 618596 - DNA, 241 bp, Homo sapiens
tccctctgcgtgtctacgtctcgcggtcctccctccctggggggtctccgctcctggcgtcgccggcccttggtgcccctctgtgcgctctcaatgctgtcgggctcgtcggggcctgtcgggctcgtcggggcctgtcgggctcgtcgggacctgtcgggcacgtcggggactgtcgggctcgtcgtgacctgtctggctacgtcgggaccttggcggcctacgtcgggcccggactcct

SEQ ID NO: 618597 - DNA, 413 bp, Homo sapiens
  misc_feature (10)..(10): n is a, c, g, or t
  misc_feature (16)..(16): n is a, c, g, or t
  misc_feature (60)..(60): n is a, c, g, or t
  misc_feature (227)..(227): n is a, c, g, or t
  misc_feature (344)..(344): n is a, c, g, or t
cctctccggnaggcancccgtctgccctcctcccgggtgcgtcccacgtgccctggggancttgctcactcactgttgctcccatgaggatgtaactccgctggggcaggtctttgtcttatttgatattttatgcgccaggcctcctaggcactcagcaaattgacggatgaacagagttgaaggcataaatgagcctccttttcttcctctgtgattggggaganaagggatggccactgcaaaggctgcagggagagaatcgaggccaccccaggccggcactcagcaccacatctgcccagaaactcccacatggctgccagcatgcccggacctgcttnccagcttctgcgttatccaagcgggaccaacaagcggacgctgcccccacgccgagccctatgcagttc

SEQ ID NO: 618598 - DNA, 710 bp, Homo sapiens
ccgatgacgcagacctgatttcggcgagatctgcgataattagcgtatcaccgccagcgatatggagcgcttgctcaatgacatgaagatcacagtactcatggacatttatatctagtccctgtctatgaaggaattagcgtgcattggtatcattgtattagactccatagatcttagcctgctggtgattatgccagagcagaatctgacacgaatgtatgagcggaccaagatcatggcatcagatgatatcagtgtcaacgaatttcacgtgattgtaggtaacaatggctacttggatgtaggacgtcaacatgctgtaggacagtgatcttgggcaagcgctgctatcatccatgtgcgcatagatatactataggtctaccagagctgcgatcactacgcgaggccctttaaggcgagcgtgacacttccgttttggggtgctaggattaagcattcataaattgaactgcagttgttcagcaaatttgcctactattcgtatcatactgttaggctactgacgttgtgatcgacctgagcattggacggaagttacattatagcaaagtttgcatggtcacgcttgaagactaggcaagaccacttttaacacacccttaaggtcttaaagttcattggatctgaccacttataagggtcctaattcactgagacattcccttggatggttcgtggcgccg

SEQ ID NO: 618599 - DNA, 226 bp, Homo sapiens
  misc_feature (83)..(83): n is a, c, g, or t
  misc_feature (104)..(104): n is a, c, g, or t
  misc_feature (169)..(169): n is a, c, g, or t
  misc_feature (184)..(184): n is a, c, g, or t
  misc_feature (192)..(193): n is a, c, g, or t
  misc_feature (204)..(204): n is a, c, g, or t
  misc_feature (210)..(211): n is a, c, g, or t
  misc_feature (214)..(214): n is a, c, g, or t
gtggacgccatcctgagtgccttccgcatgtttgaccccagcggcaaaggggtggtgaacaaggatgagttcaagcagctttncctgacccaggcagacaagtnctctccagctgaggtggagcagatgtcgcctgacacccatggacctggcgggacatcgactacangtcacttgctacatnatcaccanngagacgagaanaggatnnggncaggccagccac

SEQ ID NO: 618600 - DNA, 356 bp, Homo sapiens
  misc_feature (31)..(31): n is a, c, g, or t
  misc_feature (141)..(141): n is a, c, g, or t
  misc_feature (319)..(319): n is a, c, g, or t
gattcaggatgtaaccctattgtaagtcaangaccatctgtcttcacttcttgaccaccccacctctaacaccgtacgctgggaagattgtgaatcagaggccagactctaggctttcatggagaaaatttacaaaaaaanaaaaaaagaggccagactcacacttaggcctacccaggctttctagatgatagggaactcccatctcactgccaggtgcttttagacacccccgtgtccgcccttttgactacctgttccgcctccacagatcctgcaccctgaggaatgcatgtatgctgtgggcaggtacactttnccaggggaggcacatgggggcattaggcttccctttg

SEQ ID NO: 618601 - DNA, 189 bp, Homo sapiens
cgtctcccagtcctctgtggggacgggctcctgagtgggacagaacgacagaaggaaaattccagtcccagctaacagatacacaccattgaaagaaaacgggatgaagatattaactcctatggtggaacattggggactctcagactacgctttaactgtgaaatcacaggaatgtacgaaatcagg

SEQ ID NO: 618602 - DNA, 151 bp, Homo sapiens
  misc_feature (3)..(3): n is a, c, g, or t
tanaacggggttttgtcatgttggccaggctgatctcgaactcctggccttcagtgatctacccacctcagcctctcgaagtgctgggattacagatgtgagccatcgtacccagccttctgtgtttaatttcttaggatcctacatgcat

SEQ ID NO: 618603 - DNA, 189 bp, Homo sapiens
ttagtctcttcagttctctcacttattctataacccaaccccctcccacttgttagtgtgatctcagaactagtgccaagcagaacactgggacaaagggagaatatctagctcccctcctgagtcagcctggtgttgccctttattccccttatgtgcttatagtcccagcatacttggacaggccaa

SEQ ID NO: 618604 - DNA, 876 bp, Homo sapiens
gaagggtaaaaccaagtaactattaaaccatatggtataatgtaaacaaattgttccatttcgtaggctggtatcatcagcttcctgagaaacctttactataatggattgtaaaaataactactttaaggacaaatttcttaattgtaaatgctgcaaaatgaaggagcttgtttgggttgatgcaggacccacagcaattaaacaattgctgacgagtatatgtgatccagatgcacaggaggttattcttgcaaccagcctattggaccagatgatcttggtaccacccagatcaataaactggctcatctgatcttgtggcaccccctacccaggaactgactgagcgcaagaagacagctttgactccctatgatttaatctctaaccaatcagcactcctggctcactggcttcctcccacccaccaaattattcatagaaactctgatccctgaatgctcagggagactgatttgagtaataataaaactctggtctcccacacagctggctccatgtgaattactctttctcttgcagttcccctgtcttgatgaattggctctgtctaggcagtgggcagggtgaaccccttgggcggttacagtgctatgggacaaaattaaagatttggtggcccatttgatgtttgcctctggcccacatctcctctgggggagaatgttccattccaacatataattgggggaaccttcccgacccaacatcttaatgggatcccttttttggcccgggctctaattttaaccgtaagaatgttaggtggcggggcgggggccacgctgttatcccgcttttggggcccgaggggttgcctaggcggttttgccactctggcctttggtaaat

SEQ ID NO: 618605 - DNA, 398 bp, Homo sapiens
tggtgggcagaaattgctctaccgttggccatcagagcatggtgtctgtggctcctcgccacggccctgaagcctgacacctgggtacatggcttggggactctccaggggccaagacacacagtatcctccatggttgcagcccgggtctgtgctgggcctgggatcctcaaaagtgaggagaggccagggggccagggcagctaccagccgggcagctgtgcatggtgcaggggggtcgctatggccatgctggatgagggaggcctagactttccacagctgcccaagacttccggctccagaggagggacggagccatccccacgtccctgtggctctcaggacgccctcctctgaggggcgcgtgattccaggttgtgtacactttgctctgc

SEQ ID NO: 618606 - DNA, 381 bp, Homo sapiens
  misc_feature (219)..(219): n is a, c, g, or t
  misc_feature (281)..(281): n is a, c, g, or t
ccagatatgaagtgtcccagttgtcctcctattaagcctagatgcctaaagagatttgtaaaaatgtaagataatgcccattccttccttccccaattaaaaaaagttaacaggcatgagcccacccattccctggctattatatatcttatatactgtattcttacagtaaagtaagcctagagaaaagaaaatattaggaaaatcataagggagagnaaatatatttactattcattaagtggaggtagatctcataaaggtcttcatcctcgttatcntcatgttgagtagctgaggaggaggagagattggtctttgtatcaggggtggcagagagggaagaggtaaaagagatggaaggggaggcaagagaggcat

SEQ ID NO: 618607 - DNA, 928 bp, Homo sapiens
ctccggcggactagtatttattaccaagaatgcattcacaaatacaataaaaatatttggtgttgtatgtcaaagcggtgtgggcataattatatgtaaatttttatgttactttgtgccccatgttatctttccaaaaaatgacgactctttaggagacacacattatatttctttaactttgttcagcatgagaaaactgcgtgagtattacaattagttagaggtggggcatcttattttgtgaaacgtgattctccagtatacgtgtgggctgatagctaacactgggtagataggatcaggatttgggacaggattaggggcgggtatctataccccaaaaaagagaacagaagtataggggtgtaaataactgtgtttttctcttgggaaagaaggccagaaagagttggtcagtccagggctggatagggagcttgaggatggttataggagcccgcggtccttgctttcagtgcatcattgctcaagcgtgagcttctacctcttggtcaggggggtggtgaggaacagtcggacatcagcttttggggcgggtggcgttgggcacacatagtcgcgtgctcactcgtgggagcggggagggggtcgaatgcgggctgtaggttgggtgctggtataaaaggcaggggggtatactgggggggggaggaggcttgcgtggtaatgggtgataatgagggggggggggacctagagggcggggcttggcctgttgggggtacggggggttgggaagctggggggggtgtggcctggccgcgtggggggcgttggggggaaggcggggggggcggcggggggctctgcgaggggatgagggtaagggggggggaaggggccgaggtgcgggggggcggaggggcgcggggaggggggggatggggggggggcggtgaggggg

SEQ ID NO: 618608 - DNA, 204 bp, Homo sapiens
tgcaatctggtctcgttccgtatggtcccgctggggcctgctcccactcctctctagcatggtctagcccctattccttcttcttccttcttcatcttgaattaactttacatagttttgcccggattcggcccgaagtccggtagcgtcgtacctgcgctcgtcactgcgtcaattcactggttcactatgctgtttcctgac

SEQ ID NO: 618609 - DNA, 340 bp, Homo sapiens
  misc_feature (35)..(35): n is a, c, g, or t
  misc_feature (37)..(37): n is a, c, g, or t
cctcccccctctggtgacccaggggagggcatggncnaaatggagttcccccagggttaaagcaacatgaacgcccttgtttttgagtatcaccaggacccggatgcccccccaaaaaaggaggaggattttggttaggaggcccaaaaggaggcctaaggcaaagcccccctcccctcagggttttcagttcccttaaccgttttaatcaaatgcccctttcctttcccccaaaatttgggtttgccgcccccatcttgttttttgtttttttttttgggggggggtttaaaacagggcctggcccaaagtaggcgccccataaaaacttgtttgttta

SEQ ID NO: 618610 - DNA, 1192 bp, Homo sapiens
gctgcgcccgccgtcggccccacgcgcggcccatgatcctccggcgccgcgctcgccacaccccgaggacccgcaaggatgaagaaggacgatgtcgttcctgggcaagctgggcggcaccctggccaggaagcggatgggcgcgcgaggtgagtgacctgcaggaagaaggcaagatatgccatcacattcaccgatgtcccccgacccgtggcggatgttcaccctgaagacacccagctcgaggagaacgaggagcgcacgatgattgcacccacattccacaggaagaccccaagttcaaggaactggtcaaggtcctcctcgactggaattaatgacgtgctggtggcaggcagaggatcattgtgaagcagctggaggcaagacctgtatgcacggccaaggtgcatgcagcaagctcttggaaaaactggcagtggtgcaagctgaatgtggcctgaggtgacacagatccgaaatagggcaggaaacacgaagctgcagaccggtgctggaagcagtacatgacctgctgcggcccgaggctgggcgctccggtggagcggtggactcaaattcacgggaagacacatgctgcacatcctccacatgcatggacatctctggacatgcacctacagggcccccaaccgactatcctgagcatgtaacggtgcacaggtggagagccagtgcgcgccaccgggcacggcccgctgccattccagccacacatctcgcgaagagtggaaccaacacatacagcaagactgacggactgggccggaacagaccaaacgcttacagcaggacagcctacctcaggcaagcacccaaaaagcacaaccacggaaacaaactgcaaccttgacgtccagaaagggcgacacagaaaaaccagcaacgcctgttgcaacggagacacaggccaacaacacgccgacggccaccacactgcacacccacaccccacgagtccccccagcgacaccacatcacagcacgaccggggcggccaaacccagcgaccaccagcgccggtgaagcagaggcagaagcgggcaacagccacgacgagacacagacaacacagccggccacagccccaagaacaagacgcggccccacccgtgcagccacacatagagcacagacagcacgcgacacgaagaaagacgacgcgaccacc

SEQ ID NO: 618611 - DNA, 482 bp, Homo sapiens
cgcacagagcgctagtccttcggcgagcgagcacttcgacgcggtcgggacccctcgtcgctgtcctcccgacgcgacccggtgcccaggctcggctgcctggcggtcctcgtgtcccatcccgggcacgcctcccggagtcccgggtccctccccgtgccctcttctcgtgcgcgcgcacaggattggggcccccgcaaggtcttcggggtccgggcttctgattgccggcggcagaagggcaaatttttgggccgcagtcttcaggacgaattgttgtctgttgaccaactaacaaggctgggcggaaaaactgcttgggtgaattaataattccgtcagtgccagggtacctacaagttgggggcaccaaagaatacctggtcctttgtcggctacaaagaggcttggggttgccaaacatagttgtggtgattgcagggcaggccaaatgaattggctccaaaacttgtgcggaggaa

SEQ ID NO: 618612 - DNA, 154 bp, Homo sapiens
ccccaaactatacttccccccacacttctggttatcttgtgtggagggggagcagtgatatctaatgctgtggtgtgaaatgggtacggagatgatgcttggagtggttaatgtggctccctggaaggggttaatgggctccctggagtggtta

SEQ ID NO: 618613 - DNA, 242 bp, Homo sapiens
gcacgagaacggagtgagattccatgtcaaaaaaaaaaaaaaaatgtacatttttaaaaggggatttatttgagaagcaaaaacaacagaacacttcacaggctactttacacaataaaatagaaaataattacaaatttctgcaagcataaacactcaggtatgctaacaatagtcacaggattataacaattataaacagacaaactgtattcataaataggttaaaagcaaactgtttt

SEQ ID NO: 618614 - DNA, 199 bp, Homo sapiens
  misc_feature (71)..(71): n is a, c, g, or t
  misc_feature (99)..(99): n is a, c, g, or t
agaaggaagattgggagcgccatggtttagggtggggtggagtggaagggcaaatggggaccatactaganctgcagaactaactaaaagggcacgganctacagcgactccgcgacggagcctgccctgggtgaagggagtctctgggaccgcagggggctcctgtagcctggcaggttgctgggcaggagggggtca

SEQ ID NO: 618615 - DNA, 164 bp, Homo sapiens
agaatgcctggtcggtctctcaccttggctaggtgagagtaccgacagcctactgtggttctgacagcacttctgggttctttctcttctgctaccccaggcatggtcctttgaggaaggtgagcttctctctgtttgtcttgcttggcactgcctggacgctg

SEQ ID NO: 618616 - DNA, 243 bp, Homo sapiens
ttcatgtactggaccatggtatctgctgggccgtagaccagatcatgtgtgttcccaaacactggtggtgtagcccctgcgtgtgtggctgcctagaaatattctgtaagaactcgagcagcagactccaggagtcgctagctatcacacaggggccatactccatcagggtgtctccatcgacggaggaacagggtgctgagtttcaggtccgtggaggtgcagataatcagagttacacgt

SEQ ID NO: 618617 - DNA, 852 bp, Homo sapiens
gctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccgcgtcgcccccccacccccgaggccagccgccaaggtagtgagcggggatgctttggtatctccgccaacagctgagtcactggcgttttgagcaccgagtcctgacacctttcctgctggacgaaccagcgtccacgaacaaccgacagaggaactctgtgaacggtgactgtacaacgtgcctgtggccgaaactgtggccaaagttctgcgctccatctgtggcgcactcacaccgacacgtcaaagccctccatctgggcggcacaccagtggactctgatcagtctcaacgcgccgagcgagcattctctactcacaccagacgtgcagctgaacgacgcaggcaatcatagaatgccagacgtggctgaatgcctgactggaccgcaggagcagcccccaagcaccctggagaactccacagcctccacaagccacgcacccaagcggcccaaagcgagggcactcggccagacaccagggtagcggccacccaacaaaactctatccgcacgaaagggcccagagcgctccgcacggccgcccgcacacaacacccggggaccaccgcaagccacacctcaaatagacataaggggatcttactcaagataacgttacggctcccgttgggacccatgctccggacagcatacacgggacccgaactgtttgatta

SEQ ID NO: 618618 - DNA, 1063 bp, Homo sapiens
gcaacaggggcagaagagggggagatgaagccggtgggagcgggagcagacgctcctcctggagaggggatctcatgctgctccgaccagttgagcccagttccggggaggcttgaaggcggggcaggcaaacgttggtcagatgtaagcggtggcttggagacagaatcatctaatggcaaacagatacactagaaggtgggctccgttggatgaagagaatggccgacagttgggtgaggtagagctgcaagtgtgggatttgtacaaaatggttcacgggtgacacatttggcatagatacctcatccgtgtctacctttcatgaccaacgtacagttttcattgcaacgtctgcgcatcacaggtgggaatacctatttcctccggaagcaagcaaacttgcaaggaacatgtgccttagtgctttggccaagctgagatggcagtcccgaacacaggatgaacatccgaagacaaggttctccaaagataaggatattatagcatttattgataaatactgggagtgcatgacatacagacagagacctgggacaatgacttggccaaataacattgttaaaaccaatgagtcaagaaagagatgtattcttggtaaaggacaaccagatccaggcagtaagatccggaagaagattgaccgaaattgtgagtgtggggatcaggaccttagataacattgggccctggttatgagaagcaacaagagaaagagaggtgtctactagagggaattaaaggggggattggagaggaggacggaaggggcacaggaacacggggaaaactgcgaagtagggccaaagagcacccacacaggcgagggacctaggaatggaaagagatcacccatggaaccatggggaacacgagaaccaggggatgcgaggaaaacaaacggacgcaaagagggaaaagacaagaagatcagaagcaaaaaagggaagagaagatagaaagagcaactaagccaaagaaaacaacaagacacgaacagaagaaacgaagacaacaaaacggaagacgacctcacagtcgg

SEQ ID NO: 618619 - DNA, 824 bp, Homo sapiens
  misc_feature (145)..(145): n is a, c, g, or t
  misc_feature (172)..(172): n is a, c, g, or t
  misc_feature (183)..(183): n is a, c, g, or t
  misc_feature (198)..(198): n is a, c, g, or t
  misc_feature (489)..(489): n is a, c, g, or t
  misc_feature (517)..(517): n is a, c, g, or t
  misc_feature (526)..(526): n is a, c, g, or t
  misc_feature (538)..(538): n is a, c, g, or t
  misc_feature (548)..(548): n is a, c, g, or t
  misc_feature (559)..(559): n is a, c, g, or t
  misc_feature (563)..(563): n is a, c, g, or t
  misc_feature (599)..(599): n is a, c, g, or t
  misc_feature (614)..(614): n is a, c, g, or t
cagagatagcagcactgggctatgcacctggcctaatgccgccccgctcctcccaatccctgtgttatgctggagagggtccagcctctggtgagtttcaccaaacccccacatctctttcttctgagaccttctctaaaatccnctcttttatacttagtgaaatgggatnctctttttccnatccagcttaagcanaaacttttgactatgagaagaatgaggatgcatttagtatctgttctgcatggctaattccatcaaagatttctcattattcatgcctggcagtctcattttcttcttttgcctctaagagcacagtcgtagccttaattactgaccttttcactcttctaataccagcgatttcccccatctcagttctcaggaagttctgttcgcagaattatctcctgaatcctcacctggagatagaaattgttctctgtggccatttcttccccctctaattcttatcaaaaaacncagtgatctctgtgcatcaaatattaanctcaagctnaacagatcatgnttctggcttntctctctctcnggcntgtgggttaacaggtttgcaacctttgcagagaagncaccaaattctcagnaggccagagtttccaaaggtactggtcactcttgctctctttctcctgctcaaaattcagcactagagagtgttacaccattgcacctgcagaggagttcatctgactctagggactacagaggagagagatggacaaactaacaggcattcagaaaatgactaccacaatggggaagaaaatgaaagtcaaaccaaataagcaatggtc

SEQ ID NO: 618620 - DNA, 205 bp, Homo sapiens
actgatacgaatcgagctcgtacctatgtggtctggttgtgacaaacaggtggtcaagatttgaaaatgtgactgaggcctatagtataaatacataagttatcttcttgaagctctggtaccagatgttcatatcgcgtaggcgagatggaacctattccatggatattctacgatatctttccttctttcactttataataag

SEQ ID NO: 618621 - DNA, 632 bp, Homo sapiens
agcggggtaaaacctatagctggagcagtcaacagaggctaggtcaccttgttggcagctgccgtctgctagagacatggtgataggaagcatgggggcaggggagggcaggagatcatatttccggaagagggtgctgtggcacgaccatcctaataagggctacatggcagcccttctctaagaagtgagacatgtcttttctgaccagcagttgacagttaagggtcatccacacatgagctacatgcttatcctaaagaggacttggctagcagacatagagagcagccgaagtgtggttacacacttattccaaaagggtattggttagagacaataagaggacgaagcataatacagagggactggctcatttcttcctgaacttcctagtctgtaacttgtgtcaggcagagcctgaagtgctctgtcggttcctgtggctattgcccggccacttagcgaggacctcggagtctcgggctcgcacgcagggagtgcgagtagtcacaataagcatactcgtggaaggctcgattgacatacgccattaaacttgttggaacgagccatggaaatggacgaccattaaccatgtcttaggagctgtagcctgagaatgagtacca

SEQ ID NO: 618622 - DNA, 129 bp, Homo sapiens
ccctccacctccaccaccaccagtcattcctccaacagaaaacgaacatgatgaacacgatgagaaacatcagaagcagttggaaagggcacaattagagaatgaaaagaagaaaagagaaatagcaaa

SEQ ID NO: 618623 - DNA, 243 bp, Homo sapiens
tagatcagagttgagctgattgaggaccaaattaaaagactggctgggcatgatggctcacacctggaaaaccagcaattttgggaggccaaggcaggcagattgtttgagcccaggaattcaagaccagcctagataacctgggtatcccagctacttgggaggctgagctgccgaggctacagtgagccatgatcgtgccattgctttctagcctgggtgacagattgagaccctgtctca

SEQ ID NO: 618624 - DNA, 140 bp, Homo sapiens
tacagtacgagtgtctcaagagcgggaaataagatgctgttggtagttttgttgtttaagctgctcaatttgggacttaaacaatttgctttcatcttgtacatcctgtaacagctgtgtttaatttcttgaagaacact

SEQ ID NO: 618625 - DNA, 381 bp, Homo sapiens
tagtttcataactaaccagttagactctctatagatgtgataggatagatccatatgtgtatgaggagtacagtcatatctctgtgatttttgatgtacgctagggatgtgatcttgaacgctttcttatttggtggctgaatttacgcctatcatgggtgttaatttgtactctctctacaaggtttttctcctagatgtccaaagagctgttcctctttggactaacagtttaatttaccatgggattcagagggttctgtgggctaatttaaagttgaactaagattctatcttggacaaccagttatcaccatgtctcggtaggtttgtacgcctctaacctataaatctttccaccatatagtatcagcgtcttga

SEQ ID NO: 618626 - DNA, 671 bp, Homo sapiens
cggcacgaggagaccacgcagtgtcgaggagcggtcaatgacgcgaggagcgggcgaagggatcgcttacacctgagacgaactgacgagaacagcacgtaccagaggggaagtccagagtcaaacgcagaaggacggcctcacggagcaaccaagagtgtcagtggtacccgaggcgtctcagcagcagcgaagtaccgtgtggtggatttccaggctgaacgtgaggtcaggcacttctgtattttgagacaccaagagggtggttaaagccatagtggagtagcgaggaatctgagttccaagcaaaaaccaggctccagtctactcgttgaagcttctgcccagcttggatggtttctaggagaacctgcgtcatacctttatctataggccttcccctaggtgcttcagaagcatcaagttttaactgtggacattggattgggtggaacgaggaatcagtgacgtgttggcaagagtagcaagatgctgcagcacgattgactatagaatgagatgtatcctgcaagatggccgaatcttcatgggcacctttaaggctttgacaagcatatgaatttgatcctctgtgattgtgatgagttcagaaagatcaagccaaagaatgcgaagcaaccagagcgtgaagaacagcgggttagggtctg

SEQ ID NO: 618627 - DNA, 976 bp, Homo sapiens
ggggtgagggaggagttgctatatcaaataccattttcatagtttttgaagatgggttttttccccctcccaaattcactgcattacagtttttgcaaaccagaacgggagcaaacgaaacataaccaaacagtgctggcatccaatagcatggtacaattcacttttcatttcttcatcaaagagtggacgacgaggaactagacaattctcctaggctgtggagaatttacaactgtttagtaaccttgtgcgtccatatacttcaaaaatctacaactttctaccttcactaacctcctacttatgaatcaagaactacacttctggagaccagatgaaggtactacttaactaccatgacccctgctgactctgcttctgtggaaaccaataacttctcttctcttcataaccccagtggctcactattcgcatgaagtgggatccaaacatcttgggcatacagtcttctgtccgcagcccaggtaggtcaggccatcatctgaaccacaggcgatataaaaagaatgctctcagtcacactccataactacgccgcacacgtactgcaagctggtccactcagccttctccttcacaagtacgggtcatcaagcctcctcagactcttagggctcacacacaatttaccacggcttcactcactcactggaagtctcatggtaaattaaaggattctaagtgaaaactgtgccatctgacctgggaaaatataccgaagattcaggcaacaacatccacgcagggaccaaggagagggaagacaccaacacatcgcaattcgggcacatggaaccaaacacgcactagcgtggaagaccaccacggctcacctctggcagcaacccaccaacccgcgagacaccacctaaagggcaaccccatgaggccacacccgctgcatacccgcaagcagcacgaatatacgcgcgcgacacaatagccagcacaa

SEQ ID NO: 618628 - DNA, 463 bp, Homo sapiens
  misc_feature (42)..(42): n is a, c, g, or t
cacgtggttgttttcgtttctcattcctagcctgatgcaganggtcacgcctgtaatcccagcactttgggaggctgaggcgggcaaatcaattgaggtcaggagtttgagaccagcctggccaacacggtgaaaccctgtctctactaaaaatacaaaaattagctgggcgttgtggtgcacgcctgtagtcccagctagttgggaggctgaggcaggagaatcacttgaactggggaggcaaaggttgcagtgagccgagatcgcgcaactgcactagagactccatctcaaaaaaaaattaaaaattagctgggcttggtgcatgcgcctcccgtcccagttactcaggaggctaaggtgggaggattgattgcttgcgtccaggaggtagaggctgcagtgagccaagatcgaaccactgcactccagcctgggtgacagagtgagaccctattccaaa

SEQ ID NO: 618629 - DNA, 187 bp, Homo sapiens
tccttcatcatacctaccattttcttatgacagaactactgtcaaacatatctcctgctatggattctataatacagttgttgaacagactatattagaactccctatttctttgttttttattttttttttgaacaaagtatttgcttcgatgcgccaatgtgtgcctaacgggggcccgttgtgg

SEQ ID NO: 618630 - DNA, 915 bp, Homo sapiens
  misc_feature (421)..(421): n is a, c, g, or t
atgcttgggattgcgttctatcagcacgcatagcacagtagtcgattaaagggtttcgttaccatatattaggtccttgataggaattttttcacaccgcactatataagggggcgggccaatatacagcgcgaactactcctccaaagagggtgtgtttgtccacgcaacactgcgtgggaccaaacgtcttgcacaatgtggcgcccacagcagtttctgcacggcccctgctgatgagttttacccgacaatggccacttggtgcgcccttgtgcaccccggggcgttgtttctccccagcccttctttggggcgcgtttcctctctgtgggccccccccagttagagggtaccgctgctcgcccccactgcacagtgttgagaaccaccgactggcccgccctcaccattgggggcnccccaatctgggaaccctggaaggccactataacccgcccacctgctgcaaaaatgggagtcaccccccccaggcgactcataggaagtgctcgtctgtaggcgggaaaccccttcaatcgggcggggtccagacccggtgtgagcccccctcccgctaggggagcaaaacaccccctggtaccgtggggcaaagaataaccagcggacgtttctctgaggagtcacagttgctccacccacggtcagagaccctgggcaggatgtaccccgctttgctttcaccgacgtcatctgcctggactagatgttttcacagcgcggtctttatcttcatagttgaatacaatgtgcacaagaaatttcaagcgctgaaagctcgttcaaagcccttcatgcataattcaggggtccgccgccatgattggggcccccaacgatcatcattgcaaccgttatttgagaaaaacatgtttgggccccccgaaacaacat

SEQ ID NO: 618631 - DNA, 190 bp, Homo sapiens
ctctagctcggtaccccgcctcgtcctgtggcgcggaggattggctcacagtcggagcaatgcggttgaggatcgtggtgaacgacttaccaatgcatccccttccacgagtggcagaattcagcgtgaatcaatcgtcaattgcatcgccgtgacgggataccgtcagtgcggactgcaggctcgggga

SEQ ID NO: 618632 - DNA, 230 bp, Homo sapiens
aacattgacgacgctaaggatgccatgatgccatgaatgggaagtctgcagatggacggcagatccgagtagaccaggcaggcaagtcgtcagacaaccgatcccgtgggtaccgtggcgactctgctgggggtcggggcttcttccgtggggaccgaggccacggccgtggactctctagaggcggcggggatcaaaactatagaaacaacaagttagagtacagacgt

SEQ ID NO: 618633 - DNA, 634 bp, Homo sapiens
tccgtcgtctagaggatcccagagatgcaggctcctagtgctgcgaaacttaccaatacctaaggaataggtggatggatggcattactgatccctacattactgatcgattctgcatccgaaattgtgtagttaaaaacattctacatcatgtgtggggagataaggcggatagaatgaagagaacgaatatcatcgaggggaagtccttctgaatacaaaatgtgttgaattttttaaataagtattacattcacagggctcaaactatttgaagtaaagagatgatatatcacgaatccatccctcaacttacccaggtgatcacgttcacttttcctggtgtatctgcccagtatacattcctgcggttatcagtcaaagaatgaatgatacgtgtcgtcttcacttcagttcattctggtcaggtagcagactgtgtagactagtctgcactggcctttttcataacaatctatctgtggcgaactttccctatgagaacatacagagctgcctgtccacggtcgcgtgtactgcattatgcaactccattatattttatgtaacctgtccactgtagtgaggcacttgcagtggtgtaagtctcgtgctatcaaacagttctgggatg

SEQ ID NO: 618634 - DNA, 913 bp, Homo sapiens
atgagcggggccccgtggatatggatgcagtctgcctgtctgcgtggctgccgtgagcccacccaatgggtgccaaccacctgcaaggagctgaagtgcgtgtgtggatgccctgagtctgccgccggcgtcgtgtgcctgtcaaagaagatggccagtggagacagccagctgtggtcagagtgtgtagcgacgctaggccatcggctgcacgagctagctccatgccctgtgctttgcttgcggtatctagcacgcttgttggaccacttgtgcttgcctcaactagtggtcagcggtgtgtagtgctgtgttgacagcagtgtgccaagcactgaaccacgaagattggcatatttcctaggccttttgcacctgccccacgcttgcttaccattggcccaggaagggaccggcagtgacgatcaaccataagaagcacttgcgcaacaccattggcctctgccctctgcctagccacgctcgtaacgggtatctacacccccactggttacaccacgcacttgcagtggacacacccgatacgggaatgctacccacgctttactctactacacgtacacctaccgcagaccacacggcccaacgcttctcggcacacacctcatgctcctatatgtgacacaaactaaaccatgcacttgggccctcttctctacaagcgggcttctataatataccttaatatacatctgggcgcatctcacacgcggcaactgcacgttggtgggttataaaccacggcaccagctaacgtgaacacccaacacccccgccatggttcccttacgctttaaccatacagcttctccctacaacattacccctatcctatcacatccgcgcacctactacggctctggacgcaacatccttctacttcccaagcgac

SEQ ID NO: 618635 - DNA, 347 bp, Homo sapiens
ctagtaaaaatagaggaatagccaggcgtgggggcagccctgtaatccgagctaggcgggaggctgacacaggaaaatgcatgaacctgggaggcagaggttgcagtgagcagagattgacaccacgtgcagacgagactcggtgccgagacgagatctgccgtgggcgacacaggtgagactctggtctgcaaaataagataaatgaagtaaactggaacctccatgagctaccctaggcttatacaggattcagtattactttagagaaatctaggcatatagcactacggaggcggggaagtataggctggcaacaacttcgtagctacgcaacctgatgtcta

SEQ ID NO: 618636 - DNA, 129 bp, Homo sapiens
ctgccagatcattattccacagaccaagtcatcgaaagtcagatatctacgtctgcattgatctcctatgcgcacatatgatgcatgcacatgggatgacatttgcaaatggtaggacatctgtggaac

SEQ ID NO: 618637 - DNA, 468 bp, Homo sapiens
tgtttaactcggagagtgcttccagctcgcagatgcttggagtctagtccgtacctcgctccattagagttctcgatgccctacatcagctgagggcaggaaatggaactttaatggaagaaccactttgatctattcttttaatccatggtttcagttctgatttcagcaaacatgagcaaaccactttgactgaaagcagaaagagtgaaaattctatttggttccgctactggtgtccaattattagttggtaccatttttaatttatgtcagttgatgcatctaaaaactaagtgcttggaagtgtccgtaccctttattttcttttaagatttcctagaaaggaatcttgggtaaattccagaattgagcagttcaaagtttttggctattttacctttggtgccaggctgggcatatataaattttagggttggatgctttcaagcccttaaattttattat

SEQ ID NO: 618638 - DNA, 110 bp, Homo sapiens
gtacgagcagacggtgaaccaggagattaactttcaaaatagctttaacatccacgtgcgtacgcttgtggtcgcgcgaggaggtggtctataggactgatgcatctgtt

SEQ ID NO: 618639 - DNA, 447 bp, Homo sapiens
atacaccagcgcctgtgggaacttacatttttgcatcagtttcctcattgataaattggaagaaaggtacatggtagagaaggttacattagtcgatatttgtaacaagtcagggcacataacaggccctcactcaagagaagacacttttgttctcacatctcccttcttaaattaaggagcatctgccctgtatacaatcctgcacaaaaataaatccacgtaaacaaaatttcacagtaactacaaaagcctaatgatcattaaaaattcctgggagaaacagatgaccgttcactaattaatcgggtttagataaatcaagcaccacttaaagaatcactgctccttaaagaggtaaatgcaacgattgtcacatggccaatttctaatttttcatttctctggggagacctaaatgatacaatcttagtaataaatttctcc

SEQ ID NO: 618640 - DNA, 206 bp, Homo sapiens
cccggcaagcccttcggtcacctgttggctacaccgacccttcctctcgtgtcagctcaggctgctcgagggccgggatcaacacttgcaggggtccctgctagttagcgccctaccgtcgtggagatcgtaccgctttctttgaacttctacagaagccaagctccctggagcccttgtggcagctctagctatgcagtcgtgta

SEQ ID NO: 618641 - DNA, 356 bp, Homo sapiens
  misc_feature (356)..(356): n is a, c, g, or t
tcaagaacagacactctggggacaggcaggatctaaaacacagaaacgatgctagatgtcactacatgcaaatcacacagattcgctagaaaaaattcattgaagttgaaaatgaaacagcagaattttatatttggtgaaaaaaattcaaatttgagaatttggtgtaaagaatggatcggatgtgtaagagttaatgttttccatttaaatcaaaaactataaactcaagtgctaaacagtgaggctgttccataggcaaacacaaaatctagggacagagggcacacagggcccagaagtgtctggtctatgcgggtcaccgagctttcgaattccgtaaatccataggtcan

SEQ ID NO: 618642 - DNA, 1249 bp, Homo sapiens
gcttagttttaaacagtgaagttgaactgcccgtggaagaggcgggcagtgatacagcgaagatgagaagaccctatggaagctttaattccagtgaatgcaagacgagtacgctaagcaagacccagcgatggtccatagaacataccgaaacctgcgattagaatcatttccgagttgggaggcgacctcgtgagcagatcccgagagtctcctgagtctaatgtacagtgcttaatgtacttcgacctaggtcgatagagcagagactgactaatcactcacattgcatccacatgagacttgtgaccgagacgagtgaaccaagcttacgccgtaagggaataaacaaggcggctgatccattattcgtaggcagttccgagtatcacaaggaattcagggggttttcactggaaccctcgtgagtgctatgggaatctagagacaccaataccagaaatgagtgtgactaagcccgagggtacactttacaccgcgttgtcgctatgtgtatcgacacgtgaatgtaagagggtcggctatcgggtggaagtcatggagtggtgaccagtaacagcgggacgattaaagaccacaagaaggtcaggcattgtccataattcgtagagattgtttcgaggactatccgcgttccccgtggttagacggacaacgacgggggaagcgagaaggcaatggacacaaacattacaaaggggagctcttaaacggataataccagacagatacagaggtgcgagcaccgtttgtcactcacccccgggattataacaactggaacttaagttcaacttccgatccgagacatggaaaggattagtgtgtaacttagcgacctagagatgattcgcgacagagccaccacaagggaaaataccgaaggtggtgatcctcttaggccattgcaaacggaaacttgtgggtactaaatgaaaggacgacccacagaggcagtaagatcttcagagccgactctagaagaaagagtcgctgtacaagacaggacgactgattttgaaagtaccaagggctacgcaaagaaaggggcggtattatcgcgacaagttaacaccgatacgagttataacggtatgatacaaacgaacaacgaagattaaatcgacacaaattgtgggcgcaccatgaatgcagatcacccattatggattgtacccgcataccacgattatggattaggagcccgacacgttagccgtgcagcgtc

SEQ ID NO: 618643 - DNA, 115 bp, Homo sapiens
tgacgcacgctactctattgagggcacaggctttagagcatgttcacttatcaatcttctttctcactcactctatgtcccctttatgagatgagaccagactaaaactcttcgt

SEQ ID NO: 618644 - DNA, 822 bp, Homo sapiens
  misc_feature (1)..(1): n is a, c, g, or t
nggcacacaacattgtcgtcggaaacagactgctgtgacgcgcaaagccgaaggttctgcggactagaccctctccactctgcggcaaatattggttgttcacccgcgaaccaagtgggataccagcgcccctcttgaaactacttgattataggtgtgccccaccttatataggtcctcggaaacacccccacatgggtgctatatattcacctgctgatctgccacacgtgccacctatatcaaaaacgttgtcgcgatctcgctcccaagtacaggcacccttcggcgggggctcccgtccactcagaggtgcattggtctgttccggacacacaagtttcatggttcacgatgcgtgcgacctgaacccggctgtcgtcacccacagcgcccactgttgtgaataaattccgcccctttgatactaaacctgtggcccctcatcttctccaaattagttttccccaccgaggtccgcggtctcaaaaatagatgtgttcgtttggcccgcgtcaccttttttccaaataatagcccacctgcgagaaagtgggagaagatgttttctgtgactgaaaggacattgcatgttaataaggtcccccgccgtgctaaaggagccacaagcgctgtaaataaagtttagagtgcagcactccctcgggcgcccttggctggagaaactaacctttcttttgcttgctcccccaggaaaatttgcatgggttcacgcccctcgcagacatccctggatctttgaaaaaaaatatatatcacttttcacccccaccccaaattaaaaaatgaccaccacataac

SEQ ID NO: 618645 - DNA, 114 bp, Homo sapiens
accgggatggagacggggaagttgaacacggtggtggtggaggtagctcggtcgagcacagccatggcgcggctcccagcctctgccgcaccgcgcggagcccgcagctggaac

SEQ ID NO: 618646 - DNA, 145 bp, Homo sapiens
tcatgtgtagaattccaagctgttgccatgtagctggaaaggcaaagtgcaagacaggaaattgttagagattagactaatgaaagagggaggaaggcagcacgatttaacggctatagaatttttagcttggggaaattatttc

SEQ ID NO: 618647 - DNA, 461 bp, Homo sapiens
tatacagaaggtggcctttgggagttaataaggtaagagagggtagagccctcgtgaatggaatatcgtgcccttactagatatacttgagagtaagcatccacttctatctgccatgtgagaacctcaaaggactgacatctggtaaaatactggaagcgtgccttagccgagacaccagatatgctaccactatagatagttggatttcccagcctccgtgaactgtgagaaataactgcttgtcaaggtcacctggtctatggtaattgggtataagttgcccaaaatggactgagatggtaaatactgagtatcaacttggatttgaataggaaaggatgcaaagtgtaccccggggtacatctgtgagggtgctgccaaaggagatttaccatttgagtcagtggactgggaaaggcagaccattcctacaatctgggtgggcccaatctaatcag

SEQ ID NO: 618648 - DNA, 233 bp, Homo sapiens
  misc_feature (232)..(232): n is a, c, g, or t
ccaacctttacatttgttacgttttccacacgggggaaaaacgcagtccgcccaggtccccgctttttttggaggcaacagcttccccaggggttaaatttggggtaaaattatggattttatttgccctcctccccgttataaaactgcagggtggattgttacaacttcgctggaaacctttggaggttatttcggctgttcctgaaaaataaaaagcctgtcctttccna

SEQ ID NO: 618649 - DNA, 215 bp, Homo sapiens
ggaggaggaagatgggagctgatgagaatcaaagtggaatggagctctggcttttggaaggagagccacactgtggctgggctgagtgagggacgagaccggaacggagcagcgactcaactaacgatactatacattaccccgatttgatagtggaaagtgacttgacaggtcttgccttgcgagcgcagcctatacagtagagccgacctgct

SEQ ID NO: 618650 - DNA, 212 bp, Homo sapiens
  misc_feature (28)..(28): n is a, c, g, or t
  misc_feature (76)..(76): n is a, c, g, or t
  misc_feature (120)..(120): n is a, c, g, or t
  misc_feature (122)..(122): n is a, c, g, or t
  misc_feature (131)..(131): n is a, c, g, or t
agagcagcacactgtctgccccagcagnacctcctggcgtcccagagaaatgaaagcgcaggttcacacccaatcntgctcactaacggtccattagcagctttatttataatagccccnancaggatacncacaccccaaatgtcctttagcgggtgaatgccaaaacttgtggtgcatccacacttgtggaacggtggaacaccatcagc

SEQ ID NO: 618651 - DNA, 943 bp, Homo sapiens
aaccttgcgtcagatgaaagcactgaactgacaattacatcgagcccaagtatctacaatcaaccaagcaaggtctatccattaccctcactgtcaacccaacacaggactatgctcataaaggaagaggtcaaaaaaaagtaaaaggacactcggtccaatctgatccccggctgtattagcatacaaacagtcaccgctagcagtcaccaagtactatacgaaggcaagcgcctgacctcaggttgacacatgtttaaacggccgctggtacctcctaatccgtgacaaaggtggcataactcacttgtgccttatggttagggagctggtatgaatgggctccaccgagggttcatgactagtctccttacctttgtaatccaagtgacatagtatgagactcgaccggtgataggagagctgcggcatggatcgtcacgcaaggagcagaggaagggactccttagttggacgcttgtaacttgggattataccggcaaagaccagttaaccctatacaaaaacccgactacggtcctaaatagttagccaaatcctgctttagaaaaagtttcggtgggggcgacctcggatgcagaaagccaacctccggagcaggtacatcgcaaaagacttcgcccgagtcaaatgcgaatgatgtatactgcaatgtgatccgatataggttgaggcagaggaacctggttaccctagggataacagcgcaaatcctatctctagagtccatatcaacaataggggtttacgagctcgattgttggatcaggaccatcccgcaatggtgccgccgctattcaaggttcgtgcccgacgaaaaagcccacgtgagctgagtcacgaccggagaaccgggcgggctatctactaaagtcctccggttgaaaagacaataaaaaatcttccgggcgccccaaaattt

SEQ ID NO: 618652 - DNA, 300 bp, Homo sapiens
ctgtacaggaagcatggctggggaggctcaggaaactgacaatcacggcagaaggcgaaggggaagccggcgcgtttcttcttaaaatatccctttgaaattctttatggtgcacagatagcgtagaaaataactgttcacactgactgtcatccctctagggtgggggtagggggtatacttggatgattttcccataagtgatcaaacaccagtcgagtcccaaacttcggcgatacatggcaggtagaattggtgacatcactcagtgcacaaagtgagctcagagcttctccccga

SEQ ID NO: 618653 - DNA, 982 bp, Homo sapiens
  misc_feature (9)..(9): n is a, c, g, or t
  misc_feature (69)..(69): n is a, c, g, or t
  misc_feature (248)..(248): n is a, c, g, or t
  misc_feature (761)..(761): n is a, c, g, or t
  misc_feature (823)..(823): n is a, c, g, or t
gacaccagngtttaaaggtgactaaaaaaagggtgtataagatgaattattgtattataataattttangtttattcttttgtgtatcaataaagtttgtttgtttctattagtgtttaagatatgagtataattgataaaattaaagaaatatattattataagtgcatatggtggatggaaacacatgttagatgttgatgagcaactaaaataaatataaccctcccgtaccccatgttctgcanttcttaccacccccacttatcacccgggttagcaacatccgtatctcaatatctgtattaggtatactagaacgtattggtagacaccacgacttctctccgtcgtaacggtcgcctccctacgcttcactgatctccccatcctcctcctccgctccagaggcgccgccctcgcgcgtcgtttcgtcgttcgcgtccagacacgggtacaccaccctcccgccgcctgcgccacccctcctcactccccccccccttaccaccctctactctcgctgctaccactaccaagagcagctcgttatcccgcgctcttaccctcctcaccctacgcactcaacccgtcaccccacgactcactcctccgcgtactccctcaccgcacgcatcgcgctcaccgcaccgtcacgctgcccatttcctctcgtccagtgcgatattcacgtctcgcgttgtgctcatgctacagacgtactcgtacgtgtccacctgagtcatatctaccacttctcnacaccctacgacagcccacctacccctccacaacatctcctctcaccacccgcctgttgctntcatcatctcttaagtcgttgtgatagcgtctctgatctgtctactctccttctcctctaccccctccactaccccaccctcctcccctctctatctactccaccccattcttgcgccctcttccactcttttcactctctaccgctatacacgacgcg

SEQ ID NO: 618654 - DNA, 401 bp, Homo sapiens
aggcggcacgaggcggcacgaggctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccagactctgactctttttcagttttgctatttttttaactatttttaccataaatttatttggaaaagctttggaatgctttttaggtattttaattattggtcagatgcacaaactcagtccaccaaattattcacagagaaaactttaaagataagaaaacaatgaactcagatgtacaatag

SEQ ID NO: 618655 - DNA, 1232 bp, Homo sapiens
  misc_feature (33)..(33): n is a, c, g, or t
  misc_feature (483)..(483): n is a, c, g, or t
  misc_feature (548)..(549): n is a, c, g, or t
  misc_feature (564)..(565): n is a, c, g, or t
  misc_feature (575)..(575): n is a, c, g, or t
  misc_feature (648)..(648): n is a, c, g, or t
  misc_feature (655)..(655): n is a, c, g, or t
  misc_feature (816)..(816): n is a, c, g, or t
tcttgttataggagagtcgcttgagcccgggangcggaggttgcagtgggccgggatcgccccattgcactccagcctgggcaacaagagcaaaactccatctcaagaaaaaaaaaaaagaaaaatttagaatgtgttagagaaatttaacaagtagaacaggtgatttctggttgatagactctatctggcagtatatttatttcatgtatcagaccccaaagttgttgcctgtgttattttttataatttctcacatttttggaaaaatagatgctatcctctatagtaaaatatggaatcactttatagtagacaatacatatgacatttaacaaatactgggtttggacaaaagttgggctttattccaacaattttagtttggcccactgattttcaaatgtctggggggatggcttataactaagtagaaagtgaagattggatttttacttaagaatggggatagagatgagtttnatggtttttaaaagtatttccagttccattatttaaatgtggggtggtggatatgggtcctggtnnctggataaggaaatnnggagcaactngttttaaaataactacactaaaagactttcttcatctccgtatagagaaatccagatttcaattaatccattnatggggngctaacaaaattcagggttagagtaaattaggtctgtggtccatgtggcctggtttcctagcacccattaaacataatgctatctttaagcctgaacatgggggtttcttaaactcaacctgtgcccaacaattagaccacctgatgtcaagcggagcctngaggaatccccatcttaaacaaagtatgcggggaacatatcgactttattttcgcgggcgtggaaaccctatatcgcggggcaagttttacggggcgcacttctccattcactcacgagaattaacctggcaagggcgctcaaagggtgccgcatattccacggcggagcgtagttccgcaccacacagggcctgtcagaacgttgtcctcccaaccagagacgacgggtgtacagcaaagagcacctccctcattaataaagcccagcaaacgtcaccacaactgctgggcccactgctgcgacagcactcacgaggaggaagaactgaggcggtaaacccaaggctgatctcagaccagagtaacgctatgccagcagctcgtctcttatcatgtctgttcgactctcaatcag

SEQ ID NO: 618656 - DNA, 100 bp, Homo sapiens
gaggtgattctagaggatcccggtcaagtaaccgtcaaagtaacttaagaaaaagggtatttattggttcacataactgaaaagtccagggatattctag

SEQ ID NO: 618657 - DNA, 1114 bp, Homo sapiens
atgcactcacctcgcagggacataatagggtttctccgctggcccttgttctgggagcgcgggactccttacttgctccggtggtgcccacgattgggttcattactggtgaccacttcgtggcattgcacccgcgtctgctctttcctgccttccctgggctttagtcttacccttgggaggtctagaaaacgaacgtctaaccgctccgaaccctctcaatgactcttttgacatcccaaggtatgtcagcatcgcctcgagcggccagaggcacacggaggttcatgaccaaggatcgaagggcacatcaaccactggttccccaatccgcagatctatagagcactactccaggtcaagtgtccacgacggctgagctctggtatctctgatcgctagaatccagagacgtcatcatgactcctccttggagacatcacctgcgctgcctcgctaggaccactggtctccatcttccaggtcccacctgcgaactacctctgtttacctgggcactagtacttggacccccaccgacgaagagaattcgttcactcacgcactcacggcgaactcgcgccctccagccgtgatcaccacgctccctcgatcccatgccttctcatgcgtggtacccagatcctatagaatgattgcatgcttcctcgttccttatgaagcatcatcagtagtcacaccctcacagctggcatgccctctttgccagggatattctatcttggtggcatattcactacccttcccatatctggatcgtaacgttctgcccggtcagcttccctgccgttttcttggcgacggtgagaagttgtgccccacagtcctccaaaaagtgattccatacgtactatattctgagtcagcctgtcccccgtatgttggctagccctcatctggggatggactgggtaaatgtttagacatgaggccctgccaccgattcacagatcctaggccctagagccagccctcgtgcttcctccctcccccaacactccctaccaacccacctaatccccgtactccctccaccccccctccactgtaggccactggatggtaactgccatcgccgtaaatgacgagcgtg

SEQ ID NO: 618658 - DNA, 272 bp, Homo sapiens
  misc_feature (23)..(24): n is a, c, g, or t
actagtccacggttggctaaccnngaaaccccgtctccagtgaaaatacaaaaaaattagccgggcgtggtggcaggtgcctgtagtcccagctactcgggaggctgaggcagtagaatggcttgagccctggaggtagaggttgcagtgagccgagatcgtgccgctgcactccagcctggcgacagaggggaactccatctcaaaataaaaataaaatccagaaagccaaatatattcatttaaccaaagccaaccgtggactagtgggt

SEQ ID NO: 618659 - DNA, 125 bp, Homo sapiens
gcacgaggtatatggaatattagataattcctatactatgcttctgtttgttttaaatgatgcagatcaatctgaaaattcataagtttagtatatggaatattagataattcctatagatctgt

SEQ ID NO: 618660 - DNA, 143 bp, Homo sapiens
gttttaggaggagctctgttgtggagaagggatgaggttgctgcagcccttgatctcccttcgtgagacgacaccgggtcctcctgccaccccagggagtgccaggatgctgatttgaaggatgtaaatgtgattccagccac

SEQ ID NO: 618661 - DNA, 663 bp, Homo sapiens
cgggggggcgggcggaagccgacaggagggcggcatcttgcgcgcagctggagtcggtgctgaggttgcaccgaagagtgccccgccgcggcccagccgaagctctttcccgccgcctctccgcgcctcgccaggtggggtggctgacctccgttggcacggcccctgaccctcagtccggcctggtccggcctcaaccgcccggggacgatgaacggagataaatggtgcccaaggcagacagcggcgccttcctgctgtcttcctgctcgtgctcactgtcaccgagccgctgcggccagagctgggtgcaaccctgggcagtttgcgtgtcgcagcggcaccatccagtgcatcccctcccctggcagtgtgacggctgggcgacttgcgaggatgaagagcgaggactgccaactgtccagaaagttgacgggggagggtgcgtcctcatcatgggaacggacgctgtggatccgcggcagggcgggcacagaggcgaccattcgcacttcacgcggtgaacgtgcgcacccgtacgttcagaagttcctagggaaagtgccccgaagggtggcaccacactacgaaggcacgcgcaggttgctcacgggtttacctgaccggggagaactactgggatgcggcagactgccacccgaa

SEQ ID NO: 618662 - DNA, 710 bp, Homo sapiens
gtcatagacataattgatcaatttgcaatggtgttcttgacaggtcgttccaggggtagatggaggcatgaaggatgaccgtcgggacagatactctgcgggcaaaaggggtggatttaatacgtttagagacaggggaaattatgacagaggttacgtctagcctgcttaaaagagattttggggctataaactcagaagttggtgtttacagtgctgctaaattacaccaatgggagctttggaagtaattttgtgtctgctggtatacagacccagttttaggactggtaatccaacagggacttacctagaatggttatgatagcgactcagctagatgacggaagtaatgttccaaatatgctacaagggtatgaaccaacaggctagtatgcatatcctgctactgcagctgcgcctatgattggttatccagtgccaagaggatattcccaataagactttagaagtatatgtaactgtctgtttttcataatgtggtgcttgatattgtgtgtatctgacaagatagttactttatagaaacatgggaatgcagaagtgactgtagtgcagcagtgattatggggcactttttcggtattaggtggatatttctctacattcctgaaagcaattttaagtatcgttggtactagaaaatgcaggcagtgttgcacgaaaagtacatgtcagtgatttgaata

SEQ ID NO: 618663 - DNA, 142 bp, Homo sapiens
aagtaggatgatggtcctgggccaccagcctaaaccttgcagccttaggaaagacctgtgtcaacaggcttgctccctctctagacagggctcagcacctccaggcatcctctgcattcctgctgagatgggcagagacatg

SEQ ID NO: 618664 - DNA, 155 bp, Homo sapiens
ctctctgcgtggtgaccaagatgaagatgcagaggaccattgtcatccgcaggtaatcgataaggaaacccggacgctgctgcccccttctttttttcaggcggccgggaagattgcggatattcagactgagcgtgcctaccaaaagcagccga

SEQ ID NO: 618665 - DNA, 155 bp, Homo sapiens
tctgagaggctatgtgaaagtgctgaggcaggttgtggccgactgcagtgaaggcgggcgggttaggtgcccggtgattgatgagctgggctcgagctagcgtcgaagctacgaccctgtgccgatgacagcggtcagcctcagtgccgtgaagg

SEQ ID NO: 618666 - DNA, 172 bp, Homo sapiens
tgtatggaggcatacacagtatctagcaataagtcaaattttcgtcaatatgtggtcgaatgaagcatctggatcaggtagtctagtctttaaatataagatagattatgatagcctcctggaaagctcgcaagttaactgtaaaatgaagatcgtagaaactagtgatgga

SEQ ID NO: 618667 - DNA, 793 bp, Homo sapiens
gctcatcatcctacacgtggcccccaatgacaggcccagcacgaggatggatcggctgggcgtgggcttcaggacccaccagtggagctgctgtgctggtgcgggtggatcagcgcctccggccttggagactacctgcagctgctacatcgaccaggcaccgtgggggtgatctttaacggtgggcacggacgacattaccatcggacgagcccaatgccatagtaagcgacggcaaataccacgtggtgcgcttcactcgaagcggcggcaacgccaccctgcaggtggacagctggccggtcgaacgatgctggtacccggcaggacgccagctgaccatcttcaaccagccaggctgccatcaagatcgggggccgtggatcagggccgccccttccatgggccggtgtgtccggcctctactagaatggggctcaatggtgctggctgctggctcgccgagagcgaccccaaatgtgcggactgagggtccacctgctgcctggtgggggaggggccgtccgtgctgctcagtgcgtgagaccgtggcaccatgctgctggcttgacattggacctaccacacatcgatggagactaccaccaccatggcagtagcacacgcgcctggggccggtcgccacactgagggacaggaccacccaagaagagcagatgacctgctggtggctctgctgaagtgtcaagcgatgatgatgactggaggaatgtgagccccgtcctggaggagagtatattgcctttcacggagatcttagcccagcgggatg

SEQ ID NO: 618668 - DNA, 156 bp, Homo sapiens
gtgggcaaatataagtagaactaagatactatacttggacagacagctatcaccaggctcggtaggttagtcgcctctacctataaatcttacccactattttagctacatagacgggtagtgctcttttagctagttctataaggtagctcgtct

SEQ ID NO: 618669 - DNA, 932 bp, Homo sapiens
tgggtgctcgcggaggggcagtgtacgcgggtccgcttgtaggctgtccatgcgatggatcccaccgcgggaagcaagaaggagcctggaggaggctgcgagtgacatgaggagggccgtgtataggatcgcatgtgcctataacctgcccgtcgcattgagagaattcagcatatgtgaagcccattagaccgggggcgtccttcggagtaggagtgtatctgggtgcagaaaggcggcgaagatctgtgatgtcagtcaagaaggttgttaacagatagagccagacatgtatccacactaagaatattttgactccgatcgagggtccaaggactagcgcagagaatgccacttggtcgacttaaatgcaaagagtccccatctcgattagtccatttagtatttattcactgctagtctgcagaggcaattgtctacttggtcatatgggcatatcttattgggggagatgtcagatgtctctcctacatagtattagttggttactctttggattgaagcagatggctgtagaaaattactacttttctggacttgtacgcactggctctaagaactaaccttcatcaggaccagtggtaatcatccacgagggtaccttgagaaccggacaatatgcttatttactatatgagggtccctagttaaaggtggacggattttgggcccttatcgaaaaagtttggcttatgaaaatagcaggaatattgaatacttgatggatacttccttaacagagatagcgtaacagagtggcaaaacaaccgtatgacaaagcattatttcaaagaatcccctatggacacacaggtggttatcgccgttatccacctcgttggggatttaaacgcccacgccaagtggccgggaaaggaattccaaggacctggcagacattcctttcaggc

SEQ ID NO: 618670 - DNA, 854 bp, Homo sapiens
  misc_feature (28)..(28): n is a, c, g, or t
  misc_feature (127)..(127): n is a, c, g, or t
  misc_feature (298)..(298): n is a, c, g, or t
  misc_feature (306)..(306): n is a, c, g, or t
  misc_feature (312)..(312): n is a, c, g, or t
  misc_feature (324)..(325): n is a, c, g, or t
  misc_feature (368)..(368): n is a, c, g, or t
  misc_feature (406)..(406): n is a, c, g, or t
  misc_feature (411)..(411): n is a, c, g, or t
  misc_feature (413)..(413): n is a, c, g, or t
  misc_feature (486)..(486): n is a, c, g, or t
  misc_feature (679)..(679): n is a, c, g, or t
  misc_feature (708)..(708): n is a, c, g, or t
  misc_feature (718)..(718): n is a, c, g, or t
  misc_feature (806)..(806): n is a, c, g, or t
gcagtgtgctggaaaggttgccgcctgngatgtccgatgagttgatttagtcgcctggtgtaaggagagtttcaggaagttttcctagcctggaagagtcataactgtatgtgcgagtgcgcgagtnatggaaaccacaccagcatgtatcactaaatccagaataaatgtttctttaaatcaacttacattgcacaaatacatgactaagcagacatattgctcagggctttgctatgagcctcacagtggctcacaccaaacagcagcctggaacgaggcactcctaactgggagntaccttcnggccgnacactgggggtnnatttcctgatggctcacttgtcaccctcctctccctgcctttnactgttcctgcggtgtggcaggaagaacacatcctttnttttncngtgccctctttttggccttactttgctgtttggtgtgggggctaataactgcctaagagaggtgtggctagtnattgggttcccaaggagataagagttgaggaatcctggaaatgagctgcacagctttttggattaagcagccgccctggccgccgcatcctcggtggtggtggtggtggcagaagattgtctcccttcctctactacctactactagggtttgtcaacagctttccacacttaggttggagtaaggttctctnagacaagtttggagggagacttgggggtntggagagacnaagagctcagaaaataaacatctgagaaagaaaagcaatccctggttggtaggaggttttgtggggtgtgggatgtgcaggattcaangactgctcagccctgtcctgtagatcttactaaggtacaaggggccaa

SEQ ID NO: 618671 - DNA, 139 bp, Homo sapiens
tggtgactcgggcattactactgcgctggtttccattgaaatgcttcaacattgagtcatcctggatacatgacaagcctgtgtaatgaagcctgggtcctttaacaccttgctattaattaattccaacataagtgag

SEQ ID NO: 618672 - DNA, 153 bp, Homo sapiens
cgtgtcgcagaaagagaaccgactttaacttaactttacccctcacccttggctgccctcatgcaaatgcctgagtgcctcagaaagagaatgtcatacgtggagtcactaccaacgctttggattaagagaaatctaaattgctcaagaatc

SEQ ID NO: 618673 - DNA, 1325 bp, Homo sapiens
  misc_feature (1325)..(1325): n is a, c, g, or t
agtctttttcctggcctggcccaggtagaaatatagacctgtcatgaaaacttgaaagagtggggcttcaccattattcaattaacttactgtgccccttccttcccgccagtggcagcttcgttgttcattcagtccttccttcttaccgtgcttgagattgaagaggagttttctttcagcattttgtgccagtgtgtgttttatcaagaaatgtgggggtgctgtgggaagggcctttgagaggtttaagtgccttgtggacttgttaagaattttgttaacaaattcaggtgacttggcaacattggcaaccacttggtgggtgttttaaggggtttctttccccttattatgtgattatttctatccttcttttccagttctttaagagattatattattaggcttgtgaggcagaaaaaaagttgagagattgttgggcttcaagcctgtgaggattgacgttgggaccttgagtgctatagagtgctctacggcacgttgcgactgtggcgcaacacgggtgtgaagcgtctgtgattttggggcccaaagttttccgggggttccactctctcttttctcgtcttcaaagccaaccgcattgtgtgttcttattgacaggtgtcaattacaagagaacaattatgagggggcacaaggagttttttggcagaggacaggtccagttacgcaggcaacaaacagcgaggggcaaggggacaacagggggcagccagaacgtgtttaaacccaaaccaattaccattagaggggccacctgggttgatgttaccccccagatgttctttgcggagaaaggcccacgcagtctcaagtcgcaggcaaatcttccttacaggaacttaaacccaaggggcactaacattggttctacaattgttgcgcccttaccctgtggaccccttccacacccaacaggtgggggctccccaacactttgtgatttgggccactggcaaccgctctctacaataccaaaaccagagcacacttttggggcccatcacccccatataattagggcgctccgtcgggtgggcagaacccgttagacacctcctgttggggcatctgcgtatatcaagtgagggggaacctaccacagcgatgcgtggctcctcaggagagaacaccaatcatcgcttgcttgccccccgaagtttgtccaagaatattctgtagggcgaagttctcaccgtgctccgacggtgggtcacaaccagatttcatccacaaaatgccgtgtcaatagagaagtccccgctcttgcggggtactgtaaccgcgcccagacacan

SEQ ID NO: 618674 - DNA, 238 bp, Homo sapiens
cgcaactcactgatacagcaaaggctctgaggggacggactcctaagactgaactcacattaagttagacatgagactaaggcacgacgtggggacacagagtagcgtgttccggcacccagcaagcacggtattgctgctggacatgacatacaaggtggaagatgaggcccagttaaactggtatggtagcaagagtgctgaccacggaaagcatatctcccgttgacgacagctt

SEQ ID NO: 618675 - DNA, 798 bp, Homo sapiens
ttgtgaatccaataggaaagtacaaggacatggagattgtcagagctgttgtatgatggtggcagcagagtcaagagtccagcggagaggcagcaagcatcccaaggatcccatgactgagaaccagcttctgtggtttagaagcaaggcgccaactggtatgagaagcacagacagatggtgccctgggaacactggctgtcacgtgctggaggaggttcctcagcaagtcaccttccctccatgggcctctgttggaaagaaggcatcaagatcattccagctatgattcctgagcttttaatatattctttctgatgattaagaaatatatctgtcgagcatggcagcttacgcctgtaatcctagcactttgtgaggccgaggcgggtggatcatgaggtcaggagttcaagaccagcctgaccaacatggtgaaacctcgtgtctactaaaaatacaaaaattagccgggtgtagtggtgtgtgcttgtaatcccagctactcgggaggctgaggcaggagaaaacacttgaacccggggaggcggcagcgttgccagtgagctgacatcacgccactgacctccagccctgagtaacagagtgagactccatctcaaagaacgacaagagattatttctggctgtgacatggaaagaggtccagaatatcgacactttacctacagatcttgaaacaggtctccaaactacttccaatccccctggggttctcaactcccatggttctaaattggaccagactcaagaaaaaagttattccccactatgtgc

SEQ ID NO: 618676 - DNA, 312 bp, Homo sapiens
gggcctccattcacagctcagtgctccctctacctgtccagtgttgcgcacttattgttccagtcaagaacgttacttaggccacggtgcggtggctcatgagaatgagtacagaaagactacgaatgcatcaaataaaaatgtctggtgactcattgcttttcgctggcggaataattccgtttacctggggcaagcagctatctggaagtcttatcaaggaagatgcagaactgagatgacagggctacaaagatgcattgtggctgcagctacctaagaccaccaccatcaccatcaccaccaccatca

SEQ ID NO: 618677 - DNA, 245 bp, Homo sapiens
cgtcgttatcacgtctcgtggcggcgttgccattcgcatcaaagacgtggcgacagtgggcatcggccgcgaaatgagaaccggcagcgccagcgaaaatggggaggaggtggtcgtcggcaccgccctcatgctgattggcggcaacagccgcaccgtcgcggcagcagtagacgccaaaatgcaggatgttcgtcgcagcctgcccccggggatcgaggcgaacaccgtcctcaatcgcacac

SEQ ID NO: 618678 - DNA, 335 bp, Homo sapiens
  misc_feature (221)..(222): n is a, c, g, or t
aagagggacctgacctcggggagaccacctgatcctcacctgagccaagaggtcccaatctcaggagaccccctgatccacacctgagccaagaaggtcccaatctcagggagaccacctgatcctcacctgagccaagagggacctgacctcaaggagaccacctgatccacacctgagccaagagggtcccaacctcagagagtccctgctcatcatcnnggccaggagggccctcgatgcatcaatgtggtcaccaaaacctttcctcatagaaaacctgtaaagtctaatgctagatacactatattcctgagcttcagaagaatatcctt

SEQ ID NO: 618679 - DNA, 389 bp, Homo sapiens
agccgtgtgtagagaagggccgactattgagatgcaaaattgctgagcggttcattttcttctaatgtcatcactaactgttactgggacttggcagctcctccttaagatcaaatgggttggaattcacttggaatctattctaatgagaaagaagacagtctttaactctgataaaatagtgcttgggatccactgactcttggttggagagaagaaaaccacatgggaagctggcagaggggaagtcagaggaagggagtggtgtccagagaactccaatacagctgtgggctcaggagctgagtaggaatgatggtttcctaattgtgaaaacaggaacaggtgccactacaatgtacgccaaaaataaaataaaaacatgatgt

SEQ ID NO: 618680 - DNA, 235 bp, Homo sapiens
gtgagacgacttatgtgtgtgtgtgttactgtacttgtgacagagggaagagtgtgagtgtctgtggacacattgcggatagtggtgctggcacgtacagggttgaccaagtaagagaggcagactctaagactatgtttctgcgtgtcaggttaccaggccagaactctctctctcttctctctcttttaccaggcccaatgtgttgtcgacagcccacacatttacttcccag

SEQ ID NO: 618681 - DNA, 807 bp, Homo sapiens
gagaatgcgtggctcaggcggcggtgctctttgatcgctgacttctcaggccctcaggtcggagagaactcttgttccagcatggttacccccgtttacccgctccatcatgtacaaaacggagtcttttcgcgcgtgtggacgcgacgagttcggcaggagagaatttgatcgctgctgatgagaggaggcgaggtcccgatgaggctgagggtcgcgaagcctggctggcgtgcgacactgagaggcgacgagaaagaagtgcttcacgaacggcaagtacgaaggccaagcaaccagacagaagcttcagctaaaagtgggcgagacagcagaaaactgagcccacaaagatggaaggtaggtaggccgagataccgggaggctcaaactggtctgcccaccagcgtggaagcgtgtaggcgacgagaacgggataggcgcattgaagaagtgcggcaggaacgcagaatccagacggacccgtgcgtgacgtaggactgaatgcttgagtaagtttgtctgagaactgactttgtccccagcgccgcttcctaacatatccaaagactgtatctggtgcagctgtcattgtgtatttttgtccctccttgagcaaatattgttacgaagctaatgtagcgagctgtatagggtagatccatgatccagactgtcagatgtgtgcacggggctaaagggcgagaaactgaaagtgtcgaacttctttgtctaaagtgtggtctttctaatgtagctatctctcttgttgcatcttgtctacttcagtacacttggtgtactggc

SEQ ID NO: 618682 - DNA, 193 bp, Homo sapiens
gagctaagaggcaccaaggaggtgtgagcatagatgctgtgtacttctgcatggggagtgtgatggttaatattgagtgtcaactttgattgaattgaaggacgcaatgtatcgtcactgggtgtgtctgtgagggtgttgccaaaggagattaacatttgcgtcggtggactgggagaagcagacccaccct

SEQ ID NO: 618683 - DNA, 269 bp, Homo sapiens
tgagacggagtctcgctctgtcacccaggccggactgcggactgcagtggcgcaatctcggctcactgcaagctccgcttcccgggttcacgccattctcctgcctcagcctccccagtagctgggactacaggcgcccgccaccgaacccggctaattttttgtatttttagtagagatggggttttaccatgttggccaagatggtcttgatctcttgaccgttgacgcggtctttaatttagtatttgtagtcgttccttgtattt

SEQ ID NO: 618684 - DNA, 438 bp, Homo sapiens
ggtgactcaagatccctcaatcgacggttctcctgttctacacagtccacaagctcagcctaccgtaactgtcacccagaaggacatgaagtgacaggagacaggagaagggagtgatagtaaggagagtcaagaacccaatcagatgaatcaggggaggaacagaatggagatgaggattgccagcgaggcgggcagaagaagaaaggaaacaaacacaagtgggttcattacaaatagacatgaagcctgaagtgcccagagagaaactggcttcacgccccactcgcccaccggagcctagacacatacctgccaatcgcggggagatcaaagcccattttgactaccagtttggctaccgaaagtttgatggtgtggaggggcctcgtacgcccaagtacatgaacaacatcacctactactttgacacatgtc

SEQ ID NO: 618685 - DNA, 1601 bp, Homo sapiens
  misc_feature (195)..(195): n is a, c, g, or t
  misc_feature (587)..(587): n is a, c, g, or t
tagtggttggggtcgtgtccgtcaccgcaaggttttggtcgctcagctttgttcatctcctcgcgctggggtgtcacatcacctgttgcgcttcgtgtggtggcgcccctcctcgtgtacgatgctcctcgctgttttgtgagtccaccgctctccctcggtgggtctactattttcataagaagacattcgccncgggggagttatctgagtcgcacggtttctctctggttctccacggagggtgtgctccccctctctttaggagatttttctttatcgaaggagacgctgttcgccgcccccgcggtgttagaccgatagtttttcgcttcggcaccacccacgaggacgacgaagaccccagcccgcgcatactaaatgggggggagactctttgagcacaaagccgagaggtgggggcgccccccaaattttgtgggtattttggggagcccggtgtcgttgtgccccccgttggtcccgcaccaccgccctgttttcgctgctgacggcgtgttgcgctcgtgttttttgcccccccccaagggcgccctctactttggggcggcccgaccgagtgtgtncccaccaggacctcctttggtcccagggccactttttctccgtttcgcatggggccgcctgtcatgcgcgccaccgcccgggcgtacctcggttgctgccaaaaacacagggggggccgacaggcttcgcgtttttcttttgaagagccccacccgtggtgcccccctctgggaaaggagcccgggggcgccaccaccccacatcgggcaacagccacagtgaatttggggaaagggggcctcatacacaaggacacacgcctctgtgagagaaaaaaggggggggcccgcacagcgccgtcgtggatccccaccacttctcactcttctcacggggcgcttctcacactgcaccttaaggcccccccgctttttgggcccccgcctcccctcgtggacgcctctcacagggtttttgggcccacctctggggggcgcctctcaccacaggcgccccctcggcgccccacacactggagtgtctcttgggcccacgcaaatagttcgcgtggttcttcactggcctcccacacttcacaagctggcttttctccacgcttcactgtaaaatgtgtgggcccctgtggccccgcgggggttccgcctctgtgctcgtctctttggggctctccctcgttctccctgtggccacggagagtgctctggttgaagcgagaggtgtgagcacctcttttgaagggggcgcctcttccctccacgcctggtgtttccccaccacctcggggggctcgggcccctcgcctctcccccttatccctccctttccctcgcacggcctggaggcccgtatgggctggagactgagggttcacggtttccccccacgctgtttcaccccccacctttgtccccaccttctaagagcccgggagggcacctgggggagaggagcgcttgtgtctcgttttttgtttccaagtggtttttgggtgttttttcttgtttgtgtcctggattcccgataaaattataagaaattgccttccctccaca

SEQ ID NO: 618686 - DNA, 368 bp, Homo sapiens
tccagcatgagcacatagtaccatgatagctgtatgcggtccatcaggcgttgcacctcagtccggcactggcagttgatgtcctcaggtgtctcattgatagacgtttcctggtcagtatggtccacaaattgggatcgcaagtataccttcagcgtctgcatgcttacgtcctttgcccgagaatttgttttggttaggcgtacagctcatcctgtaccagtcctttggtgggcagctctcaccagcttagcacgtgtgatagaggtatcccgcagcgcgcttgtcagtcctagcatggtcctctctggcgtcaacatcagccgcatctccagaggatcaagcagggtcagctcaatgcatgatac

SEQ ID NO: 618687 - DNA, 362 bp, Homo sapiens
  misc_feature (24)..(24): n is a, c, g, or t
  misc_feature (64)..(64): n is a, c, g, or t
  misc_feature (151)..(151): n is a, c, g, or t
atgtaataaatgtgggaaagcttntcatttgttccagttcactttaaagacatgaatgactcancttggagagaagaagctgcatgaaaattacttaattcctgtaatcccagcattttgagaggctgaggtgggtggatcacttgaggtncaggagtttgagaccacccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctc

SEQ ID NO: 618688 - DNA, 147 bp, Homo sapiens
aggaaacagtatactggcatccgcaattgattgaagggacagctcatcattgggaactccagtgtgaagctgatcaataggtttctagcaatttctccattctctctagggcttctctcctcttctgagtaagcgtacccagtcggt

SEQ ID NO: 618689 - DNA, 1473 bp, Homo sapiens
  misc_feature (1267)..(1267): n is a, c, g, or t
cgtcgttgtgtattattaacacgccgctgtctgctttttgtggtgcctccctgctgtatgtttcgcctcttcggtggtgtcggtcgtcaacttcctcccccgccactgtgttgttgtgccgcccctcctctcgattgttggtgctccgcccatcccgcgggggggtacgagattatcttgctcgctcttctcggggggtctgcttgtttctccttagtggttgtgctcctccgcgggggcgccgggtgggtatagtctactaattgtgttgttgtcgccacacttagcagcggggggtggacgacgtgtctcgttggttggagctcgccgtctccttattcggcgcggcctcgtctttttttttttttgggtggtctcccaccctcttttattgtggcaccgcaacacggtgtgtgtgtccaccccaataatctcgcgacggtcgtgtgtgtgtgccctcggttctcgcggattttttgtccccccgcgcagagattatgttttcttgtttggtcctccacgctgcgctggtctcttctcgcgcgagagcacagcgcttgtgtggcgccagcgcgcgcagtgtttattatttgctctgtgcgatagagagggcgccccctcactcctctctttgtgctccccccgggtaaatactctctctctctctgtgatggagggcgcgcgcgccgccgcccgccctgcgctgtgtttgtctcgcgcgacgacacaccactctcttgttatagagaagatctctctctctttacagcgggcgctcgctcgcgtctcttctctctgcgtgttctgcgcgcgagagagagagatatatatatatagtgtgtgtcgcgcctctctcctctctctctcacagtgtgtgctctccgcagggtgtggtgacacacacactgtgtgggcggcgcctctctctctctctcacagagagagacacacgcgcgctgtgggtgtctctcgcgccctctgctctctcctcctcctccccagcagaggtgcttgtgtttattgtgtgcgcgtgcgagagagatctgcgcgcggcggtgttgtgtgtgtgtgagagacacacacacactatctctctgcgcaggcgccccagcgcgcgcggttgtgttgtgccacacactctctgtgtgggttcgtgtgtgtgtgtgtgtgtgtgacacactctctccgcactctctctctctgttttgatgatgatgggggcgccctcgtctgtgtgtgtgtaaaatcacacacactctgtgtgttntctcttctctctctctcccagaatctggtggggtgttaatctctgttgccccctctcttctgtgtgttttgcccccgtctctcctctcttgcccacgaggggggcgccctcttgtgggcgccctctctttgtttgtgtgggtgttggcgcccccccccccctctcttgtgtgggtgtgtgagtggagggaaaaaaaaggttttgga

SEQ ID NO: 618690 - DNA, 234 bp, Homo sapiens
gagtatccccaaggcttcgaagatgtggtggtgggtgcggggcgctgtggctgccctcataatggcctcccagacaggagtgcagtgtgcctttaatgtaggaattaggccaaccccaggcccagtctgctcctgggacgagcacgtccacgggatggctgtcttgcccatctgacggcgcttgagatgttcgcgtctggtgtgtgcggcgtccgattccctctaggccccccc

SEQ ID NO: 618691 - DNA, 467 bp, Homo sapiens
ccgtgatcgactcatactacgggtaggactagagaaattataccaagtgtacaaaatatagcaatcatattactacaatgatgctatttcgcacttcctgctcgtaggggaggggagataagaaaccctcactctctacaggtttgggtacatgtggcaacctgcttccatggccgtgtagaagcatggtgccctggcttctctgaggcacagctggggttcatgacaatggccagatgtaacagttcattcttgaagtcagattgcaggctgggagcacagcgtagtagatgttctcacttggttctgctgtactctagacagaatatttggttttcctgtataggaatgagcattaattcctttccaggtattttataattctgggaagcaaaacccatgcctcccccgtgccatttttagtgttatcctatttagatggccatgaagaggctgctgtgaaatcc

SEQ ID NO: 618692 - DNA, 185 bp, Homo sapiens
taatatgatgaacagtaagggaccagagtgtttaggactttcaggaacttaactattctggaataaggaatgaatcaactgacctatgggcccagcaggattttgtaactaaatagttacttgacctcttctcacccagcttcatcagctctctgttacttgttgtcccgtttttgaatacaagt

SEQ ID NO: 618693 - DNA, 149 bp, Homo sapiens
aactgcgacggtcagagtaatgctttcccagtcagattgggacagacaagtatgtctgtgttcaccactcctgttttacatagtattgtaaattctagccactggaattagtcaagaaaaggaaatgcagacaggtgcagcgtagaaat

SEQ ID NO: 618694 - DNA, 182 bp, Homo sapiens
ggtatgtcactattgttaaatataattgatgtcaactccttttttctttgtcccctctctcagctgggtgccttgtgctgggctgtatgattttccccgatggctgggattcagatgaagtaaaacggatgtgtggagaaaagacagacaagtacactcttggggctacccatcggcgtgtg

SEQ ID NO: 618695 - DNA, 150 bp, Homo sapiens
atgctgtgatgatccgatcctattcatccatgaagttaaggtgcatctgcttcagcttcctgaaggcaatgtagtgcacgcccatgcccgccagcatgaggaggaggcagtaccccagcacttgttagttttgtttgtgtgtgcagcgtt

SEQ ID NO: 618696 - DNA, 283 bp, Homo sapiens
tgtagaggggctgccacacatgttgctcagcctgaactcgaactcatgaccttagctgcatactgagtcacatggttacccactcgcgtctggcaaccttcacgaatgtgctcactgaggacatcatcgatgaatgcaagacccgtttctatatccattgggctcacactacgcacaagcaccatgcctagtaccgcaacaaaggtcacagccagctacagacttcgcggctgtcgtctagagtcagccggcagacgtacaaccgcgtcgctagccgtgtgat

SEQ ID NO: 618697 - DNA, 350 bp, Homo sapiens
cgatctagcaggatcccggcccgtgggcggggacacctctttcatgcctgagtgggaactttgcggtctcacccccagtctggatggctcggtgtacgctgactaactcagagccatcctgggttcagggctcccattgtgagtggtggagctgggccatctcccacgttctctttggacagaggaggactcttggtcctgctgggcctgcgcacgcagtggtgaaccatgcaccccaggctcctggccttttatcggggtgccccgttcaggccctggaagacaggctgggttccatatcctcacggtgcgccccagcccatggctgtaccattgtgtccctacctcag

SEQ ID NO: 618698 - DNA, 381 bp, Homo sapiens
gttggacaaagagactaacagtctgcctgctgacagttttgcaaagacgcatgtaggatcgtagatggttgaagagatacctagagtcacaaagagaagtaggcacatcaatatgtttgtggaagtctggcagtagacttgatatcagtgcccacaaaccagtaggaatcaaggcagtttgtgtgtgtgcctgtgtgtggggggtggagtgtacatgtatatgtgtgtgcatgcatgccctcatgtgtgtgtattttttatgggtatgtgtttgtgagtgtgttcatgtgtgtgtgtggtacaactatttgtatgtgtgtgatgaagaaaaggaaagttacacgagtacagagaggcagagagagagagagaggtcgacgc

SEQ ID NO: 618699 - DNA, 297 bp, Homo sapiens
cttcgtaacgagcgccaaatataaactcctgaaacagcagaaagaaagggacttaattctatcaacaacaaaatgattgggttgggttcaaagaacttcaggaaatcattgtaagaaacgtctaatctcttcggtttcctgtagattctctaggtgctagatgtctgcaagcaaaagtaacttttaaaggggacacaacctatagtggggcttcaaaaagttccaggcaaaagttccagtattgccagggcaggtggtaaggggggagtgaggacattgggggcgctcgtatacgga

SEQ ID NO: 618700 - DNA, 285 bp, Homo sapiens
ttgtgggtagtgcacttgtaatcccagctacttgggatgctgagcgctgagaatcgcttgaacccgggagttggaggttgcacgtgacgccgaaatcgcaccactgcagctccagcccaggtgacagtgtgagacttctttaaacaaaaaaaaaaaagtggatttaccatatgaccaagcagtttcacttctggttttatacccaaaataattgaacgcggagtctcaaaaagattttggcatatcctggggcatagcagaaagaagcagaataacccggacgga

SEQ ID NO: 618701 - DNA, 1069 bp, Homo sapiens
tcctttttaaattattcacaaaaagcagcgggaaatcaaaaaggcagctgccgctccagggttctcaaatccattaaaaccaccacagaacaattaaaacaatcagagagagaaagggaaagggaaacaaggtccaacattgggcattgggttttatccacgaggttttcccaaagctcctctgggaattggaaagcaaaattattattgggcaaacactggtcttctcaatacacaggaagggggagcctcagtggcctccggccaacagaggcgggctctggtgcagtcagactgggggggtgcacagcagctctctcgaggcgtgggggtttcgggccttttttccatccaattcacccctttccgaggaaattcagcagccttaccgagacacggggcctctgtgccgggtgtgccctttcccccaggcagaggggcctggggcataataccagggcaaccggccagccccagagcagaaaccctgggggggatcccttccttcatcaacctgggggtgggaggatggtcaatagggcttccacctcccacttcccaagcccatagttacattctctccacccttcctgggacaagtcctactttcccaggtacaccaaccaaccaagaagttaacgtcggggggggatcaatccatcaggtccttccccgtggtgtaactcttttccttccagaagatcccccgtgtgctcctgtctcctcaactattcccctcacatcaactttttctcagatgttcaagacctgaagggggagggtgcccaagagagagggtagttccctcaggaaccaaaaggggtggaatcgcgaggagcgccagaaaatcccctcggggggcccaagtagggtaccccgagttgtgacagggggccctcaagggaggacaaaaaaaaagcacgggcgcaaaaagagggggggaacacgctcgcggatcggaggacacacggtgggacaaggcacacccaagagcaggcacacacggccgtgagccagtgcgagctcgtaccaagcgcagagtacgtaggtcgaaagagagcagatgaca

SEQ ID NO: 618702 - DNA, 312 bp, Homo sapiens
cggctgtacttctttcatgaacttcccactgagtcacataccccactaccacctatctcactgacaccatgtacaagcatttcttttactttacaaattccaggaactggccttcaggaaatccaggtatcaaaccaaggtagtgtgcagtattccacctctaggaaggaatgctgaacaactgacttacagaccttgttgccccagactagaccacctggtaggcccagtactcaagtgtacctttacaaccaaatagtgctaacctgtcataccctacccctcacatgctttgccaagccccagctgcgg

SEQ ID NO: 618703 - DNA, 958 bp, Homo sapiens
  misc_feature (691)..(691): n is a, c, g, or t
taagcacaaacatcagcaccagacatcaggaagagttagatgcacaggtggctcagcggacgcacctgtctacacgcgctggcgccgtacacccttagaatgtggtgctggtaaccactacaattcactggttcgtaaggtggaccaggtatgaaatgggctcaaagacgttcccaatgcttgtctagagtgcttagatcagcttcatcgttgacacggcagtctgcgagaggagtactggattgcacccccagtggtgttccctcacagctgcccactgcatcaggaacaaaagcgtgatcttgcgtggggtcggcacagcctgtttcatccctgaagacaacaggccaggttatgtcaggtcagccacagcttcccacaccgtctctacgatatgagacctcctgacagaatcgattcctcaggccaggtgatgactccagcgcacgagctcatgctgctccgcctgttcagagcgcctgccgagctcacggatgctgtgaaggtcatggacctgggcggcacccaggagccagcacttggggaaccaccctgtacgcctcaggctggggcagcattgaaccagaggagttcttgaccccaaaagaaacttcagtgtgtggacctccaatgttactttccgacttgaccttgtgttgcgcagggtcaacctcagaagggtgccccaggncatgctggtgctggcgctggacaggggccaaagcacctggtgggggtcaatcgaataccgaatgaacatgcagcctgccgagggtctccagggtcctaaggctggaaggaggtgtttatcaacaaaagcctggaggggcctggagacagggagactgaatgtctgccgcacgaattaaagattctagacgccataaagaagcaaaacacaaggagacaccatacagaaaaataaagataagaaaaagatacagatgcggccacaacg

SEQ ID NO: 618704 - DNA, 297 bp, Homo sapiens
aaaaaaaaaaaacccggggtggctatagtcccagtacctgggaccgctgaggcagaagaatcactggaggacgtcagggctcgggtatgctatgatcataccccttcatagctatggactggcattccagtcggggcaacatagaaagacctcatctctattggtaaaatattttagagtgaaatccccatagtgtgggtgggggtacggggtttgggtccataaccatattggccggtggtggaagtataagaagatggtaagggcgggttaattccattcattctctttcagtta

SEQ ID NO: 618705 - DNA, 514 bp, Homo sapiens
aaggtaggaagatcgcttgagcccaggagttggagacccatctgtgcaacatagtgagacgctgtctgtacaagaaacttttaaaaaatgtagctgggcgtggcagtgtgctcctgtggtcccagctactcggagctgaggcaggacgactgcttgagcccaggaggtcgaggctacagtgagctgtgacggctccactgcattccagcctgggagacagcaagatactgtctcaaaaaaaaatttatcattgaagcctgggcattttaaaaaaataaaaaggtgggaaaatacgtgggcacagcagtgaatcctcacaccctgggctttgcccaagaagtgctcgtgaacctgatgaaagtgtcgggtgtggccgacgtgaggctgttccaggagccacgaggggtgattggttccgctagaaggttccagggaggaactggagtctcaggtgtgtcctctgatgagtgatctatttttaagtaaaagtgtttcattaaagtcaaaaaaaaaa

SEQ ID NO: 618706 - DNA, 659 bp, Homo sapiens
  misc_feature (126)..(126): n is a, c, g, or t
actacaaatccattcctaggttcccaaatcgcccgcacatccaacaaaacaaggataaacaactacaaagcacacacaagatcacacaacaaacaaagcctaaccagactaagaaacaccaaaagncaaaactcaaacaatccccagaacccaacaagacaaacttctaaaatatctacaacaacaccaaaaaggcaaactaaaagtaaaacacctgaccaaacaataaccaaaacctcaaccgtattcacaaaactacgaagcctaaacataaccggcaacagaagcctaggaagagccctagccggctacgcaagaccactcggaaccgtcagacgattccgagcgagaggtaatatactactaccgtctcttcgatcgaccctccccttcttaagcctacgcaaagcaccacaactaagattccgccgatcaatgttcagtagactacaaagcggactactaagacagatatcgaccgtcacttcaagaaaaggaactagaagggaatgcggaggactaaggggccttctaagaggagacttttctctaataggagtaccatcctacgacccataatagtatacatcgtaggacgcctacccggaattcaaggggggggctaggtctaattgtaactagcggaaggctatgtcaga

SEQ ID NO: 618707 - DNA, 1000 bp, Homo sapiens
tggaaacggagtcttgtcctgtggccaggctggagtgcgggtggtgcaactctcagcctcacgtgcaatcctccaccctcctgtgggtttcaaggaggttcctccgtgccttctagccctccgtgagttagccggggagctacaagcttgcaccaccacacccagctaatttttttttttttttggaaaggagttctctcgctctctgtgtgtccgccccagaggcttttgaagtgttgcggtgggccgcagaatctcgcggctctcccagcgtgcaaaaccctctgtgctcccccggggggttctcggtcgcctatttcctcctgggtttatcgagcctctccccgaatttaatccccccgagggagattttcgcgtgggggaacttagggggttgccacaccacgacaacaacacccccaggcattaatttttgtgggggattatttcaaggcataagaaaagtgtgggtgtttcaacccacgtgtgtttctctccaggagaggtggattgaggagtcctcgcgggaaccccgcgggagaattccgggcccggctttgtggcctcccaaaaaaggtgtgtcgggggcattaatatagggcgttttgaaacaccaaccgtccccgcgagagacaaaaattttggggactaattataatgagctcaaaccgaagtgggggtttaccaccaccgtgtgtttgtgcgccacagtggaagtttgtcttctaaaatctttgtggaccctttgtgtatatccgtgcaccacacccttgcgtcttcccccaagtgtgggcctagggactcaccgcggggggataagccccccacaacttactataagcctataaagcgcaataatccctaaaatatttccaaggggttaaaatatgggcctcgcaaaaaaatgcgcggtggggggggcctcaaataacaccataccctttaacaaacggtggaaacatggcttgcaggacaaaaagggaggagatccgcgattaga

SEQ ID NO: 618708 - DNA, 473 bp, Homo sapiens
ttctggatgcacagtgtcataacggctctagaaaacagattgggattgtgatatactgtctgcacacgtttggcagttgttatagaattgtcacccttcatccatgggcaaagcctagtgtagatgtcttaaatcttacttgtggatgcagagcagagttgaaattgtgactgtcatatgtgatcatcaagaaacaactggcgagcttactcattgttcactggtccgctcattgtgccagtaacaactctcatatctggacccagtcattatagaggtgttaactctcatatctgggcatagagccacaggtacgattatgggtcgataccattacaattgtctcccagtcacaaaagattgcgactctcatgggaaccttataaattcctcggttggtacagggaatgttctaactaggctcattgtacagttgaggttttgacactcatgcacacccagccgacagtaac

SEQ ID NO: 618709 - DNA, 379 bp, Homo sapiens
atttttctgagcctgtagttcagggaaacccattggtttgggcctccttcatatttgagagaacaggtttcttccctattgttttcccttgcttactgtcacccaggctggagtgcagtggtcccatcacagcttactgcagcctcgacctccacggcctcagccttctgagtagctggaactataggcacacaccaccatgcctggctaatttttctggtttttgtaaagatgaggttcaagaccagcctgctaacatggtgaaaccctgtttctactaaaaatacaaaaaattagtcgggcctggtggcatatgcttgtaatcccagctactcgggaggctgaggcaggagaatcgcttgaacctgggaggtggaag

SEQ ID NO: 618710 - DNA, 424 bp, Homo sapiens
cccgacctaccaacagctcctaagaattctctcacttgccttctgctcttaggctccagtagattgcaaatgacctgctttctttctgatcccaggctgcattccccgtgtcggatagtaaatcccaagtaacgtacctgctgtcgacagatctcagcttttttcttggacaccttatacccacagtcctccaggcgctggagtagggcatccgttcccttggcgcacctgactgccgtggggtgtctcagcaaaaggtcatcaacgtactggagcaacacgcagcctaggtctctggtgggaagcttctggaggtctgtagccaacgcctccctgaagatggtggggttaggtctcagatggtaaaggacagaggtctacgtctactggctgtagtgctcaggtatccatcctcgtttcccta

SEQ ID NO: 618711 - DNA, 454 bp, Homo sapiens
tatctatccatccgtccatccatccatgtatctacctatctacctgtctacctacctacctacatattctatagttctgctctctggataaccctgttctatactgtgagtatttaatgagttaacatgtacattgtttaggaagtgctagttaagtatgtctcttatttctgaatccagctacttacttttatgacaataaaaatgtaaatgctggttggcaaatgacccacatgttacaggaggacataaaatagcacgaagtttcctcaccctgggccaggactgtcacattccccagagcaacactgtaaactggtgtgtcctcttctagacatctcctctgcgtgaatgtgtgcgcacacacacacacgttaatgtgagtggcagctcgtgccctgcgcatgccttgctactttcatgtacagtggctgaggctctagtggaggacgga

SEQ ID NO: 618712 - DNA, 152 bp, Homo sapiens
aattcggcacgatgggggaaaagaagactgcagagatgaatgaacgcctgcaaaaaacaggagaatcacatgaacctggaaggcagaggttgcagtgagccgagattgtgccgttgcactccagcctgggcaacaagagcaaaactgtctca

SEQ ID NO: 618713 - DNA, 167 bp, Homo sapiens
  misc_feature (142)..(142): n is a, c, g, or t
accccctcacaagacctgttcaaaaaaatagagtagtggcttattggcttatgattatggaggctggaaagtcaagattgagggggcagtatctggtgagagcttcttactgtatcatatcatggcagaacgcatgacatgngtggcagaagggcagaagcaggaag

SEQ ID NO: 618714 - DNA, 127 bp, Homo sapiens
tcccttcatacattcatacggtgcttccctcttcccactgtaaagctttcccactcctctgcctgccttggcctctgacaaaatgcaagtgatggtggctgactcccttccaagcttggaataaaga

SEQ ID NO: 618715 - DNA, 110 bp, Homo sapiens
agtatccggtctgtcgacgatcacacctctaatgccagcagtcttgtcataagcacaggtactcttttctggatgcttcgcaagaccggtccttctgtgttgatggcaag

SEQ ID NO: 618716 - DNA, 736 bp, Homo sapiens
caacccaccaggctacatatactaaacaatacccattaaagggaggatataaaaaataacagcaaaattctggaaatcctcaaagaacatattattacaatgggcatttcaaattacttttccattatggcctgttctgaaatcacggtagctatgactagaaaaatttaaataaagtctcaactaaaatgacaggaaattaccagatgttgaagaagtcattaataagatcactgagtacaatggaaactactatgtaaccataaatatttcagacatgctctttgtcatgccaatagacaaggaaagccaggaatataccactttcacctatgaaggcaaacaataccaatttaaaagctcaatgcaagggtatttaaatagctcactccattttatcattacatataaaccaattaaaatacagatcactaataatataatacatagattacattacatcattgctgaaacaatgaccagcagaatcttaaaagcaggaaccatgacaaattagttaacacactgtaaagatcaactgagaatgtgagctattccataatagagaaacaccataggcccagacacctaattcgtaacaattaacagagtacaatggttgtccagaacgtgcagaacaattaatgacccaccactgtttacaagcccttaggggcaccaacaacacaggaagcacaagaaaaaaagggttaatcgcgcactgggaacacacagt

SEQ ID NO: 618717 - DNA, 729 bp, Homo sapiens
  misc_feature (84)..(84): n is a, c, g, or t
ggacagtttgctgagggctgtcaggtaattgagaaggggaaagcagttaggacccctgaaaagcaaaagtcatccctcgaaganttgataccatctgtcaaaaactaacctgttaccctatgacccagtgattccacctacagtaatttatcttggaaacagcaaaaagtatgcacaatttattatagtcttatttttatagcaaagagtgagaggatgttaaatacaattatgacaaattgatacaatagatactttctttgcagccatataaaagaatgaagaagctctttgtgtaatgatatgaagtgatcaccaaatgtatcgtgttttcaaatgtttatttccaatatacatgctaagtggaaaaaaggtgacaaatatatatatagtaacaatatatatataacacatattagtttacatatcccataaacttcttctgcagagatacacaagacagtgataacattagtgtcacggaaacgaaagctaagaggctaggggtcaacagaccaagaggaagtcttttcactgtcaactccatttttcaacatttacaatttatgataccatgtgaatgtattacctatttaacacaataaacaaggccggacatggtggtcatgctataatccaagcacttaggaggccacgtaggaggatcacttgagctcagggttcaaaacagctgggcacaaaggatagcatagacggtgtacatccaaa

SEQ ID NO: 618718 - DNA, 178 bp, Homo sapiens
  misc_feature (13)..(13): n is a, c, g, or t
catttctacaccnagcagcgtcagcagcaacttctgtggccatacgcttctcatagaaagtacgaaggttggcgtaccatcgtccacttcaatgagtttctggcagccagtggctgggacggagatgtacagcttcatcttgtgtagaaattgaccacactgatctagaggtcccgga

SEQ ID NO: 618719 - DNA, 363 bp, Homo sapiens
tcccagtccgatcggatcagcgatccgctgatccggaacacgctgatccgcaccctgaaatctccccttagtgaaagctctcgagtccagaaccctctccagctaggtcagaatttcgagtgtaccaaaacaaggaacactctttataggtacaaaatatatacatataaaaatatgctaacatctctaaggaagacagactggccaatgcttcctatacaatacaggagcaaacaaaacgcggtatacacaccatttcacacacacaccattgccacaagttcctgcgggaactacgggacaaaagcaacaatgcaacgtcagaagtgccagatacctagctacacaaacacaaacacacac

SEQ ID NO: 618720 - DNA, 416 bp, Homo sapiens
ggatgaaaaattaaagaaaggaagaaagagcagagtgagaaagacagtagtaacaggccagaaaagatgaatgaagtatgtaaaagcagggagaagaagtggatagaaaggaaaaaaaaaccgagaaccaggagtcttgaaagaaaaaggtagaaattaaaaagagcacaggatgacataagaataggcaaaaaagagaaaaataacagtgaacataaatattaactaagagagcgagaaatagggaaagaagagacatggatcacagcagaaacatgaaaaaagacaaaaaacatgataaaagatagagaaagacatgaaacagactctctctctcactctctctactctctctctctctctctctctctctctctctctctctctctctctctctctctctctctctctctctc

SEQ ID NO: 618721 - DNA, 123 bp, Homo sapiens
ctcggtaccgtaagtacaatatgggagattattccgaagcctgtaggataagaatataaacttcagtgctgacctgaaaaatcagaataggtgttggtatagaatggggtctcctcctccggc

SEQ ID NO: 618722 - DNA, 107 bp, Homo sapiens
gagctggtacccaaaatgactgacgctctttgtcggacagtgattccggccgtacgccgtgtcgggctatctgtttctcttcgccatacatccaggctaaaaagtgg

SEQ ID NO: 618723 - DNA, 102 bp, Homo sapiens
aggtgctgacatgtggctggcaggtctaagtgctgctgttggatgcaatttcctttggtagacttttttttttaagaaaaaaataaagccaattttggggtt

SEQ ID NO: 618724 - DNA, 138 bp, Homo sapiens
acagccaaccccagcgactctccacccaggactgtccagctctagatagatggtctcaaggggctaagcgccatgatccaaggaaagataaatttgtgtctccactactgaagaaattctattttgggcatgcatggt

SEQ ID NO: 618725 - DNA, 159 bp, Homo sapiens
gagtgacttacaggagttagccccatgtggaattggagacggtccgtaaactctggagaacacagtccagcctatcaatgacatgtctactttggttgcctggacaggtgtactggagaactcaaaggtgctggcgcgaggccatgacttggcatctcc

SEQ ID NO: 618726 - DNA, 216 bp, Homo sapiens
tttccccgttctgggtagggggaaatgttgtatgaagggcattctataccggcacagtggctcacgcctgcaatccctacactttgggaggcagggtggtggtggatcacctgaggtcaggagttcgagaccagccaggccaacatggcaaaaccccgtctccactgaaaatacaaaaattaactgggtatggtggcaggcgcctgcaatcccaga

SEQ ID NO: 618727 - DNA, 338 bp, Homo sapiens
caagaacattaagttaattggacgatgcaagtcacaaaagaccatgtggtctatgctgccactcatgtgacatatctagtggaagcaattctatcgagacagaaagtaatttagtgtttgcctagggcttgacatggggtgactggggcgtgcccgatatgggtacggagtctctgtgcggtgtaatgaaactgtcctgaaatatgactgtgatggcagttacacaactctgtaaatatatgagaagcagtgaattctctactttaaaagggtaaatgttaccgtgtgtgagatgtcttgtatctcaataaaacttcttttagtacatccctcatata

SEQ ID NO: 618728 - DNA, 356 bp, Homo sapiens
tctgttggacaaggctgacctagagcaggtctgtccgatggaaacacagttagagccacatttaaaaagccaaaagaggccgggcacggcggcccatgcctgtggtcccggcgctttgggggactgaggtgggcggatcgttttgggctcgggggttcgggaccagtctgggcggcgtggccaagccttgtctctgcagaaagtacaaacattggctgggcatggtgccatgtgcctgtggttccggctgctcgggggtctggggtgggaggatcgctggggccgggggggtcggggctgcggcgggccgtgattgagcttctccagcctggatgacagagtgatacctggtctca

SEQ ID NO: 618729 - DNA, 1993 bp, Homo sapiens
  misc_feature (661)..(661): n is a, c, g, or t
  misc_feature (889)..(889): n is a, c, g, or t
ggagagaactagtctcgagttttttttttttatttgtggttttcctcggtttaaaaaaggaccccaattttaaagggtagggtgaaggggacaaggaggggaacattagccccttagttgtaagaggaacagtggagaaggtgacaaagtgaagaaggccttcaaagagggagagggtggagagggagaaatgtcataaaggggcagcaacagtaatctcgtgtgagaaagagaagtgagagaggagagggaaacctctacgcataagtgctctgcagaagaaatgaagcggcgcaaaagctatgtgggccactatctcacaggtggtagccagaagagcggacacaaagtggtacgagatcttaatactattcctctgtacacagtggcgctagccacagtctcacacagtgtgcctctcacactctctgagggaaattatatcctgtcttggcactcgcctgttcagtgttcagagactgaaagagaagagtgcagtagaaaaaagaagcctcgtctgacaaagagaggcgccagacaagacattagcgcgcatgtgatgatgtgtgcgagcttatcacacacaagtgtcacagtaccaatgtctcacagagtacaacaagtcgccgaaaagtctgtagttgtcgtcttcgtgccacgnagtaatatcttccctcgtcgacaaatagtactctacaaggggagtatacacccccaccgtctggagtcgtgtcgcctacactagtgaggggccgaagggaggaagcgcccccatcttcgtgttgtgacgaagggagacaacaggggggctcatcaccaaacgcggaggaggcgaccacaggagtgagacaaatataaggcacatcatctctgttcgaagaactgtgancgcaaaatgtacttcaaaaactcacggttccttgtaggaacgagatgatgtcaacaggctcgccaaaaatactaccggagcggtggatccgcacaccaacacgaacttatgtatggaggcgccaccgaaactcgtggcgtggcttccgaggcggcctatctacaacgagcaactgttattctccgccacgactagcggatcaaaggaaaagacagcgctggcgttcaatcgaagagccgcagaaacaagaggactctccgttccatgggccaacacaaggacatatccacggcgcaaaaacacatatggtcgcgaaccatgtgttctctcaacaacgggtgttgattacggcacaaactaattgtctgcgaggacctcgttgctgcaaggaacacaacaaccttctcactgggcgacaggactcatgcggggcgtaacccccacggacagtgtgttgtattaccaaactcccaccggctggtgttcattaaatgggtgtgcccgacaatcgtgtggaggataacctaggtgtgataaacacttcttagtgggcccacagggccgacaaagaatatacgagccacaagatatgtaacacttgatgtccccacccacattttgagtcgccccaaagaacaacggtgtcccgtcctggaggagatcaagaaactcctacggagtgaacacgactaacggcacactggcagcgatgtacaccaggcaacacactgctaaacggagcccctgcatacgaaaactagcgtgggccggcactacaaaagaaactccgttaggaagaccacgattagagacgccatgagctaaagacccaaggatagcgaggagtagatgcctcgagtgcaccacagaaattattgcacagtaagaggctagagtgagcattagaacgactcacaagaccgcagaggagtacacgtgtaacacgccgcggcgaaacgctgctaagtgtcgacacaagctaaccaatgcggcgaaatagtagtgacacaacactcactcagtaaacacccacaatggggtgagagacgacaccccatgactgctcacgtactgacgacgcgggaagcactcacgtaaatcgtg

SEQ ID NO: 618730 - DNA, 173 bp, Homo sapiens
tgctgtcagcgctgttagtccacagcacacacatgcaagggtgctggttctgggtttgctttgcgttcacctgtgagcagtgggcagtgagcagtgtcttggtgcccggccccggatactactttttgcctcaccgtaagtactcactagtacatatttccttctctctttac

SEQ ID NO: 618731 - DNA, 954 bp, Homo sapiens
  misc_feature (54)..(54): n is a, c, g, or t
  misc_feature (71)..(71): n is a, c, g, or t
  misc_feature (94)..(94): n is a, c, g, or t
  misc_feature (100)..(100): n is a, c, g, or t
  misc_feature (132)..(132): n is a, c, g, or t
  misc_feature (140)..(140): n is a, c, g, or t
  misc_feature (173)..(173): n is a, c, g, or t
  misc_feature (191)..(191): n is a, c, g, or t
  misc_feature (207)..(207): n is a, c, g, or t
  misc_feature (250)..(250): n is a, c, g, or t
  misc_feature (260)..(261): n is a, c, g, or t
  misc_feature (278)..(278): n is a, c, g, or t
  misc_feature (288)..(288): n is a, c, g, or t
  misc_feature (294)..(294): n is a, c, g, or t
  misc_feature (299)..(299): n is a, c, g, or t
  misc_feature (304)..(304): n is a, c, g, or t
  misc_feature (352)..(352): n is a, c, g, or t
  misc_feature (369)..(370): n is a, c, g, or t
  misc_feature (392)..(392): n is a, c, g, or t
  misc_feature (424)..(424): n is a, c, g, or t
  misc_feature (428)..(428): n is a, c, g, or t
  misc_feature (472)..(472): n is a, c, g, or t
  misc_feature (550)..(550): n is a, c, g, or t
  misc_feature (555)..(555): n is a, c, g, or t
  misc_feature (560)..(560): n is a, c, g, or t
  misc_feature (565)..(565): n is a, c, g, or t
  misc_feature (592)..(592): n is a, c, g, or t
  misc_feature (595)..(595): n is a, c, g, or t
  misc_feature (737)..(737): n is a, c, g, or t
  misc_feature (934)..(934): n is a, c, g, or t
ctccacagaagtcgccacctcagcatattacataacatctctccagcattcagngtgagccgcaaccgcanggagagccccacggtcagcctcnctgtantccaggtgaaccaactagatgttaatactgcnctgctacnaggtaaaagctcctaactcaaacttattggaanaggagtgaaacggctgcnaagtgcactttaagangaggtactttttgcttatgaaaagaaaccagtgagtcctctgnggatatcaanngggagtattttacagtnaagcacatgntttggngtgangaatnccgatgttgctctgctggtccaggctgttactactcttcttgctcctncggggggcccccttcanncggtatcacaaagccttcatcngtggcatacagaatgtctacaatcctctgcantacngggtcgttttccccctcgttctcctggcaaatcaattcaatgtnccgtagctttccgaagtagaaatccctctctttctccaggtcttcaacagtaggtttcaatacgttgacctgcggcancaacncagcngcctngtcgtcgccgttgcccacaccggggtnctntcgcaccacaccagggccagccttaggagccgcagcgcttctctgtgttgagatgggcctctggggagctgcactgctagaagtgagaggtttcttcggtttattcagagctggagcaacaagggaaggagccactgcagtntcttgaccttgtctggcagccacagggtcatagtcttttccatcatagtttgcatcgaaaaacttcttgaaccactgaacgaattcaaattgtcctgaaactttccttttactaatttgtgcacagggaatattttgtcacacccattctcttaaaactgcttgtagtattttgaagtctgggtgtactcgtgtctnacttagctgggatttcactt

SEQ ID NO: 618732 - DNA, 985 bp, Homo sapiens
gtgcggctctcctttgtgggtggtatctgcgctccgggggccaaaggtcgtgtgccctctcccatggctcttgcgccgttctttctgggtgtgtcgcacccactcatgggtacctcttcgcctccgccttgttgtggtctgccacactcgcggggaacttgtgctaatccctgctgccgtgtgccgcgcccgccctttgtacaatagcggtcggaggctgcatgggcctattccgcgagaggtatcgtttctgcctattctcgcggtctatgggattgccgtgtggtgcgctccctaaacaagggaggtgttttttcgcgtccggtggtcgtaagccgccgtgcttactcagcgatgcaggcgtggtacatgttgcgctgactgtttcatgcgtttatgaggtgggcggaaacatctagaatcatgattagtaagaatgcaaggatgataggcggtccgtggtgtgtgactactatttggggtttcctaccgcaccgcttgttttgctgtttgtctgcggcccctattaagcgcccggtgtaccgcccccgtggtgcccccgaagtctccgctccccttgtcaagaagaagcagaggttgtgtgcacagtataaggcgcgggtggaagaagatttcgtctgtttatcaagggcaccccggcgcgctacgctgggtaagaaggcgcaaccccccgcccgccataggggttttttgagagccgccgtctcggggggtattgccataggccgcctagcacctgccgcggcacacataatagggggtattgataacgggccgtggctaatcttcaaaccacgagggtatctcttgggggccaacgccccacgcatatgaggtataaatacaaggggggtgcggtagaggttcgttcaaccagctgcccgatggctgtcgtcatcacccgctgtacagccgacaataatttttgttgctcaagagacaccccccggaaccccacaaaaca

SEQ ID NO: 618733 - DNA, 107 bp, Homo sapiens
tctcagagtactgcggaccagtactcattgaccccagcgcatgggggcttcgacatgggctggagaggagtcataagtaggagtccgtacaagaggtatctttcact

SEQ ID NO: 618734 - DNA, 151 bp, Homo sapiens
agttggatgcctacatggcgcagcagatccggattccaatgagtgaagcctgcccatactcccatgagagactcttgttaagtcaacacatctgtaaataaacctgagataacagctgagaagaaatctgattgatgctggatggacctat

SEQ ID NO: 618735 - DNA, 198 bp, Homo sapiens
tgacagttcttaacctgtaagaacttctgctcgcccatttctgttccaaatggctgacagagctctagcaggaccacacccaagctgtacatatctagacttggaatcatactacagatccttccaactgtactgggtgaagcgtacagacaagtacccactctggacgtatgtgtatggtgttctcttacccgtttc

SEQ ID NO: 618736 - DNA, 276 bp, Homo sapiens
gaagtcgaatccttttctcgcctggacgacttaatcgagaccattcgcggcctgggcatcaaattcgccgaaattcatatgtaattatttgcataccacggtcacgctgcgggtcttgtagttgccgacatccttgcccagggtcttgtcgctttctttcagggccggtgtgccttcggtgccgacaatccggtaaccggtccctgcgcaggacgcatcagccttttcatagcagctggcccaggagttggcttcgcggaacaatcggtcgacgcg

SEQ ID NO: 618737 - DNA, 375 bp, Homo sapiens
aacggttcctccctgccctcagcctccctgaagtaagctgggaattaccagcatgcgcccattgtgcctgaatggcctactttttatatttttagtggagacggggttttgcccatgttggtaaggctggtcttgaactcctgacctcaggtgatccacctgcctcggcctcccaaagtgctgggattacaggtgtgagccaccgcggctggcctggggatattctagatcttataaatcatttaccatctctttggagacacctcctacatccctgtttaagtcatccccttagttaaggcttattgatttcacatagaaggttacctctagtaaaaggattcagaagtcagagtttgtcctcactgaaatctg

SEQ ID NO: 618738 - DNA, 160 bp, Homo sapiens
aggattacttattcgtgttgcactcatgtctatattcagtcatgcaccccataataatttgcagtcaaatgatggaccccatgcatgacagtggttccataaaactgataatggagcatacacagaagtgatatctagtacttctgtgtatgctccataa

SEQ ID NO: 618739 - DNA, 554 bp, Homo sapiens
  misc_feature (531)..(531): n is a, c, g, or t
tcaaatcgttgaagaaatattatggggcatttttctaggctttattattaactattattattcgatgagacaacatcctaaactacactttttggcaagctactcaggcagtatctcttaccattttaaataaacataacgtttaacacagcaatcctaacttgggacagctatcccacaaaaacaaaagcacctggataagaggaaactgtaggggaaagtgttttgatggaaaccggcatgagggccctcctttccggttttgattctatcgggtctctgaggccttccgggcttttgggctattttacaacattgtagctgattgcaatgcaaaaatagcccggcccctagacaggtacgtgaattctgttccgtggagattcggttgactacgctccccaactgtggaagaggccagctgtgtgtccatttacacgttcactttgctattcatctataaatgtgtctgttctttggattgtccttggtttaaacatcttcattattgcctcaataatgaattaaganatttagtacacaattaaaaaaaa

SEQ ID NO: 618740 - DNA, 1163 bp, Homo sapiens
gggaagtgaaaggcgccaggtgccagtcctggtgctctgatgtaatcccagacgccccgcagtcccgagtacatgattcctggatctcagccccatagcagactatgatccctgctggctgcatgggcagacgcatgctgtagcggtccccgtccgggtgacctctgacactgctacggtggaatctccggagcatgactgtatgactggttcgtggctctacaatgctgcctaagctcttagagggtccgggtgcaggctggctgcatgagacgggctgcagttacaagtatctggaccgatgacgctccgggacgtgtctggctggcgacggtcacgggggccacctcgagtcagacagcgcgcggaagggggggcccgatagggccgcggaaggccgtgtcagtcgcgtctctgttagcacgggaggccaaacaaacgcaggaaccaagactcaggcacctgtaacctgcactctgatcgagatgaaccaaacacgtcatcaaatcccaagacaaggctcagtgacatcttccatgctgtaggtgcactcggaaggtgtagtccatgcgtccttgaccagcggataggagggcttgcttgagctaggtccacaagtgtaccctaacttccctccaccgggccatcctcttgctagcatacagctggccctcatagcgcctgtacctacgggcagacccctgctctgtgtgtcttttccctttcgctcagttctcgaagatgggcaagcagctgacctacagctaccccctgggtctataactaccagctggaaagggatcttttgcccaggaattccccgacttggagaatgtggtcaaaggtgccaccactgttagccaaagaaccctggaaacagcaggcatcacactccacatcccaggcccggggctgtttaccagagctttggcacagtcagcaaattgtgggatgacctgtactccgggtggtggaagcagccctgggttaccagcctgcaggtccagttctgggacaaaactggtaggatcctgccctctaactagcacggaattctaggcaggttctgattgtgaccagataagttccctggaacaacggccaagtacacagacaaggagcactacaatggtgcggtcccaaaggcctggactgttggtaaa

SEQ ID NO: 618741 - DNA, 277 bp, Homo sapiens
  misc_feature (49)..(49): n is a, c, g, or t
  misc_feature (199)..(199): n is a, c, g, or t
  misc_feature (275)..(275): n is a, c, g, or t
ttttatttctttacaaattaaagatgcattgaaaaataaaccaatgaanagaaatgaaaggtccatagcaggggcatcctgggctgggagcaggcaggcctgaccacggtcattcctagcccttgtcctgcccagccaactggagttggaagataacttgtcagccactcagtcaataccaaagcccagtaacgtcctngcaccggaagacaggggctccagcatagtctggcctctccccaacaaacgttttctgggtgggaagcttgaagttngg

SEQ ID NO: 618742 - DNA, 234 bp, Homo sapiens
tacgcaggcgcagtacttcttattctacaccctagttaggctcccttcccctactcatcgcactaggtttacactcagcaatcaccctagtgctcactaaatcattctactactcactctcactgcccacgaactatcaatactcctgtagccaacaacttaatatgactagcttacacgatagcttgtatagtaaagatacctctttacggactccacttatgataccgcgaa

SEQ ID NO: 618743 - DNA, 233 bp, Homo sapiens
ggatttctcagttatgtgtgagcatgggctgattagtcattagtccatcgcgatgtcttatttaaggggacaagagtgggcgcatcttcaggtgagatggtcctgacagtaagaaccagatgcctgttaaagttcatcacatagaaacccccacggtttattgggcccggagcgaggaagcagggatccctgcccaagcgggttgctaggtttcacgcgcgcatggtcagttc

SEQ ID NO: 618744 - DNA, 122 bp, Homo sapiens
aacgatggtctcagctatttattagggtggtaaaattactagtgatttccatttttttccccctcattctgtcacccaggctggagtacagtagcagaatcttggctcattgcaatctccag

SEQ ID NO: 618745 - DNA, 467 bp, Homo sapiens
gacacatatagaaggctattggtttccaatgtttagctagccaatgaaaagacaaacttcatgtacagggttgataccctaaaagataggtggctggagcttaaagacagctggctgaatctaggcggcagtcgaagagaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttttaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaa

SEQ ID NO: 618746 - DNA, 568 bp, Homo sapiens
ggagagcgcactcctgggcggctccgaggcctgacgtgggcatcattttaacaggtgcctttttgtttttggtttcgttttttggtcactccagtagctcctggaaaaaaccttaaaaaatgtttcctccaaatctgatttcattacatttctgaatgtcgaaaaaaaaaaaaaaaaaaaaaaaaaaaaaattgttggggcggctggggcctgcgggaaaggtttttaagaacaattgtggtggggggggcgggccccaggaaggtatcaggggagaccttggggcaaaaaagcgtggtgttccacagaggagaagccccgcgggcgccacatagagaccaaggggcggcaggggagacttctctctaacccaaaatgttaaaaaaaacgcgcgccgggggggaaaacaaccaagcagaggggtcttcgtgcagaaaccaaactctccaagagagggagagttcctgaggaggggcccacatcaagcgggggccctactaacaaagcaggggagaggcccaaaggggagacgcgccagatatttcaaattaacgcccgggacccaggg

SEQ ID NO: 618747 - DNA, 116 bp, Homo sapiens
cttaggctcagagctcgagatcaaccagggcagtaaggtgaaacccctgtctctacaaacaagtacaaaaacaaaaattagctgggcatggtggtgtgcacctgtagtcccaacta

SEQ ID NO: 618748 - DNA, 272 bp, Homo sapiens
gttatccagtcttcacacgtaatcataagaacgaggagcttctcgtaggtggatgcccactttaagtcggtgatcttacccattcgcacatacttataatgtctaagcttccgtaaaaggcttatgttctgtgtgacattatctggtgggttcagagagtcggttttctattctgattaccaaggtctgttcttgaaagagcaaagtgcctataaatggtgcagaggttcatggagctataaccgttaggatgccccacaaggtatctattg

SEQ ID NO: 618749 - DNA, 476 bp, Homo sapiens
catgcctgtcccgggctggcagggagggtcataatgacctgtcaccggatggtccgtctcgcgcggtgacaccgtagtccagcctcaaatgcggccccaggctccacgccaccatacatggccgatgtgccgcttatactagcaagacggcgactattcggggatagcatgatcgaatcggtcgcgagcacttgagatccagtcacctcactctttacaacttctgagatgacctgcttcactcacctaacccgggcctgtgtctaagccttctatggagtgaaaaaaggacactcacctgtcgcagatgaaatgctctggacaaagagctggcccactttgtacaaaccatgccaagatgcccgccatcacccggtttcaccgttacaattgaaaaatgggcaaggacgctatcctgtaccacccaatataccttgcatcaggcgggcagtggtcaagccctagaaatacaccca

SEQ ID NO: 618750 - DNA, 366 bp, Homo sapiens
cggcactctagctcatggtcacacattctgaaaatttaaatggaaagtttcagtaataaacaattcataagtcttaaatgtgtgccattctgaggagcatgatgaaatcttacacgtccctctccattccacttgacgtgtgaatcatcccatcaaccagcttatcctcgctgtacgggctaccctctcattagtcactgaacagccatcttagttatcggattgactgcagcagtatcaagatgcttgtgtttgagtaattcttattttacttaataatgaccccaaagcccaagagtagtgatgttggcatactgttataaatattctattttactactagttatttttgttggactagagtgg

SEQ ID NO: 618751 - DNA, 706 bp, Homo sapiens
  misc_feature (286)..(286): n is a, c, g, or t
  misc_feature (369)..(370): n is a, c, g, or t
  misc_feature (435)..(435): n is a, c, g, or t
cttgtattcaggcgcccctcccaccagcctttttattgcccatggggggagaatgttctgccgagccgggagttaaaggggagttattcgccctcccacccataataaaagggggtcccccattttggggctttccccccggcccatcaaaggggcgttggttaaccattgggcaaacagtggcatggggagcattttgtttgtcccaaggggaaaaaccccttttttggacttcgccattatgagaggaagggccgggcattttgtgaaacccccaatacccagntatttggggatgtttgctccccccccaatggggttataaaaggggagggggtttccgcttttaataaggccgggggggggaanngttttccctttttcccccgccccacaaatttaccccccaagaaatagtttgggggggtttccaanaaccccggtttggaaaagggtttataggaatttccccttggggggggaaaaaaaagccttaagaaaccagctggccccttgggaaggaaaaaggtccctttttttttttttttttaggcaaaaaaagagattccccccattcctttttttgttccccccaattttaaagctatttttcaaaccggttgagagaaggggcccaaaaagaagggttttaggtcttttttttaattaaaaaaaaaaaatttaaatattggggttttaaccccca

SEQ ID NO: 618752 - DNA, 592 bp, Homo sapiens
  misc_feature (592)..(592): n is a, c, g, or t
cgaaacgtcaggaaactagggttcagcccacccggacgaatggggcgggaccagtcattcacttttatagctcttcacgcacagaaggaagccagagacttttggaacgatggttaaagcatacctgtgatatagaatgccaatgatggcaagggcagtgatatttcccacgccaaggttgagcaagtacactaatccggccaactgtagctataatttactcacacaagcctatgcacttagctctagaggccggcatggaaggactcctgctcacagcagacatgattggcctgaagcaacaggtcggagcacaccagagtcacctgatcaatgacctttgacaacaggtgtggacacccgcagatcatattctatatacttgcactcatgtcggacgttacaggcctgggcctgatccaataacgattggaacgccaaggagagcacagtggtgggcgactcgcggtcccatactcacatgaactaccgcgctaccttgtggagctatagacgtgttacgagcactcttaattcactggctcgtacactgtcaagcgctactgatggtcgtacattcgtgcactagaan

SEQ ID NO: 618753 - DNA, 160 bp, Homo sapiens
atctgatactcgcgagtcatggtcactcggggtgtgacgccgaagaaaccgatactgacacgccgagaccccgtactacatcaggggtcggagtggacgaagttgttgtgcacacgccgagggtccatactagaggagatcgtggtggacgaagttgttg

SEQ ID NO: 618754 - DNA, 1170 bp, Homo sapiens
gagaaaccctacaaatgtaaagaatgtggcaaagcttttagcgattcctcaaacctggctacatcatgagataactcatactgaagagaaaccctacaaatgtaaagaactgtgacacaaacttttaagcgacttctcagacccttagctaaacataagtaatacatgctggagagaaactctacaaatgtgaagaatgtggcacagctttaagtcgatcttcaaatcttactatacataaagttcatacatacgtggagagaaaccttaccaagtgtgaagagtgtggcgaaagcattgtaactggtcctcaagccttactaacacataaaagaactttcagtacatagagaagacagagcccttcacaatgctacaacgcctgctggcacaagcaatttacataatggttccttcaaacccctaagctaagacaatacacgacggactaacaacaacatggaggacagaaagcccttaccacaaatggtgcacagcaaatggtgagacacaaaaggcgtcaggcaaagaccagagaaccacgtccagagaccccaatcagaccgtgaaaacagccactcaaggaaagcacggtacaaatcaccaggggaccgcaaagagaagacacgtagccacaagtggtcacaagcacatggacggcccaaacgcagcgaacaagccacagtcccacgagaaccccacggacgtacacaacagtaaaccgacaagacaacgagcaaggggccgcgcgcacgaacacgaacaaccggccgataccagccacagtgcaggacaaagacacacgagcggccacacaaggaagaggaaacagacccaagccccgaaccagaaactcagacaaacgaaaaaaagaagacaaggaaagaacaaagcagacagacgagaaagagggagaaagaccgcagatccacgcaaagagacgaatcgacacgcaaaacaggcaggaaaaaaagagagccaaatcgaaacagcagagggggggacccaacagacaagcacgcgcatgaacacgcaagacgcaggaaggcacgagaaacaccaaaaacgacaagagacagcaagccaaaagaacagagtaacaagacagagacggcagacgaccggcaacaagcggcgaggccaacacagcgagagcaagcagacgcacgc

SEQ ID NO: 618755 - DNA, 172 bp, Homo sapiens
tttggatttttgcccctttttttcccttggcccgggtgtcccaaccaagttgccatggccaagggccgaacccgtttgccctcacccctgctccttgggcccaggggccagggccccgcccctgggggtggcaggggggggctccggggtaataaagtggggaaactgtcca

SEQ ID NO: 618756 - DNA, 140 bp, Homo sapiens
  misc_feature (82)..(82): n is a, c, g, or t
  misc_feature (111)..(111): n is a, c, g, or t
  misc_feature (130)..(130): n is a, c, g, or t
ccccctccctccaccctcctcctgtccctgggctgtctccccctccctccaccctcctgtccctgggctgcagctctgcttncctgccacaggtcccaccccctgcctgcntctgtccacttcccacccncctcttcacc

SEQ ID NO: 618757 - DNA, 359 bp, Homo sapiens
tttttttggtttgtggggtgaaacaaaactgtaaaccccccccgggggggtttttgctttttttttgccaccaggcccccccctttttaaaaaccccccccgggttccagggtaaatttggttttttttttttttttttagaggttcccttttaaaccccccacccccccgggggggggtgttgggccgccccttttccccctttaagaaaaaaaaaaaaggggggggatgtttttgggctttttccccccaaaaaccccgggtttcttttttttttaaagggtttttttatggaaaaagggcccccttttggccaaatgcccccccttttttttcttttaaaaaaatgggggggggta

SEQ ID NO: 618758 - DNA, 1150 bp, Homo sapiens
  misc_feature (1104)..(1104): n is a, c, g, or t
aactaatctggtgcagatgatcaaaataatcagatgcgcagagtatcgtggcggaaccttcccgctgttaaccgcgcgacagtggttgagcccaacagacacggtctacttgagttggcttgctacattgcactaaaccaactcgagagattcgggcttaatccggtgagacaggaagcaagtatggagtacatactgaacagaagtaattcttgacagctcgcgtccgtgttcatgctagatcactgcttttaaagttggacatagagcgcgcaaagccgatataaacagcctcataggttagatgcacgtattgactatacaaggatacttacggacagcctagatggcctggacttatcaaaaccgtcgtgagtctgtggggatacgtgtcgcgaccatagaggtattccgcaatcgatcataattaacttgaaatggggacaatgactttctatacctttcactataacttcgaacttcctttaattgtaaaacggctgtcccgtatagtgatgtcctttcagtgcaaaggacaccacattcaacatttaagcgtgtctcattcacacacgagtggggtcactttacatttgtgcttttaagacagtagcgtctcgactcttgaatactatagggaagtgtaagagtattaaaacactgagcacgtggtattgttacttattatttctcaagcttgtgtggtaaatgcgggaatcctgaggggtgagaaacttttgagaaatggccgtgtaaccaatttgacggtaataaggcaaaaaatctctattaaacatgaatattttcaattaaatgcatagagctaaataaattattgcaaatggaattcttgggtggttacttcgatgggttgccgtagaaaagtgactagattacgtgtggccacaaatgtaagtggttgtggcggaaaagaaggtggatgtggttttggccgaaagtggcagcgcaaatgtaagggttgtaaaccacggggaaacttcctatcgaggttgatggaattagctattttagaggagggaagtagatcgttaaacatagtaatatggttgaggttcacacgggttttattgttctggtgagagngaataaacattgcggtgtgaaagaaagcaggacgtgtaattatcag

SEQ ID NO: 618759 - DNA, 248 bp, Homo sapiens
  misc_feature (28)..(28): n is a, c, g, or t
  misc_feature (45)..(45): n is a, c, g, or t
  misc_feature (76)..(76): n is a, c, g, or t
  misc_feature (79)..(79): n is a, c, g, or t
  misc_feature (155)..(155): n is a, c, g, or t
ctccagcacaagcagtaaaatttaaacnccaggcctggacaaaancaatgtttgttaaaaaaagtctgccagttcnggntgcgatttttcagaaacaaggaaagaaatcctaaataaagatgatctgtgctttggcaaaattcatttaggggaantgccctttttttccaaatggctgtgcatttttaatgatgatgaatataaagtatttagcagaaaattttttattaaagttgttgagcttatgg

SEQ ID NO: 618760 - DNA, 1197 bp, Homo sapiens
gggtccccacagctgccattgtggcccgacacactataccttgccaatggacagaccaaggtgctgactcagaagttgtcatcagtacagaggcaatcatattatctcagggacatgcgcatacatgtggtttggccagagcctatcgggttcagcacgatcaggccttctatcctgggctgcaacatccttcgagttgaatattcctatactgatctatgtagcgtacctggatccaacgaaggttcatccattgacctgccccatggataatcggacagacagatcaggtctacaaagcagacagaacatccagcatggacagacgaacccaggactctgagatgagtagggaagatctagaacatccacatgataacccagaaagctcactccctggctaatatggatgtcattcctgaacagaaacaccgatatggaagagcccaaaacactcctctgcctagcactgacatggataggctcttcaaggacacgaccctatctaaaatgtaatagcacccctagacaggtaacaaggtacatggccaacacaacagactatataactgacggggggaatcccaagacatccacaaaccaaagaaaagagcaggagcagcaatgagagacagaacaaggaaagcaaccaacaaccaacaatgaaacaaaaaaagaacacacaccaaacaggcaccaaaacaacgaaaaacaagacgacatccaaaaacgacacatgcaaaaaggagatgacgaggaaccaacgcaataaggaacgcaggaacatacataaaaaagaaagagaaagaagaaaaaagacagggcaacacaatcaccagaaagacataacaaaggagatgagaccaaaacatcatacagccaccagaccaccatgatagagacaacaggaaaaagaaaaggaaaggcaacagcaaacaacaaaacacgacacgaagaatcgaaaccgacaagacacaaaaacagaatgaggccacaacacaccatgacaaacaataggaggcgccttaaaaaaaaaaaaaaggagagcagagaacaaaaggaacagacagcagatcagccaagcaccaagcgacgacggaaagaaatagagaacatagataacagcacccaataacgacagaaacaatgaatacagtatcaaacgaacagaaataagaaatagaacaaaagagagat

SEQ ID NO: 618761 - DNA, 81 bp, Homo sapiens
cagccccgtggggtgcaaagtgtgacccgcactggggggcggcccgggcatagctgcgttcccggctgaagattttggctt

SEQ ID NO: 618762 - DNA, 103 bp, Homo sapiens
ccaatcagcaggacatgggcggggacaataagggaataaaagctggcgagcgcggcaccccaccagagtctgctctcacgctgtgggagctttgttctcttgc

SEQ ID NO: 618763 - DNA, 93 bp, Homo sapiens
ctcacagggatgtgtgagggttgatgagagaatgaatgttaataggaatggaaaattcaaagcattaaacacatgtaaacaggtggtattatt

SEQ ID NO: 618764 - DNA, 215 bp, Homo sapiens
tcaatgtcatccatctgctcctttctgtgcacctattaaagaacaatgagtgtatgctccattctgaatttcgtccagcctctctctaactgtatctttgtccatcatgaactttcccttttgttcattgaactatatagtactcttcatttcattttgatttactgtgcaatttacttttggacacttgagaacttgaaatggtcgccaatccg

SEQ ID NO: 618765 - DNA, 1068 bp, Homo sapiens
  misc_feature (42)..(42): n is a, c, g, or t
  misc_feature (46)..(46): n is a, c, g, or t
  misc_feature (121)..(121): n is a, c, g, or t
  misc_feature (210)..(210): n is a, c, g, or t
  misc_feature (214)..(214): n is a, c, g, or t
tagggagctgggtggtgaatcggcaccgaggggttcctgctnggtnagctgactggccgttcttcatctcttatcctgtactggtgcttcctcaaatgctttctggaagtagctaggagtngaatgcaaaggatagatcatcaaaggtctctctctcccacctccctccctctttccccacccccttccctcccctctctctctctcccntccnttctctctccttctctctccctcccttttcttctccaccacgctcccacatctcctctctactctttctgtctctctccctgctaaagaaagtgggaacaatggagagttgttacggacagcaatggcatcccagtggggtccactcatgaggcgtcagcgcactgaagaccttgcaggatgggaagctacatccaacgagcgctcgggggattatgccccagatctgcagcgagcgcacactacactcggtaaagttggcgtcagctaagaacctcagttgcttgcgagggacatgccccagtctgcgtctaacgcgagcaacgcagcaggacggagagtgagcgaaggaagtgcaaggagcaacacggccgtggggacagagggaggaggtgggcgagagggtgaccaccgagcatgacgtgaagagacagaaggccccgaaccacagagggagtgccggaaatcggccacgggagggtggcagtacccccaaaaggggagctcacaaccagcaggaagagagcaggccagcgagggaaaaacaagccaagcttccaacgcaggagcacatgcacaagtcgggaccaagatgttacgaacagagacacaaagaagacgaataccataagagcgaacgaagaagcagacggactgccacaagggagagaacatccacatcaacgcacgagcaaatgtgtgacagggcacgggtacacgcggtggaatcccagccggtaagaaaggggaacatggcacgaagcgacgcacgaagggggaagaaaaacgaggcgaggcgggaaagcagcatacacgaagtaaaacccgtgagctggataccacagaaggcccaca

SEQ ID NO: 618766 - DNA, 402 bp, Homo sapiens
cgctggcttcttcttctcatggggtcgccgggatctagtgatggactgagttactaacatgagcacccatgtcttgactggtgtacatggtggcttcgatgtacaagctatctccgagattgaagttgacttagggaagaagggagcagagaatggaaaaagtggagcatgcagaggggtcttacagcaaggatgggtctttctatctctagtactacactgaattcacccccactgaaaaagatgagtatgcctgccgtgtgaaccatgtgactatgtcacggcccaagatagttaagtgggatcgagacatgtaagcagcatcatggaggtttgaagatgccgcatttggattggatgaattccaaattctgcttgcttgcttgtgaatattgatatgct

SEQ ID NO: 618767 - DNA, 792 bp, Homo sapiens
  misc_feature (42)..(42): n is a, c, g, or t
  misc_feature (46)..(46): n is a, c, g, or t
  misc_feature (121)..(121): n is a, c, g, or t
  misc_feature (210)..(210): n is a, c, g, or t
  misc_feature (214)..(214): n is a, c, g, or t
tagggagctgggtggtgaatcggcaccgaggggttcctgctnggtnagctgactggccgttcttcatctcttatcctgtactggtgcttcctcaaatgctttctggaagtagctaggagtngaatgcaaaggatagatcatcaaaggtctctctctcccacctccctccctctttccccacccccttccctcccctctctctctctcccntccnttctctgcctctctattctctctctctctcccccctcccccgtctcattttctctactctctcccccgcttccgcactactcctctctctctttctgatctctctccctgctacgaaagtgggaaccaagtggacgagtgtcaggacacgctggacatcccagtggcagtccatcttgacgctccagtggacttgaacgccctcacgtatggcccacatctccccaggcctggcggtctactccccccacatctcgcacgggagcccactccacttacctaccttgtcctcagatagcactccactgcctttcgccacccagccacctcggctccaccgagcactcatgacgcactgggcctaagagtcaaagaattacaacgaacaaagcgctcttgtgaaacagcgaagcaggcgcggcacgacccgtgaccccgttgcagacctcgcactcaagatgtcctttccttacaagcttgtagtagatagcactctgttgctcgctcgcattcccccacacttgccgacttccaccgagcacccagaatcgcagcaccacccgcatctacccaaccttc

SEQ ID NO: 618768 - DNA, 202 bp, Homo sapiens
cgtcgacaggacagccaatgctgtcatgacttcaaaacagctgtggctatattcattaagtctacacacaaatgagcctatcaacaggtggtcagggaggggcctgtgggacctgctcctccctgctaagctaccagctacttatggatactgaaaaaaaaagtcgtatcgatgtcgagcgtcgacgcggccgggtcgacgc

SEQ ID NO: 618769 - DNA, 408 bp, Homo sapiens
catcatggggttcggaatctcccaaatcaggaagtgagtattaggttgggttcatctgggtggccccgtgcacctgttctccctcctcttgcctttgccatggccgttcctttgcctgtctcatcctttctccgctctactcttcttccaagacccagttcattttatgatccctcgttaaggcctcaaagaggactaggggctgaaatcagacctgaactcacttctggcgtcccactattgccctacacagagcctggtgctaaagtgaagtgaagttatattactctttacactagtgatctgaactcagggagtaacaactaggtcttcggggtgagaaaggggagtccatgaagccaagtcgatgtctgtctgacagggcccgtctcttcccaccctcagtct

SEQ ID NO: 618770 - DNA, 363 bp, Homo sapiens
ccataggtgccacaaacttggattttatgcgcagcttcttctcaaacacgatccggcaggcactcttgaggttcttctgaaggccggtgcccgtgtcaaggagctccttataggtaccatgaatgtctgggctcctgatcaagtcatagtagagagcccggtatatgatgtattctgttcgctgctccgctcccagcgagaggtccgagaggccggtggccactgtgatagaagacagaagcacgttggtcgtggggctctgtgttggatcgcacccggtacaggtcatagtcgaagttatagacatccactgacagcgtgctcacgggctctgtaaacagaggatcctcctcctccaacacc

SEQ ID NO: 618771 - DNA, 518 bp, Homo sapiens
  misc_feature (24)..(24): n is a, c, g, or t
  misc_feature (38)..(38): n is a, c, g, or t
cttattgccaactcagcctagacnatgctgatggtgtngccactatttgctaggccccaactcaagccaaggtgtagatatttagatgaatcttcgactggtgcactgatgtatttttatataaccattatttaaccaggcaagtcagctaagaacaaattcttatttacaatgacggcctccgcctggccaaacccgaatgacgctggcccaattgtgcgctgccctatgggactcccaatcatggccggttgtgatacagcctggattcgaaccagggtgtctgtagtgacgtctcaagcactgaaatgcagtaccgtagaccgttgctccaagcatgtcactttttctgtggctttcggtctcctctcggttcaggcattgaagcagaggtgctggtggtggagtcttttgaggagctgaagaaaaggcagaaggaagccattgggaagatcgtggtgtataaccagccctttgtcagctatgaggagactgtgcagtacagggagtttggggcg

SEQ ID NO: 618772 - DNA, 131 bp, Homo sapiens
agcccgcctggtcccctctgtgagcacccatttttgccaccactaacacagctggctgtgtgtggcacatgccagtagtcccagctacttgtggcagcttagtgtgggcggcttgcttgcgcttggggtgg

SEQ ID NO: 618773 - DNA, 123 bp, Homo sapiens
ctgctctgtggtcatgtgaactgcacgataaaggaactcaggcgcctcttcttatgacgatttagttgattctctgaagtttgcagtgttgatgtggtattactattaggtgccttgttaatg

SEQ ID NO: 618774 - DNA, 546 bp, Homo sapiens
gcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactacaaatttattaaaccagg

SEQ ID NO: 618775 - DNA, 1517 bp, Homo sapiens
aatagggccagaccggtggaactgggaagtaagcagagtgtttgagatctacatggggaaagagactagccttaattggtagcccacggttatagatgggcctctttagtttatattaagtgtctgaccataactctgattcgtaggtgagtgccaaaatgctctcttgtatagtcgatactaaaaagacccactgggggccctgggagtaatccgcctgggtttcatcctggcggtagttgttcgacccgtaggtaattagggttgcaagtttctgaagaacgccgaaacccgtccacgctgttcgcgtactgttattagacgtttaacagatagccgctccaagggccgcctctatggtagcttcgccgtgtagacaccatagcgggtgagcatcgacttgtcgttgcgagggcgcccactgtccgggtttaaagttgtgataagcgcctttgctcgtgggaccaccgttaaggtcgccaaagtgctttgaaggtgttgtccgaggcgattgttgccgcaacctttgcgcgggtgaaagcgggcctgcccgttccaaataacgcgtaagtggccctctaagacgtgaatgccccgtagccaaacaagccgttaggagcccgcaaagtatgtaagtcgccagaagataggaacctggggcactgcccgtaacatgggtaaagagccaaccccgaatgacaaactggtcaggcgacataagcggcacaaggggtccccagtctgcaatcattcaggcgtcagtctcctttgtttcgcgagaaatgtgaagggtcctcttttgcggaattacttccgggggcacttaaattgctcgtaagtgtattatgttaggcgcgtgccagtgtaaagagtgtgcttagtattgtagcgttgttgcggtctacggagaaatgtgtgtgttgcgttagagggccatttagtaacgtcagctttcccaaaggcccgtaggtcgtccggcgtatgcgcgcgctgctcagagttgtgaggcgaagagcgtggcatgcttggtgtctcgctcgcacagtcagggtcagtgcaagcgcgcgcggcttagaaagtgctccgcttaggaagggtgccgcagcttccggtataagcagcagtcgcgtagttagcgtcgcagtcagggatgtagtcagagtcagacgctgaggctgccaacgcagtatgtgctgaagtatgaaagagcaagcgcgagacatcgcaagagtaacttccaagcgacgtgcgtcatgtagcaactattgtagctgggtcgtctattgttagccctccgtagcaagccgtgcagagtagcttcgagtgctccgcttcagccatttgccgatcggcatctacggctcaagcatttgtttgtagccacaggcttccatcggacttcacgtcacttaatggctcaacgtttcctcactatctgcttcatccgccaacgtaatatttcagctttacagccaaacatcactttggcttcgaagccgccaaccttagtactggca

SEQ ID NO: 618776 - DNA, 198 bp, Homo sapiens
cttctgatggtgatcatggtaaattaaggaacggaagatgggacaggcagataagaaaaatgaaaccctgaaggggataagaagtgctgagaagaagacacctgatgacaaggtaagaatccttcctccctgcaaggaacccagttctctccccaacccagctctgacaccactactcatggccctggcagaagctca

SEQ ID NO: 618777 - DNA, 443 bp, Homo sapiens
gggatctcctatgttgctacgctggtcttgaactcttggactcagtgatcctcctgccttagcctccccaactagctgggactacaggtgctcatcacagtgcccagctctattagatgtatttttttttttttttttgaaacaaaatctcgctctgtcacccaggctggagtgcaatggcatgatcttagctcactgaaaccactgcctccgtgttcaggcgatacccctgccacggcctcccaagtggctggaattgcaggcgcacgccaccacgcccagctaatttggaataaagggtggaaacggggtttcaccatgttggccaggctggtcttagactcctgacctcaggcggtccacccgcctcggactcccaaagtgctgggattctaggcctgagccaccaaccccgaccttagctatataagtactgaaacgaa

SEQ ID NO: 618778 - DNA, 1407 bp, Homo sapiens
  misc_feature (621)..(621): n is a, c, g, or t
gtcacggcgtggggcaagacaccaagatggtcgggatgacgtccgtgtgcagccggtggtggccctgtaggccctgagtggccctgtgatgcgggaaccgtggatggcttccgacgtgagagtttcgtccagatgggcaattctgggagccggcgggtctgctagacagtaggcacggggcactgcggttccgtatgtcgcgagagactcgcgagaggccagtggcgagggattaagtgagtggaagttgccactgtcacctagagttttgtggcctgcttgggtcatatggaccatgatatgatcatacgttcgccttggagagtaggaatctactcgttctatctcccctggcccaaattaaggagaacgtcaagacgagtcaactatgagtattcctatcccttggtgagggccatcctcgtcaaagggatttgaaggtatattcgacagggacttaattgcccatatgccaagaaacgacagaccccaggtcgcgcggtggcacaagcagactcgagggatttcaactggcaagttgttgatggctagtcagtaggtgacgtaacatatggtgcgctcatgccgtcagcgtcgcgtgggtcgtatacatttggcatnccgaaagcgatgtgtagtgaccaacacagccaggtcccaggttgagtcagccaatacattcccttgcgtcacaaagacctacctacccagtcagttcacccctggtggctgtcaaggaaggcgcataccttggggggtgaaacacaacgaagttccgggacgcagaaagtggcgacaagtaatctttggtaccctccgtttggaacataggtggcttagaaatcatgtgggcgcgaatggtagccagaggctttcgcttggttgcgtttggggttaaccagagcgcctgtcgagatacgccacagtgagcattcccgaatgaggggttgcgacgcttaggcggctgagttcgtgcttcccttaccgcggacacccgtagtaggttggcctcgttaacacggaaacagccatttggtgcccaacttgaaactgtggctagggcgttagctccggacactgaaccgttaggcaatttcacaagccgtttcaaagagccctctggagggggtcgttgcccacgattgagccagctgccatctggtggtgtagtaacaactgtacgtcagccaaagtgtgagccaagcctatttatggaggttaggcccacattttcgtttatcgaacgccgttaagcagtgtatagctcattgaaacccagcacaggtagacctgtcgttgtaacagggtgaggaacttggtattctcaacaggagagggttcgtcagggtatatacagaggaaggctacaacacgtgaatccgaccgggtcagtatagagaaagcgca

SEQ ID NO: 618779 - DNA, 363 bp, Homo sapiens
atataccaaattagcctaatatgtttcttttggacttccaggggccctatttggacttccaagggctttaatgcccaaaagttagcttgaggtcgaaaacatttaagttagaattttacatttgattttggaaagtttgtcaaatatcaaaggtttaaaacacttgatcaaaataagattacaggtcactgtaagataatagttattcatttagccaaactgataattcaaaaatttcaaaaagcaaaaattttactctttgacagaggggagattcagttttccaaacaatcaaaagacataataaaaacagcattagggaaattctctcctcttattactaatattttttgcagtttactc

SEQ ID NO: 618780 - DNA, 571 bp, Homo sapiens
agcaataaagctgtttatttcacctgggtgccggtgggctgagtccgaaaagagagtcagtgaaggaagataggggtggggctgttttataggatttgggaaggtaataaaaaattacaatcaaagggggttgttctctggtgggcaggggtggatctcacaaagtacattctcaagggtggggagaattacaaagaaccttcttaagggtgggggagattacaaagtacattgatcagttagggtggggcaggaacaaatcacaatggtggaatgtcatcagttaaggctgtttttacttcttttgtggatcttcagttacttcaggccatctggatgtatacgtgcaagtcacaggggatgcgatggcctggcctgggctcagaggcctgacattcctgccttctgatattaataagacaaataaaacaaaatagtgttgaagtgttggagcggcgaaaatttttggggggtggtatgggaagagaattggccatgttttttaaggccgcttcaaaatggaatatgggcctgtttgggaaacctctagggttaaaaaataaacttgcag

SEQ ID NO: 618781 - DNA, 473 bp, Homo sapiens
gacgtcatatgctgcttgaaaattacaaatgtgtcttcgaacaatctacagtcaaaacagtgcacgtcccgagtttctcctatagtctgacttcgtgaacgtagtctcatccatgagtttttctggaattgaatgaactttgtctaatatttcttcaagtaagtaattaagaagtcctgcttccttgcatttcttaagaaaaggaactttcacagttgcatctgtgtgtctgccatgctcttctttcacttgtcttatgaatgtattacatttcattgtttcgggtggctgtacatgattgcctgagaggggtttcttccttcctctttttcttttcactcctgaaaatttagctaaaaatataaaccatttaaaaattggaatccataaaggaaaagattactctttgactacatgaaatatacaactcatatgccaaaagttcttacaaagccaaaagatatggcaaactt

SEQ ID NO: 618782 - DNA, 161 bp, Homo sapiens
gcagaacgacagtgaacaccagaggatgttcaacccgtgtcctccctggtcaagggccacctctctcccaattgccggccgcccacggagtagaagggaccaatctgtcccgcgacgtctgaacccatctcacggaccactttaaaagggcgaacagcaaa

SEQ ID NO: 618783 - DNA, 225 bp, Homo sapiens
  misc_feature (137)..(137): n is a, c, g, or t
  misc_feature (206)..(206): n is a, c, g, or t
  misc_feature (224)..(224): n is a, c, g, or t
gccagtcattgtggagcaatgtgagagcatggtgataaaggtaaggaacatgttttctttttttaactcctcttctgagtagctgtgtgatcttggacaagcctaaacttcgtgggctacctttcgaaacatggcanatgaggacgtctgaagctccttcccatgctaaatcacttgatttcaaacttgcatacacttagtcctanaatcagatgccctgatana

SEQ ID NO: 618784 - DNA, 1124 bp, Homo sapiens
tggctgtggtgctgggatccctgagctcggcaatgcagctgcagctgtggcctggcccacctgctggtgccctggaggctctgagccccggtgtgctgccctggtgcccacgctggaacgatggggcgagatgctgagccaccgcctctggcttgctcctgctgggttccctgtccagtgaagaagctggttggacgttggattgacaacttagatacctgagctgtcccgtccaggaaacgagctcgaagtgggccccgagcccagacttgcaccaccgtgccatgttgccgcctgatgccacacacttactagcatccaaggatcagtcgcaagcttgctagttgggccacattggctcacccgtcattgaggacccatattgtccctcccgtcgggagcccagagggagtggctggagctggatgcttatccatgtgctccttgctaacttgccccttaccagggcaacattgagattaataacccttgcaaaggggtagtaccacactggttgcaagagaaaggcacttgggcgcctgtgccttgggagaccattaattgcagactggaatggcgcacaccgaaggaagggcattgtaggcatctgtgaccacaaagttgaagggagtcccgttggagattgggtataccacgacaagagcattcaccattcatttaaacggacccgtttatgtgtacgacattcggaggaaccccacacagtggggggcacacaattgcataacaaggtcacaatgggaatgacggaacaggcgcccgacgaaccgagatgattcgccacgttgacaggccccgttgaaaggagcgcttagcacaggagtgtccgtacgttttaccgggtccaaggaaagttatgggacaatcagcgtgggtactcgtttgtggggggacgagtttggtatgatcgcgaaagggcgaaagggggtactatagagatcacggttagacggttagaatttcttctaagaggctgtttgttgatagggagatatgtggtaagtataggatgtgacacggttgaatagagggatatgagagaggattggagtggattgggaagagaaccattgggaaggtacttagcgttggagtatgatggc

SEQ ID NO: 618785 - DNA, 166 bp, Homo sapiens
aggctccatgtaaacgatatttggaggtcagctactgaagctcactgtgtcgacggaacttgtacagtggaggcatgcaccgcatgtggtgaatacacgtcgaccaggatccatgtatacgttattgggtggtgaacacggatctcatatagttgaaggagcttgt

SEQ ID NO: 618786 - DNA, 805 bp, Homo sapiens
  misc_feature (15)..(15): n is a, c, g, or t
  misc_feature (62)..(62): n is a, c, g, or t
  misc_feature (70)..(70): n is a, c, g, or t
  misc_feature (82)..(82): n is a, c, g, or t
  misc_feature (87)..(87): n is a, c, g, or t
  misc_feature (89)..(89): n is a, c, g, or t
  misc_feature (99)..(99): n is a, c, g, or t
  misc_feature (140)..(140): n is a, c, g, or t
  misc_feature (167)..(167): n is a, c, g, or t
  misc_feature (182)..(182): n is a, c, g, or t
  misc_feature (187)..(187): n is a, c, g, or t
  misc_feature (196)..(196): n is a, c, g, or t
  misc_feature (198)..(198): n is a, c, g, or t
  misc_feature (204)..(204): n is a, c, g, or t
  misc_feature (210)..(210): n is a, c, g, or t
  misc_feature (263)..(263): n is a, c, g, or t
  misc_feature (423)..(423): n is a, c, g, or t
  misc_feature (499)..(499): n is a, c, g, or t
  misc_feature (624)..(624): n is a, c, g, or t
ggaggaacggccggnacccaccccgtggggctccaagatgccctttggggaactgatgttcnaatccagnagtagctgcggntgggnanatggcgtttntttttcagccagcgggagccgcgtggcctgggtgagccacnacagcaccgtctgcctggctgatgccnacaagaagatggccntcgcnaatctggcntntgaaanactacnacggctggcgctgaccttcataacaaacaacagcctggtggcagcgggccacnactgcttcccggtgctgttcacctatgacgccgccgcggggatgctgaagcttcggcgggcggctgaacgttcctaagcagagctcgcagcgtggcttgacggcccgcgagcgcttccagaacctggaacaagaaggcgagctccgagggtggcacggcngcgggcgcgggcctaaactcgctgcacaagaacagcgtcagccagatctcggtgctcagcggcggcaaggccaagngctcgcagttctgcaccactcgccatggatggcggcatgagtttctgggatgtgaagggcttggagtcagccttgaaggacctcaagatcaaatgacctgtgaggaatttgttgccttcatcctngctgctggggaagcggggagaggggtcagggaggctaatggttgctttgctgaatgtttctggggtaccaatacgagttcccataggggctgctccctcaaaaagggaggggacagatggggagcttttcttacctattcaaggaaaacgtgcctttttcttgaatgctttcatttattga

SEQ ID NO: 618787 - DNA, 710 bp, Homo sapiens
agcggttcaagactagcctggccaacatggtgacatggtaaaaccctgtctctactaaaaatacaaaagttagccagggctgggcacagtagctcatgcctgtaattctagcactttgagaggctgaggtgggtgaaccacttgaggtcaggagtttgagaccagcctggccaacatggtgaaaccccacctctactaaaaatacaaaaattagtcaggtgtggtggtgcatgcctgtagtcccagctatttgggaggctgaggcaggggaattacttgaacccaggaggtggaggttacagtgagccaagatcgagccactgcaccccagcctgggctacggagcgagactccatctcaaaaaaaaaaaaaaaaggttgccaagcgggggggcacacacctgtaatcccagctattcaggaggctgaggcacaagaagggtttgaacccaggaggtgaaggttgcagtgagccaagatcgtaccattgcactcctgcccgggcaacagagcgagactgtctcagaaaataaatattaaataaataaacctgccatatagcttctatgacccaaagatgagatgcccctgggccacctctaaaaatctcctacaaagctgatgtaaccttgagaatcaccgaggacccaaaagctgactgagcatcaaatattctgctagttcttgcagatggggtagaggaagaatttc

SEQ ID NO: 618788 - DNA, 572 bp, Homo sapiens
agagctgtgaggaagctcactgcagagtgttgcagtagcatgagagggaaaggcacccagcctggatctcactctggtgtcatcgccgcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgcttgcggatggacaagcctgtgcctcgctgccttgtgtaaccagtttatgcaagggccagcggcccgcttacataaggggaggccgggccagcgcccagctggggagggggaggctctttaagggagcggcgtcccccgcggctccctccacggggcctggtgcggaatccataggggagctggggactccaccctcag

SEQ ID NO: 618789 - DNA, 425 bp, Homo sapiens
cccggtgggaaggggagggcgcgtccgccgcccgccgcaccccccaccccccggggccggcacgcccccccccggggggaaaaaagaataacccccggggggggccaggccagccaccaggcaatccccggccgagcggcgggacaggggacgggagacccccccaagccgccccggcaccgcccggcaaggaaccagcccggcgcggggggcggggcaccccggagggggccaggcggggcgagccgcccgggccccgggccgggcccccgcggggggcccgggacccctcccaagccgggggcccggggagccccaccacgggcggcggggccggggcccgcacgtggccggggcacccagcgggcgggccgggggccgcacgcccccggggggcggcccagggccccgccccgcgcccgccg

SEQ ID NO: 618790 - DNA, 410 bp, Homo sapiens
ttatctagaaggatccccagcacatcttagtcagttaagagaaaccaatgcagatgcctgtgatgagtccgggatcccataatgagcacacggatgtgtgaccctgttggtgctgccatcttccagagtcacggtggatagatccaccatggcaagacattggctcagtgaccaaacagattcccttttaacgggtggtccccttcaccatgttgaccagattcgggccaaacacagaacttaaaagaaaaaatccaaggggggctggcagagaggaaccaccaaagggagcaactggaatagatacggtgaactaaccaaaccaaaaccaaccccagagttgcagataaacaatggttgggggttcctctcttccgggtcctggtccctttccttcctcctttcctttt

SEQ ID NO: 618791 - DNA, 112 bp, Homo sapiens
atgcctacaaagctttgaattcagggtcccaagttgctgtcacaaaggaagtgaagtgaaactctccccccctacccccttttttatataataaaagtgccttagcatgtga

SEQ ID NO: 618792 - DNA, 289 bp, Homo sapiens
taaagtcctactacctacctggtatatggcatatctgagtgtctggaaagcctactactgccccataagccaggaaaagtgaacagagaacacagtatccttaaaaaactggcagcaaggctatgaggcctatatgtatgtaagctagattcagcaatggtacctgatgctgtctgctttcacaaggacttttctctcctagctgactgatttccttccttagttgacggcactagcttagactgacctctgctgagtcgctctgagctctgtgtcatggagctctgct

SEQ ID NO: 618793 - DNA, 859 bp, Homo sapiens
cgacgtgacgacaaactgtgctcctccaggccagacacaagagcacctcagggtgtactcaaaatttctgtagagtgcatcacccagtgagaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcggatttggactctttattgggtgcagaactcggcaaggggcagcttaccctccccagaacccaggatcatactgtctggttgcaaagagagaccaacccctaacaagggctgggccacagcaaggagtacaaccctaccttcttccgttggcagctggacaaacctggggcccaatataactccttgaaaacttcatcgccccgcgccttataattggaagaagtctgggggcccaagttttccttggaagcatccacgccacacgcccccctacctgggatactggcccctggattacagtcactacacgctgctacacaaccgcgaacctgccggaatctcataaagtacttgcaatcggataccaacagaaccaaaagggactaccccggtggttacggaagctttaccaacagtatggcaacttcagagcttcggaactagggagccacgtccccgcccacacgcctgatcgtacatgacctcagaaccagctaaggctggggcgcgcacctagattggaggaccggctgcagacaatactaaccaccgttgagccacaagtaattcagacgtgtccattgggtgg

SEQ ID NO: 618794 - DNA, 263 bp, Homo sapiens
gtagtgattctggacccagtgcggagcgcttgcgcttgtctgtccctctagagcaataatggtcccatccaggcagtcgggggctggactaggagatatctgagggaggaggccaactctccaagggcttctgcaccctccagcctgtcccccagctctggtgagtcttggcggcagcacgccatcataggaagggaccaaggcaaggcacggtgcctccaggtgtgcacgtggcatgtggactgtggcctgtgtcccataga

SEQ ID NO: 618795 - DNA, 87 bp, Homo sapiens
ttttcccccccccccagctacccataggggggggagagttataagcccccaacggggcttggtccaataaaaatgtttttcccccca

SEQ ID NO: 618796 - DNA, 1416 bp, Homo sapiens
  misc_feature (241)..(241): n is a, c, g, or t
  misc_feature (819)..(819): n is a, c, g, or t
  misc_feature (1066)..(1066): n is a, c, g, or t
  misc_feature (1161)..(1161): n is a, c, g, or t
  misc_feature (1358)..(1358): n is a, c, g, or t
  misc_feature (1360)..(1360): n is a, c, g, or t
aattcttgcacgaggtgggcgagtacgagttcctacagaccagtcaacatgagcaccaagcagatcacttgcgaggtatatatagcattggttgtgtgtacgggaaaggaacgtcagatggtctaattgcatccacgatgacttaggcctaagcatgttaatatctgtccaacctatcatgcgtaggttactaccgagtaaagggcttccttgatgtccctattggcaactactggtggcntccattagtgactcacgacgtatggtaccctcttgactgtcaatcctgggagggtagtcttgatagggccacacgatgtgaccgaacagaagctagcctcttccaccctaaacattatcctacatacgtccctcgactgctatccatatactaggagtggtcagcttgcgaatccacattggtgacaacatcgtagacatcatcacatgaagctcctggtagaacagccgctgtactaatgatgatactaatagtggtatctattacgcagcaccggaacattctcttcttgtgtccgtgggcatgtatccatggtaacgtaacctcaaacgcggaagtcactggggtggaggtaaattcccacggtgcaagaccatgctccgcgaactcccaccataacccaatttccacaggatgtacatgaaagtcctgggggtactcgatactccattgttaattgaccacgtgacgggtaggatgcgtccctcgtatcttgactcgtgggcatgaggtctacacgcattcgtcccttaacgcttgcataacagatgacaagcgataaaatgtctgtgccccantaagcgtcgagacgatgccttcgttgtggcaagctggccagggttaatgggcggcgaattgcccggggaggtttctaaccgcgggtagatcgagcggccggtgttgtattgtgtataaccctcagcgcagaggcccgtgacaaggtcccagcgcagtcgctctattccgttaccacaagacccacaatgtgatgtgtgttccagtaccaaacgacatgctggtagattgtgcgggccgcaacccctncgatgaatatgcgctttgcccctgcgaactaacctcaggaccacgcggttgcctatacgccgcgaagagctaccatgcaggagccctttctcgcntacggacagtcgaccacaatctccgcacacctccaaccaatacatatctacgcagcacggatcggcacacctacagcagacagcatcattttgccgcacgacaccaacatcgcatcgtggggtgctacacacccatcaatcgcctgcgcactcagtgttgaactatttttttagtagacgatattagtaattaagtncngcacgactcgaatgacctgcgcctcctgctacctcgagcgatcgagccagcgacgc

SEQ ID NO: 618797 - DNA, 377 bp, Homo sapiens
tgtaaaccgcattatctaccaagagaattctcttcgattataatcacagcggtatataaccccccctcccaagaagacacatcgatgaacgaactttatttgactctttgcaaactggaatccatttattccggaggctgcattcattgaagctggggattttaacaaggctaatctgaaaacaagactccctaaattttatcagcatatcgattgcgcaaccaggggtggaaaaaccttggatcattgttactctaacttccgcgacgcatataaggccctgccccgcccccctttcggaaaagctgaccacgactccattttgttgatccctgcctacagacagaaactaaaacaagaggctcccacgtcgacgc

SEQ ID NO: 618798 - DNA, 154 bp, Homo sapiens
gtcagaggtagtgattctaactcagttctggatgagtatcaaacccatcgtcttcaaccctccagtgtgtagatcagttcctaacttgtctcactcccaggcctccctatatccagtacattctctcatccttccagaatctgcctccatggat

SEQ ID NO: 618799 - DNA, 261 bp, Homo sapiens
cggcatatgtcagcctagtccagagcggatagactaggtagtagattccatggtatgcattacataaatgttgtccaggaaatgagaacgatgccctaaggcttcttcacactgttctagatagagctagacctggtgcttggagaagagacatctttggaagaatcatctggcacaatgttcaacgcactgggttataccttgtgccacctgcttccaaagataccataggccacgattctcggccttgccatatgccat

SEQ ID NO: 618800 - DNA, 822 bp, Homo sapiens
  misc_feature (419)..(419): n is a, c, g, or t
  misc_feature (482)..(482): n is a, c, g, or t
  misc_feature (488)..(489): n is a, c, g, or t
  misc_feature (495)..(495): n is a, c, g, or t
  misc_feature (505)..(505): n is a, c, g, or t
  misc_feature (511)..(511): n is a, c, g, or t
  misc_feature (514)..(514): n is a, c, g, or t
  misc_feature (517)..(517): n is a, c, g, or t
  misc_feature (520)..(520): n is a, c, g, or t
  misc_feature (533)..(534): n is a, c, g, or t
  misc_feature (539)..(539): n is a, c, g, or t
  misc_feature (547)..(547): n is a, c, g, or t
  misc_feature (555)..(555): n is a, c, g, or t
  misc_feature (565)..(565): n is a, c, g, or t
  misc_feature (641)..(642): n is a, c, g, or t
  misc_feature (645)..(645): n is a, c, g, or t
  misc_feature (649)..(650): n is a, c, g, or t
  misc_feature (662)..(662): n is a, c, g, or t
  misc_feature (664)..(664): n is a, c, g, or t
  misc_feature (670)..(670): n is a, c, g, or t
  misc_feature (682)..(682): n is a, c, g, or t
  misc_feature (689)..(689): n is a, c, g, or t
  misc_feature (694)..(694): n is a, c, g, or t
ggggaaacgcgggcgtaggtgaccggcggctttctcagttttggtggagacgggcgcatgtgggcgctttgctcgctgctgcggtccgcggcggacgcaccatgtcgcagggacgcaccatatcgcaggcacccgcccgccgcgagcggccgcgcaaggacccgctgcggcacctgcgcacgcgagagaagcgcggaccgtcggggtgctccggcggccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttangtggaatgattcttactttaaggaaaccgggcttccaaagtgtgtactttctggacctccacnactggnnaaatanctcgaagcantcaagnatnttnctnggtccattgacanngaatngaactggntgtgcggncccactctgncccagaatacgaggatgaaaccgtgacagattaccagatccccgtacacagtgaacagaggaggggaaagcaccanncanggcnnagtcagacaggncnctcagnaggctcaggccngagcgancttcngactccgagtcgcatgacacatgagccacacactgcacctggtgtcagccctagacgagggtcagggatcatccctggtcgtgatcccgtctgtcagctcacttacgagaggaaactattggtgtcca

SEQ ID NO: 618801 - DNA, 202 bp, Homo sapiens
  misc_feature (147)..(147): n is a, c, g, or t
tcgtgcatctctcagagtggtatgcagtcttcgtgagacctgactgtagacatcacctcgaagtggagcgagtgacaccattgagaatgtcacggcaaagatccaagacaaggaaggcatccctcctgaccagcagaggttgatctnttgccggagaaacagctggaagatggtcgtacccttgtacgtgacatacaacatc

SEQ ID NO: 618802 - DNA, 180 bp, Homo sapiens
ctgatccgcttagtagagaacttgtttctattgtacagcaacaaaaatgtcccaggtgggctgggcgcggtggctcatgcctgtaatcccagcactttgggaggccgaggtgggcagatcacaaggtgaggagttcgagaccagcctgaccaacatggagaaaccccatctctcttaagc

SEQ ID NO: 618803 - DNA, 129 bp, Homo sapiens
  misc_feature (39)..(39): n is a, c, g, or t
  misc_feature (76)..(76): n is a, c, g, or t
  misc_feature (117)..(117): n is a, c, g, or t
tttgaaatttcaagacaactttatccagacaggcgcctnttaaatagaacacagggaagttaggcagcagttactnaaatacagtctcgccaaatgatttacaacagaacacaaacnggagcagggatc

SEQ ID NO: 618804 - DNA, 277 bp, Homo sapiens
ggactcgactctggtaatgacccctgaagttagtgtggcgctccaagcagagtcgagatcagggaaggaaccagatctggcaggatctgctcgggcaagcgtccccgggaccacacacaccttatggagataaggcctctgcggcgtgaggagacagagaactttaggttggactacagttggtaaaaaaaagctaattttattaagacagaactttttttccttccaaatggtaaatctgtctactaatgtaacgcatgtcgttgttaccccttct

SEQ ID NO: 618805 - DNA, 212 bp, Homo sapiens
tcgataggggccacaaatgccagaggataactggcaggctgaggtgagcagattacttgagcccaagagttcaagaccagcctgggctacatggcaaaaccctgtctataccattaaataaagaacaaaaattagctgggcgtggtggcatacacccacagtcccagctactcggaaggctgatgtgggaggatcgcttggcccttatcgag

SEQ ID NO: 618806 - DNA, 874 bp, Homo sapiens
ggacatagagatgagaatctcactctcgagttttattgtggaaatttcgcaattgtccggagctctatgaatgtcgtgccggtgaaggaggaggatgtccttaaggttccgtgccttccccgaaacgctatcatctaggtgtgtgcgcccgaagtcttgtaagtttccggagacttgtgatcaggttactattcattataactacggtatccacagtgtattggaccaatcgtagtttgtcctatacaaagtcatcaatcgcagttagccctggtcgcataaaagcgttcatgcctgagtatatgcttcctgtttgaccaaagtaagatttgtgcgcacttaggaacacaatctctcctcgccattgggattcgctaccaaaggtgggtttgaaataagttcctcgtacccaaagggcgaaatagttactcttttgtgcgcgcctaggaaaagagagtccttagtttgtcattggtacgaccgaataaaaatgtctttggctttgcaccaatcctttgtgcgagggccgctataattactcaaacaatttttgggcctgtaggttctccgggcggtgtccagacatttctctttggggcagaagtcggccatttttacgaagcgctttaaatgttgccgaggtggaaggttcccccccaacggcggcatatatggttccccctcttcattcactcgtaggtagtgataggtgaccgcccacccccgcggaccaattattccgtttttgggaatgggggatggttgttataccttttgggaaagacggcgcgcgccaatagtagtggagccgttggtcaatctcccacactggctgaagagacaccacgttccgttgccagaatctggtgtgcca

SEQ ID NO: 618807 - DNA, 1134 bp, Homo sapiens
tgcagtggctcacacctgtaatcccagcactttgggaggctgaggcaggtggattgcttgaggccaggagttcgagatcagcctgggcaacatggtgaaatcccatctctactaaaaatacaaaaattagccaggtgtgctggggggtgcctgtcatcccagctacttgagaggctgaggcaggagaactgcttgaacccatgaggtggaggctgcagtaagccaagatcacaccactacactctagcctgggtgacagagagggaccctgtctcaaaaataaaaataaaaatacatttaaaaacaaagaaataaagaaattatacacaaagttaaatggaagtatagaggaagaagcaattaattcttcagttaaagggagtcagggcaaggtttcacattggaactgagccttaaggggatgacaagaagaaggtcattctagaagacaaaaagcaaaaaaaggcacttgtactaagaaagccgatgaagccacgtggtgcatacagcctaggtgcacacaagtgcggcggccgacagcaaaagcacgagtaattaacaacgcacgacgagcccaggcaacgacacacacgcaccagttaagaagtactagacttttcaagtgcgtgagacgcacattgccgtgaccatgccaagcgccgcgcgacatgcgtgcaaggcaaacacggggttggtaaacgtactgagattcttaggcgtaatagtacggtggtccaaggcaaagacgacaggcattgttaccctgaacaaggaaggaaacgcagtctggcgacggatacaacgttaagagacgagttcaagcgcccgctaattagattgccaccacagagttcgtggcgaatccaagatcacactaaggtcaaagggtaccccggggcaacagagtgctaggaggaaaacagaacgtcacagagaaagccgtcaagcaccgcacaaacagctgagcacaaagggacaacacaccgaaccgcccaagggacggacgacgaagggcaaagaacagacgaaagaaccgttaccagaagggactcaggcgaaggaagagccaggaagagggaagaacggacagaaggggggaccaggccgcggaaggacgcagcgacaggaggagga

SEQ ID NO: 618808 - DNA, 540 bp, Homo sapiens
cctactgctccacacgttatgtttacgtttgtttcgagacagtttcactctcgttgcccaggctgcagtgcaatggtgcaatcccagctcacggcaaactctgtctcccaggttcacgcaattctcctgcctcagcctccctgagtagctgggattataggtgcacaccatcgtgcccagctcatttttgtgtttttagcagagacggggtttcactgtgttggccaggctggtctcgaactcctgaccttaggtgattcacctgccttggcctcccaaagtgctagcgttataggcgtgagccaacacggtcagccggacaattttttaaatcaataattcatcctttagcaaatatttattgagcatctgctatctaccaggcactgtctagtcacaaatgattgcagtgaacaaaaaaccaaaaactcctctcatggtgtatatattttagtggggacaaacaataaatcagggaaaggaacgtatattgtatgtgacatgatggtaagcattaaggaggaggttatttgatatata

SEQ ID NO: 618809 - DNA, 410 bp, Homo sapiens
ctgccctagcctcctgagtagctgggaccacaggtgtatagcaaccatgcccggctaatttttaaaatgtatagtagagttggggggggggggtctccctgtttggcctaggcgggtcttaaactcctggcctagaagccaccataccacctacagactcccaaagtgctgggattacaggtataagccactagtgcgcggcctcagatgtaaacttccatctattggtctaaagctactcaagatattcagatgtgttgtcatttggccaatacccattttcctggagtcatctgatctgaacctctctaaggtgctggtctccattacctgcatccacattccctttttggctatacttcatcctgaatggtttctccaagaaatccctttagagagttggaagtaac

SEQ ID NO: 618810 - DNA, 704 bp, Homo sapiens
  misc_feature (27)..(27): n is a, c, g, or t
ttgaggcttgtaggtacccctgggtantggatatcgtcgaccaggcgtcgtgaaaatatatggactctctgagattggatgtctgctagcgggattaattgataaagtacactacgtgtatgatatgtttaagagactctactactaagtagagcccaccccgcttctctgagacgaaacctgtgtctttggttggtttgttttaagagatggggtcttgtctgtcacctagggtggagtgcatgtggcacaatcacagctcactgcagccctgaactcctgggctcaagtaatcctcccgcctgagcctcttacgtagctgggattacaggcatgagccactgagccctactttctcttctctctaaagcaatgaggtcttgcttgtgttgcccaggctggactcaaattcctgggctcacagtgatcctcccacttcaccttcctgagccgccggaactacagatgttggtccactgcacctggcagaaacacacgttttgataggggcagaaatgaacaaggagaaacaggtgagttcttaaggtgcagtgcactttagggtactgggtacgccctaggtacgctacaaggttgcatgaacggccctgggccgtttgccagatggtgtagaagccagccaaagcctcaactacttgttccgcacagttccttgacagaacaggccttgttcctaccgacaa

SEQ ID NO: 618811 - DNA, 302 bp, Homo sapiens
ttttttaaaaacccaggttttcccccgggatggggggaacccctgatcaggttttttgggccggtccccgggtttcccaagggccttcatccggggcggggttcaaatgggtttagggggcccctattttcagggaggtggggggacccccccggtggggaaatttaaaaatggtcgggcctatcggtttcccaaaatccccccttcccctttgattttccctttagggggggggccccttggttggcccttttgttgaaatgaaaaaaaaaaaattttggccttgttttaaacccccccca

SEQ ID NO: 618812 - DNA, 598 bp, Homo sapiens
gagcggctggcggtgctttctagacgattcacaattgtgtcattaggtcccccactgggagtgcagagtaaccaagatgacctggtcgtgcgaggtgtggtggccggcaaccgaggttccagtccgtcccaacccagcggttactcatgcatgcatgaggactgactatgagggatgacgagtgtagagatagtagctttgctggcataccatcccaataactcttgtgccattatgatatttgaggaggagatacgggaatcgatgggaataggtcgacaggggcgcatgagagctgagtctgcgtgtctagaatgagcgcgaagttgtttccgggtgcgtaagtcggaggcagccgagtaactgcctaatgcaaagcggtcgtctgaggggtgtaatcacacgtcgtgctaatagggacgatctcccattcgcacaagggagccgtcatcgaagttcccttgcatggttccaacgtcggatgactagtaaggctagtggggacggacactggcgtacgctcacgggactgctgtgcaagatgtctccgaagcatggacgtcgggtccagggcccccttccaactcgcatggcacac

SEQ ID NO: 618813 - DNA, 185 bp, Homo sapiens
  misc_feature (111)..(112): n is a, c, g, or t
ctctagaggatccgactgcatctgtgctcatggctaaaacaaatttttaaagaagaaaaaaattgcaaaaatatattacaaatgttcaccatccattattattcagagaannttacaattaaacataaggagctgggcatagtggttcatgctggtaatcccagcactttcagaaaccaaggtgg

SEQ ID NO: 618814 - DNA, 566 bp, Homo sapiens
agacccgatgagtctgcagagatgcacccatgctatctattgatggcggtatcttcatgtgagtgcttctacagctctaaccgacgaactttatcagcgtaatagtcctccccttaaaatgtcgtatctgtattgaccttagaaaagtacattcttccaatctggcatatgcacaaagcaatgtccatatcagtacatacgttaaatggtcgagattatgttagcagataaggctgtaagattgtgagtcctaaccactcgaatgaaagacctgcttacatttaattatcagtggagctgccggtcagcatgtcaggctgtttgtgtgtatggctaacgtctaactacatatatgggctgcagggaaaagacaattctagccacttggccctctcatgtaaaaagacaactgatcaggcatatggatagctttctggcataggattatcaaactttcatctgtaaatgacgaactatcaaaacgagtagcaataccaacaccaacaaccccaggatgggataccttctctaggtctacaagtacctgtagagatcaaatgcaaacc

SEQ ID NO: 618815 - DNA, 456 bp, Homo sapiens
cagtggttgatcctgttgtacaggaggcccatggggatgttccagccagccgttctgtccaccgctgtgtggcaggacttcttgccttccaggttgttccagtttatgtcaggatttgacttcttcaccactgccacagaaagatacccttcctccggtgctttcttgcaatcagtgctttcatagttctctgccaggacaggcaccagaccacactggcccgctatgtagacatatcctccgtccaagctcatggcgtcagcttctccattcatgatcttggcaatgcagtcttctggggtctctgccgattcacactctattaaccctccactggtaacgctccactcatcacacttgagcctctcgtggtggctcagagcgcaccacttcaccgccttgcactcatcctgtaaggggtctgggcatatgccttcccgtaggttacgaacggcg

SEQ ID NO: 618816 - DNA, 256 bp, Homo sapiens
  misc_feature (103)..(103): n is a, c, g, or t
  misc_feature (105)..(107): n is a, c, g, or t
ggtgaatgactgagaatgtactgaacgttatggtagggaggtgtggatatcctgcatcctgctagtacaggacaggaccacatcagaaagaattagcctgccngnnngggtgcagtgactcacgcctgtaatcccagcactctaggaggccgaggcgggcggattgttcgaggccaggagttcaagaccagcctggtcaccacagtgagaactcatcctttatatatatatatatacagtgcaccacgacacagtg

SEQ ID NO: 618817 - DNA, 438 bp, Homo sapiens
gcggaggtttcaacaagaggaaaacagatataagttctggataggggagaaacccctagtgcgctgttttcccagcaacaaaagatgccacggcggcttgaggcaaggagtacacgaccagcctagccaaagtggtgatacgccatctctcctaaaactacaacagatgagccaagtgtggtgaaacacacctgtaatacccagatacctggaaatctgaggcacaagaatagcttgaaccgagagagcggaggttgcagtgagccgagatcataccactgcactccagcctgggtgacagagtaagactattttcaaaaaagaggccaggcacagtggctcatatctagtaatcccagtactttgagaggacaagatgggcagatcacttgaggtcaggagtttgagaccagcctgagcaacatgatgaaaccctgt

SEQ ID NO: 618818 - DNA, 239 bp, Homo sapiens
  misc_feature (66)..(66): n is a, c, g, or t
  misc_feature (71)..(71): n is a, c, g, or t
  misc_feature (105)..(105): n is a, c, g, or t
  misc_feature (216)..(216): n is a, c, g, or t
  misc_feature (239)..(239): n is a, c, g, or t
ccgccgcatcgctatttatttgcacataagaagggaacattttaaagaacgcaaaaagtcatatanttttncttagcatcggtgttcattttaaagaaaaacatntgtccactgggttgacaacaaggtaaaagcccatggtaattgcattttaaaacaaagaggggaaccttggagtaaatttaacttggctcctttaaactgataacgtcatantgtagagaggggggtgctaaatn

SEQ ID NO: 618819 - DNA, 224 bp, Homo sapiens
ctcatgacacctgtcaacatctcatcgctccttccaacatctcatacccccttccaacatctcatcactccttccaacaacacatcactccttccaacatctcattgccttccaacatctcatagccccttccaacatctcatcgcgccatcattggtatatggttagtgtgtaggttactcgggggtatgagatgttggaaggggctatgagatgttggaagg

SEQ ID NO: 618820 - DNA, 379 bp, Homo sapiens
tccagttgtcggtgggtggaggaagacgaccacccacttcctagctagctcgtcgaacgtactaactacgtccctgctggttgctggctggtaactcgtctacctctgctcgaccccctcgctgctgcagcagcagccgcagtagagtagtagtagtagtcctcgtactgtcgtctcgactcccctgctctctcacgcgctactcgtctagtagtagagagagagagaatactactctctctgtatagtatagtgtcgacgcccactgactcgtgagagagctagagacctctctttatcataaataatatatctcatcagatctggcgcgcagacaagaccgcacatacaaatagaacagcagagaaaatacacacag

SEQ ID NO: 618821 - DNA, 859 bp, Homo sapiens
  misc_feature (18)..(18): n is a, c, g, or t
  misc_feature (69)..(69): n is a, c, g, or t
  misc_feature (82)..(82): n is a, c, g, or t
  misc_feature (128)..(128): n is a, c, g, or t
  misc_feature (279)..(279): n is a, c, g, or t
  misc_feature (300)..(300): n is a, c, g, or t
  misc_feature (361)..(361): n is a, c, g, or t
  misc_feature (506)..(506): n is a, c, g, or t
  misc_feature (541)..(541): n is a, c, g, or t
  misc_feature (727)..(727): n is a, c, g, or t
  misc_feature (841)..(841): n is a, c, g, or t
ccggccggagcggaggcncgcgagcgcgagcagcaggagcagcccgcaccggacaacgggcgagcacanggggcgggcggangcggcggggggagggcagcgcacaggcccgggggccccgcgcgagncacgcgcgggagcaggcaggcgccgcgggcgacgccgcgcgggagcaggcagagcgccgcgggcgacgccgcgggggaccgcggcggaggaggcggcaggcggcggccccgcggcagcaaggggggggggcgggagccggcgcgaccccangcccgggggcggggcggaaanccgcgggggggacgcccgagggccagcccgggccacagggaggcagcggcgggcggaggancccggccaggagaggggccggcgggggggcggggggcacgggaggcccgggcagcggcccggggacgagcggcgggcagcggaggcccgaggccacccagcgccacggagcccggagggagcgcgccgagccgggcgggccccangggccggccgacagggaggggccaagagagacaangcgccgcccgccaaacgcggggcccaagggggcgggggagggagcccgggaagaagaccggagggacgcacggaggaaaggagagggggcgcgacgagcgccgggagagagcgggcccaagaggcgcggaggagcggccgggcacccacgccacacgccgccaacaggacagccaggggagaggcncggcccagaccgagggacacacaggcacggcgggcggcaacacaagcaagggaccggcggaggcgagacgaccacagggaacggccgcggcggaaccaggagcagggggaggancgggggcgcgggggcgca

SEQ ID NO: 618822 - DNA, 405 bp, Homo sapiens
cagacaactcagggcggaagtgccatgagctatagacactgcctgttctcacataccgttccgagagctggacccagcaggctgcccacatgtgaatgccttcaacaggtaacgtgagctaaggatctacagatgtggtcatctccagatacttgcatcgagatggtgaaggtaaagcggtacatatagcactgaggatcccatggaagcattagaccctggttgataccatcgtcctccacatgacctgcacacagtggaaacctagggaatgtagccaacagatgagtgtgagcaattggcacaggacctggacaggctgtgcatggcacctacagtatcagaatggcactgacactcatagggactgacagcgcagagtgattaccgtgaccgagcctgagg

SEQ ID NO: 618823 - DNA, 123 bp, Homo sapiens
agcagacgaaaggaaaagtgaaactggcagctgtggatgctacagtcaatcagggttcttgcctcccgatacgggtttagaggttttcctacaatcaagatatttcagaaaggcgagtttcct

SEQ ID NO: 618824 - DNA, 272 bp, Homo sapiens
agctgatgtgctagttctgaacacatagacatgtgtccccgactcccgcgtgtaccgatcgccccaggcttcacactgtgtgtctctacgtcaggtccaatctgcacttacagagctctacggtacaggaacgagactctccggggctcgccaggacctaaccgtgctggcacatcggctgcatatgggatgctctctacttcctgtgcacgattctcactggtacaggctggcatagtccgtatctcggccctctatagcatggcgatgct

SEQ ID NO: 618825 - DNA, 392 bp, Homo sapiens
tgtccagtaagcaccaagtgctagtctttaccgggaacattcaaacaccaactggtgctcagcaaacacgaagccccacactaaggcctgggaatacagagatcgtattactgcctcaggcctgaaaagggttctaagattttagaattccaaaggtatcctcacattcacaagctgtgcaatttggggatgggggactgggacggacattcagtgccacctgtgtctcctggcacctctacaactctagattgggcatctctaatgtctttagactttcctccaatggaaaaaaaatggagacaatacaccttaattccacaagttctttggaatgagtatggcatacaagacacatttgagaaagcgtctaggacagactcaccccaaca

SEQ ID NO: 618826 - DNA, 467 bp, Homo sapiens
  misc_feature (132)..(132): n is a, c, g, or t
tacctaaatggctgtgctgtcatcaaggaatattgtcgaacacaagctgtattgttgactgaaacgcacagcagatacctgaaggggaagggaactgtaagtcaaacttatcaaagtgtattattttctcanttaaaatgtcaaatgacaaagcactaagatatgtcttacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttcaaaataatgggaaaagtcgttcccgggcgcggtggctcacacctgtaatcctagcactttgggaggtggaggcgggcagatcacgaggtcaagagatcgagaccatcctggctaacatggtgaaaccccgtctct

SEQ ID NO: 618827 - DNA, 244 bp, Homo sapiens
cacgaggatgtcgctcccctcacggcgtagccggcgcgttctcgtgcccggttggctcgccgcggccggtatagcactgtcccggtcggccgttcgacgacgacaggagggagaaatgccgctggttcgcttcgagacacgcgaaagcgtcgcgatcgtcaccatcgaccgcccggacgtgcgcaacgccgtcgacggtccgaccgccgccgagctcgccgccgcgtttcgccgcttcgaggac

SEQ ID NO: 618828 - DNA, 966 bp, Homo sapiens
cgctgctcaagttaattttcgcccatgctcagtacgtgctgttttgtctgccgcattatctgttttgtggttccgctgtgccgtgctgcgttgtttggccgcgggaccatttgtggcccccccgcgtgcggttgtgccccgcctgtcggaggggggcttgaccgttttgttgccctccgcgaccgggttgtcttttgctcacaaccgccctttcgtggcctgttggccgcaaccgtagaccatgtacgcattgggctgcgtgttcaccgctgaacgttctatgcataggcgccacaaccctacgccgtcttgcttaggccccttcgacggggggattttctcattgatgtgcccgtccgaatcttcttgtttcgcccgggagttttagaccgttctaccaaggcgcggtgttcgccttcctcgccctgtgtgtgggccgctatggcccgccacaatgggtcgctccgctcggtatcccccgtcagtgctccctcatccggcggacccacccgctttgacctccctccggcatggggatctcaagaccccgccgcgccccccaaggattgtcagtagcaccctctccgcggtcccgcccatgatgtatcagcccccgtgggaacgccctaattgcctcggtggtttgctatgtgcggcgccgtcctaacctgccgcatgattaggttgtccccgctcctccatattttcggggcagtacttacggcctcagagacttattgggtgagcacggagtagtcctccactggcttttcacatccattatttggtgccccaccattctactccatttatggttgtctcctccccgcccaagtagtgttcctcatgtcacactccccaagtcactacgcagcgggtgcggtaacacgcccctgcgacacgttggctttttaaaggggtaattttggtaaatgccccatttaagtaggggtcccaacaaaacaa

SEQ ID NO: 618829 - DNA, 934 bp, Homo sapiens
atggcggacagcaggaaaggcctcgctctgggaccaaagtttgggacgcggacgggggggcttgatctcggcgtcgatatgggcctctgtgccctcccgggctcaaaggcacgttgtctcttttgccatcgatgctttagcgtccagcatggctggagaacttggggggtgcctctgcctccaatatatctctgggctttaagttttggagagtttgacatccagaagagagtgggtgatgaacccgcctgttttgctgggcagacgcggggcgtcatgctcaagtgtcactggaccatcaattggagtcgtggccttgactggggcgctacgcaaaatagggcgtaggatacctaggcgaagggtctcaagaagatgttccagggaatcactcaaggtcctgacaaaatcgagtcttcacattggtccagagagatatcgagtattcgggactatcttggtaaaggatttagaccagcggagctagttcaggggattgagcgcaggagggatagcccgaagaggttaaatcctaaatttacggcatggagggacaagcccttatatcaaggaggcagttgcacgattgaggggctcctgtttcttcacagggaaaggccaggcatgattggcgggggggaggcgtgcccacagtataccttagcatattacacgtgcttactaaccatcctgtgaatttgttccccgacgcgccgaaaagaagatgaggatggtgagggggtttggtgacactaaggtgcggaaatgaatttgccccatcgtcggaataaccattttttctacgcatgacatgggtccccggagacgtcctgtcaccttcattaattgaacccctgaaaaattacatgcctaggggtggacgggacaaacacgccctgagaggtttaaacaaggaaaggaggcctgctgcaac

SEQ ID NO: 618830 - DNA, 681 bp, Homo sapiens
gtagcggcctatgtcgaccaggcgtcgggtccgcatgggcccgaaccgactttctgctactctcgggggccctggccctgatccagacctgggacgggctcccactccatgaggtatttctacacctccatgtgccggcccggccgcggggagccccgtcttcatcgccgtgggctacgtggacgacatcgcagttcgtgcggttcgacagcgtacgcctgcgatgccagaggatggatgcctgcgggacgccgctggctagagcaggaggggccggacgtattgggaccggaacacacggaatgtgaaggcccagtcacagactgaccgagtggacctggggaccctgcgcggctacatacaaccagagcgaggccggttctcacaccatccagaggatgtatggctgcgacgtggggccggacgggcgcttctccgcgggtaccaccagtacgcctacgacggcaaggattacatcgccctgaaacgaggacctgcgctcttggaccgcggcggacatggcaagctcagaccaccaatgcaccaagtgggaggcggcccatgtggcggacgcagtggagagccctaactggagggcacgtgcgtggagtggctccgaggatacctggagaacgggaaggagacgctgcagggcacggacgcccccaaacgcactatgac

SEQ ID NO: 618831 - DNA, 1119 bp, Homo sapiens
ggcctgagtcacgtgtcagggggaagctggaaggcgtcgttctcctttcccagctctcctgcctgtcctgtcatgttttcaggccgggtctggcttgtgtcttcccccgtcaaggaaatggcctggtggagctccagtgggacccagtgcgcctgtcgcttctgtgcggagcctgggctgaccagcacaggacagcggtggtcaaaccctgaacaattctgcgctgaggtcagggaggcccatggcagtccggcagtcaactgtgctctccgtgggtgaatgtcgtgctggtgatggcctacgggagcctggtgttttgtactgctatttatttttgtgaagaggcaaatcatgcgcttgtgcaatgaaatctcgaaggggacctcatgtccctgtgggacacaatgcccccaaggacttgaacagaggcagatcgatattcgactctccagaggtttaggatatcaagtatgagccccagttccttgcagatgattgatgctagaactactacaactggaaacccagggaaatcaaaagttgctacaactatctcgtataggatcgacaagctcttggatgccattcgtacctctgagatcccatttcacttcttgcagggctggattcccggttcttctaatgggcacagaatttgcggtactacctgctggatctgagaaacaactagtacgccctttcacggggtgtacgcaaagcactcattgattacccgttttggatggcttctgaacgcgagccgtactgggaccaggggcctttgggcaccactgagtacctaccgtatcacgaggcctcgagtgattgtccatctggtagttgacgcggaccaccgcaccagggaccgcccacgaaggctcggcacgctcaccagggagcaggagcttcatacggcttaaccaagccagaacccccaacgagtcgggctctgcaatatgacgaactacaatagcagcggggcgcagcggggggccaccacaccaggcgagcggcagcacaacaggcgacaacgccaacgtaaacagacgaaatagggggtgcatgaggggaacatggtcgcgagccctcgagcagaaatgacaggcgcaggaacacgga

SEQ ID NO: 618832 - DNA, 299 bp, Homo sapiens
gggtctctctgctggttactctagcggctcccctccagttccggttgggatgttgggacgacgcggacggtccctggtgctggctgcagacgcgggcttaggctgcgcagagcggcgttcagggctgtggtgtggccagggtgggcggacaaagacctacaagttggggtggggcgcaggtggcaagctctgctggtcgcatcgtgggccgcagtggcctcaattccaaggactgtgacaagacccggtggggatcctcgcctgctcaggaggggttgagacaggcggctggtgttctc

SEQ ID NO: 618833 - DNA, 102 bp, Homo sapiens
ctgagcgaaaccaacactcacacagagggaggatcaagctctgctaatggtagaaaatatttgcgaaccatacatctgacaatggtttaatatccaaaatat

SEQ ID NO: 618834 - DNA, 123 bp, Homo sapiens
gcggccgcctactactactactactgctcgaattcaagcttctaacgatgtacggggacatgcagctatttcaaagtgtgttggattaattaggatcatccctttggttaataaataaatgtg

SEQ ID NO: 618835 - DNA, 461 bp, Homo sapiens
cacgagtgagtatagtagtagtagagagtagagagagagagagagagagagagtagtgcgagatagtgagtgcccatagccatgtgcagcctctgttccctgctcttgctgctgaccccctgccttcctttcagcccttgccctgtgccaacgctgcccgccctcatccttctgcacttccgccttccatctcctctccgttctttgctatgtctcttctccctgtccatcgctttcccctctgttcctgtctctcccctttctatcacttgtcttaccgcttctcttctcctcttcctgttacgcctccgcttctcgcgcctctgtatcattttctccctctcctcccttcccctcccgttctcttttcccatcctctcttcttctcttccctttcctccactctccgtctcactctcttcctccctcttcctctcgccccttctctctgctttccctcc

SEQ ID NO: 618836 - DNA, 340 bp, Homo sapiens
agttgaggtgtaaaactaggcttcgaggaggttagttagtggcaataaacatattgaggattttaatataagagatcaggcttcgtcctttaatgtcgtgtcttgttatcatctgtcttgaggttagtttgattagtcattgttgggtggtgacttagtcggttgttgatgagatatttggaggtggggatcaatagagggggaaatagaatgatcagtactgcggcgggtaggcatagtattgtggtgtgacggtgcgttggcccaacacggtgcgttggcccaacacggtgcgttggcccagcacggtgcgttggcccaacacggtgcgttggcccaa

SEQ ID NO: 618837 - DNA, 728 bp, Homo sapiens
ttcttgtgagttaacctctggtgacatttggctgagtgttcgagtttcggcaacgcctgtcttgggaaatgtgatagggggcttattgagcagactgcaactggaaatgaggaatgttgacttgaagtctgtaattcactctataccctttctctccaatcctagactgagtcactcaatgtgagataagtactgcacagtgcatatgcaatggatttcacgttagtacagtggagctgggtaagagcagagacatttagaggcaatggcaggaaatccaggtgcaaatcccaccctataagtctttagttttcccactttgtaaagctgaagatccagacacttttgtgcattaggttgcggttggagaattgaattagctaaatgcttagtactaatcccaaggcactggaacatacttatgtgctcaataagtgacacatatgattcactatatatgtaacagtatctaatgttaaaaacataataggccgggcgtggtggcttacgcactgtaatcccagcactttgggagaccgaggcgggtggatcacaaaatcatggagcttgtagaccaacggtggccaacatgtatgaaaccccgtctctactaaacatacaataattagctggacatggtggcgggtgcctgtaatcccagctgtctcgggagtctgcggcaggagaatcgctgggcccgggattaaatcgtgggtgaccgagagttt

SEQ ID NO: 618838 - DNA, 298 bp, Homo sapiens
acgctattgtgtacatcatctggctcccagtgttaccaattctgatgacctttattcatccttactccatgctctcccctaccaccggatgtactgagcagcagagaatgggacctgggaggggtcctattccaggtcaaaggttagagattactcctgttcaacggggaactactctgggtctattgagagggctagtttcggtagatgaggtactactccaggtcaatggggaaccactctggatcaagggaagactattccaggtcgtgcaaggggagctattccaggtgaagaa

SEQ ID NO: 618839 - DNA, 205 bp, Homo sapiens
atctagaggatcctagatgattgtccaccggtccataaagatattttaaaaaattagccaggtgtagtccgggcacggtggctcacgcgtgtaatcccagcacttgggaggctgaggtgggcggatcacctgaggtcaggagttcaagaccagcctggccttcatggcgaaacgctgtctctactaaaaatacaaaaattagcca

SEQ ID NO: 618840 - DNA, 145 bp, Homo sapiens
accagaggatccccagtctccactccaccttcccattccttcactggagctcccagaccttcccactcatctttgaatgtgtatctgctgactggcaatgcatcaaaatcttttttttttttttttttttttttttttttttttt

SEQ ID NO: 618841 - DNA, 146 bp, Homo sapiens
agtagagacagtcttgttgtgttgcccaggctggtcttgaactactggcctcaagtgatcctcccactttgtttttccaaagtgctgggcttacaggcatgagccatcttgccttggtttagtatatttataaacttgtgcagcca

SEQ ID NO: 618842 - DNA, 148 bp, Homo sapiens
gtatacgaagggggctagcgttgctcgtgattactgagcgtaagggcgcgtaggcagacagttaagttgggggtgaaagcccgggctcaagctcggaaatgccttcaatactggctgtcttgagtacgggaggggtgttaacggaggc

SEQ ID NO: 618843 - DNA, 125 bp, Homo sapiens
gtgaacctgggtgcgttatacctctctccaagctgagagcagcacacagagcggactggaggactgcagcttcggtgttgggggacgtccctccggagagttagtttcatgtaccagccgcgggg

SEQ ID NO: 618844 - DNA, 336 bp, Homo sapiens
attcggcaccaagaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagct

SEQ ID NO: 618845 - DNA, 330 bp, Homo sapiens
tctggttgggagaatagagaagagtgatcaagggctaggaatgacgctattactagtgaagaaaacaggcagctgtcaggatgggcgccatggctcatgtctgtaatcccagcagtttgggaggccaaggagggtgatcacttgaggccaggaattcacgaccagcctggccaacatggcgaaaccccatctccactaaaaatacaataaaattagctgggcatggtggcacatacctgcaatcccagctatttgggaggctgaggcctgagaatcgtctgaacctaggaggtggggattgcagtgagcagagatcacgccactgcactc

SEQ ID NO: 618846 - DNA, 377 bp, Homo sapiens
aatatatagcatacttacctgaatgagccactagaagcagtagtcagcagtacatgcagaatctgaactgcaagttcagaaaaaggtgtttcgcaaggtagcaattctagttaagatctcaacagtgctgttgggaggcggatttatcaagcacatcatgtgagcagtctgaccctggactgttcccaaaggtcagagccataaaacgcagccagaatttcattcaatttcacaaatgcagcaactgggcatgtctgctttccttgtaacaggggcaactgcaaagtcttcttcaagaagattaataatcaaagtcaaaaattcagaggtcatcatgtaaaccactttctcctttttaaaagctaagcttttccaat

SEQ ID NO: 618847 - DNA, 367 bp, Homo sapiens
ggatggtgacttattataacattccattgcattaatatatcccatttgtctgttgatgaacgttggtagctttcactcttgggttattatgaatagggcacattttgtgtcttgctggctgtatgcctttatttctgtttggtatattaccaaggtatggagttgctgggacttagggtagccagctttagcagagactgccaagtagttttccagagattgttccactgtacattctgagtagtgtatgatttccagttactctgcttcctggtcggcacttggtattttctgtttaaccattctggtgggcatatagtatctagttgtggttttaatttatatttcccttataactgataatgca

SEQ ID NO: 618848 - DNA, 154 bp, Homo sapiens
  misc_feature (6)..(6): n is a, c, g, or t
  misc_feature (42)..(42): n is a, c, g, or t
  misc_feature (57)..(57): n is a, c, g, or t
  misc_feature (119)..(119): n is a, c, g, or t
  misc_feature (140)..(140): n is a, c, g, or t
tccttnccatcctaaaaagcagctgggacaacattcagggcnttcatcgaagaagtnccttcaaaactttcagctccttgctgcaaggaaaaaaaggttcctccgggacttataatgcnctctttccccgggggccgaanaacattaaactttg

SEQ ID NO: 618849 - DNA, 929 bp, Homo sapiens
ggcagggtcttctccatatccccagtccaaagacagaccttagattttcgaggacttcctggtatctcctcagtgtgttcagtagacaacacgcctacgccatgcactatcgaagtcccattcatgccgttccgcatctttgactgtgatgatgacggaaccttgaacagagaatatctgagccggctggtgaatctgcctcacgggagtagggcgaggacactcggcttattgcgtctgagatgaagcagctcatcgacgaactctcctggagagtagttctgacgattgacagggtatggaaccatcgaatctcatctgagttccagcgacgtcgatcgtcccgttctccagactttgccatctcctttaatattgtcctgtgacagcagccccagcgtgtgtcctggcaccctgtccaaagaacctttctactgctgagtctgtggcgcaaggtcacagcctgtgttgccagtgcgggccaagctggcccagcctggagctggcgctgtgcaggctcaccccgggcaggggcggccctcgttgtcagggcctctcctcactgctgttgtcattgctccgtttgtgtttgtactaatcagtaataaaggtttagaagtttgaccctatgtgtgacatgagatacactggtatgacgaaggactggacttctcttctaagagccttcaatcatcctgagaataagcagcatatcgagcagatgcagcgggaccgtcaaagcgcaccacgcctggtgtcccgtggaggtggaggttagggccgccgcggttggcccgcccgatccgaaagggggggtataatctgctggtcaccattctaacccactgcagcttccgctgcacacaaaaaaaaaccgctttcggcgcaaaaaaggccctgtccccttaagacgccatatagctccaaag

SEQ ID NO: 618850 - DNA, 258 bp, Homo sapiens
gctaaatcatgttagacacaactgtgcataaggttcaaaacactctagagcagtttttttaaggatatggttttatactgattgcttttcattgctaagaaaggtggttattaatagacgatataccctctttactgcctgctgctatgttcacatgctatagctggataataaaacctacaaagcaggctcgtaactaaaacttaacagtaagccttactagctaaacagtgtgaaggtcaaattagatcactcact

SEQ ID NO: 618851 - DNA, 203 bp, Homo sapiens
ttaacgcttagtccgcgccttctaccgcatgcgcacagcaggccatcagcactgagccatcaaccaacgctgcacggtttgccagacgggcttgcggatgaaaaaccctgcgatcgagcccgccatgagggcaatcaacgcgttgacgctcacactgatcatgatctgcgtaaagccgagcaccaaggactgcgacagcccac

SEQ ID NO: 618852 - DNA, 392 bp, Homo sapiens
  misc_feature (16)..(16): n is a, c, g, or t
  misc_feature (20)..(20): n is a, c, g, or t
  misc_feature (55)..(55): n is a, c, g, or t
  misc_feature (59)..(59): n is a, c, g, or t
  misc_feature (177)..(177): n is a, c, g, or t
  misc_feature (179)..(179): n is a, c, g, or t
  misc_feature (188)..(188): n is a, c, g, or t
  misc_feature (216)..(216): n is a, c, g, or t
  misc_feature (244)..(244): n is a, c, g, or t
  misc_feature (254)..(254): n is a, c, g, or t
agacaggttgtctccnaacnactgccctgagaaatgtccttcagattggcctccnactnctggaacaccagaagaggacttctggattcaggatagagagaggagatggagccaataggaggcgatgcacttctatcaggcccatcccagtgctgagagagcactccagttgacagntnccttcaggnctggtgaacccatggcctgaagatatgncagcttctcaagggtcgtcagcaggtgncagcactggnctgcccatagtctgctgctccagggagagaatctgtggcttcgaaatctatggatttgaattgagacaatggtggccctgatttttgaggccatgactcaggaaagggatgggattctgtggcctcggctgctcgtgc

SEQ ID NO: 618853 - DNA, 502 bp, Homo sapiens
agggaaatacaacatatatattagctggataatgatttacatttacatttttgcacctttatgaaatttgataaacttctagaacgcttgtttttaaatgtttaacaatgtaaaagttgttcagcaattttttttaactcctagcattacagaagttaatttctacaaaactggttttctgggctcacaggtaaatgtaaccagaaaaagccctaaacaaattgatggaatatagatggatcaatttcttagtacagtcatgtaccacataatgacattttggtccacaggagattgcatatgtgatagtggtcccataagattataatggagtttaaaagttcctattgcttagtgatgttatagccatcctaacactgtagtacgacacattgctcacgtgtttgtggtgatgctggtgtaaacaaacctactgcactgtcagttgtataatggtatagcacctatattgttattttatagtgtactcctcctatttact

SEQ ID NO: 618854 - DNA, 122 bp, Homo sapiens
  misc_feature (74)..(74): n is a, c, g, or t
gatcttgacctcacggtgtaagaagggagaggatggtttctcttctgccctctcccatggtgcccgtgcctctntgctgtgtatgtgaaccacccacgtgagggaataaacctggcactagg

SEQ ID NO: 618855 - DNA, 349 bp, Homo sapiens
acaggagacaacagctttatacatttctggaggaactatttctttctttgctgtcttaagctctaatgaatatctgtctgagcattctatcgactaaaatattatgaaggatgaaactgaagcatatcatgacccaataataaccgttgcccctactgaagatcttaaactactgcataatcctgaaccatgtgccttcacaactattaaacaagaaataactaatatttattacagtatgagtaggaattacagcttacagcttagattctgatctttgcactgattagctcttgattaattcaaaaaaatagctagcacttattaaacatttactacacgctaggca

SEQ ID NO: 618856 - DNA, 117 bp, Homo sapiens
ttagtgctctctgattgcgagtatacggatgtgtctagcgcagtgggacgttctaggtggatttagcgtgggtgatgcctgttggagtgggcagttggcctcctaattggggggttg

SEQ ID NO: 618857 - DNA, 806 bp, Homo sapiens
  misc_feature (23)..(23): n is a, c, g, or t
  misc_feature (29)..(29): n is a, c, g, or t
  misc_feature (32)..(32): n is a, c, g, or t
  misc_feature (51)..(51): n is a, c, g, or t
  misc_feature (58)..(58): n is a, c, g, or t
  misc_feature (66)..(67): n is a, c, g, or t
  misc_feature (77)..(77): n is a, c, g, or t
  misc_feature (82)..(82): n is a, c, g, or t
  misc_feature (87)..(89): n is a, c, g, or t
  misc_feature (102)..(102): n is a, c, g, or t
  misc_feature (106)..(106): n is a, c, g, or t
  misc_feature (108)..(108): n is a, c, g, or t
  misc_feature (118)..(118): n is a, c, g, or t
  misc_feature (129)..(129): n is a, c, g, or t
  misc_feature (144)..(144): n is a, c, g, or t
  misc_feature (146)..(146): n is a, c, g, or t
  misc_feature (150)..(151): n is a, c, g, or t
  misc_feature (154)..(154): n is a, c, g, or t
  misc_feature (156)..(156): n is a, c, g, or t
  misc_feature (159)..(159): n is a, c, g, or t
  misc_feature (164)..(164): n is a, c, g, or t
  misc_feature (167)..(167): n is a, c, g, or t
  misc_feature (171)..(171): n is a, c, g, or t
  misc_feature (176)..(176): n is a, c, g, or t
  misc_feature (181)..(181): n is a, c, g, or t
  misc_feature (188)..(188): n is a, c, g, or t
  misc_feature (193)..(194): n is a, c, g, or t
  misc_feature (198)..(198): n is a, c, g, or t
  misc_feature (217)..(218): n is a, c, g, or t
  misc_feature (223)..(224): n is a, c, g, or t
  misc_feature (227)..(227): n is a, c, g, or t
  misc_feature (230)..(230): n is a, c, g, or t
  misc_feature (256)..(256): n is a, c, g, or t
  misc_feature (271)..(271): n is a, c, g, or t
  misc_feature (287)..(287): n is a, c, g, or t
  misc_feature (297)..(298): n is a, c, g, or t
  misc_feature (301)..(301): n is a, c, g, or t
  misc_feature (305)..(305): n is a, c, g, or t
  misc_feature (312)..(313): n is a, c, g, or t
  misc_feature (315)..(315): n is a, c, g, or t
  misc_feature (321)..(321): n is a, c, g, or t
  misc_feature (326)..(326): n is a, c, g, or t
  misc_feature (336)..(336): n is a, c, g, or t
  misc_feature (355)..(355): n is a, c, g, or t
  misc_feature (363)..(363): n is a, c, g, or t
  misc_feature (370)..(371): n is a, c, g, or t
  misc_feature (378)..(378): n is a, c, g, or t
  misc_feature (384)..(384): n is a, c, g, or t
  misc_feature (388)..(388): n is a, c, g, or t
  misc_feature (404)..(404): n is a, c, g, or t
  misc_feature (416)..(416): n is a, c, g, or t
  misc_feature (419)..(419): n is a, c, g, or t
  misc_feature (434)..(435): n is a, c, g, or t
  misc_feature (448)..(448): n is a, c, g, or t
  misc_feature (463)..(463): n is a, c, g, or t
  misc_feature (490)..(490): n is a, c, g, or t
  misc_feature (494)..(494): n is a, c, g, or t
  misc_feature (503)..(503): n is a, c, g, or t
  misc_feature (540)..(540): n is a, c, g, or t
  misc_feature (709)..(709): n is a, c, g, or t
  misc_feature (786)..(786): n is a, c, g, or t
gactgggccgccgaatacccctnaggacngcnctagaaacgggcaggaagngggggcncgcagctnnggggcaaccnaagcngggannngggaacagccgcnatcncngccgccgcancactgggaacncgcggggaaggagcngnaagnntancngtngggcnacnaacnccaanaagtncaaaatncaaannaaanaaagaaccccaaagaaccnnaaaannaanaanaataaaaaaaaagaaaaagaaaaaanacaacaaaaaggcantggggaaaaaaaaaanaaaaaaaaannaanaagncataaanncnaaaacnctaantttaaaccanaaaacccaaaatttaaacnccaaaacnccaaaannaaacctnaaaacncggngtttgacatcccgaanccctgggcttanacncccaaacactaaatnnacacccaaaaacnctgaatcaaattctnaaaaccctgagtttgaataccagaacnctangtataaacnccaaaacactgcctataaacctcggagccccgggtangaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggtntcaccccctggactccttcactcaggggtttggggagcagcccacaggggacctgcccatagggccacctttttganatgcccacaggggccctgct

SEQ ID NO: 618858 - DNA, 869 bp, Homo sapiens
  misc_feature (277)..(277): n is a, c, g, or t
cataatccatcacataaacagaaccaatgacaaaaaccacatgattgattatctcaagagatgcagaaaaggcctttgataaaattcaacaccccttcatgctaaaagctctcaataaactaggtgttgatggaacatatctcaaaataataagggctatttatggcaaacccacagctaatatcatatagaatgggcaaaaactggaagcattctctttgaaaaccggcacaagacaaggatgccctctctcaccactcctattcaacatagtatnggacgttctggccaggcaatcaggcaagagaaagaaagaaagagtattcaaataggaagagaggaagtcaaatggtccctgtttgcagatgacatgatggtatatttagaaaaccccatcgtctcagcccaaaatctccttaagctgataagcaacttcagcaaagtctcaggatacaaaatcaatgtgcaaaaatcacaagcattcctatacaccaagaatagacaagcagagagacaaatcatgagtgaactcccattcacaactgctacaaagataataaaaatacccaggaatacaactcacaagggatgtgaagaactacaaacaactgctcaaggaacataacgagagtacacaaaaacaaaagcaccgaaaccgacgacaacacacctttgggggcgcccagggccccgagaaagagtgtttaaaacaatgaggtgtaggcgcggggccacaaaagataagtgaacagggcagagacagacacaagaaaaacgggaaagaaaaggggcggaatccgcacaaataaaaaagccgggggaaacaaagtcgaacaaccagaggagacggagaccaaagcgaaaaacag

SEQ ID NO: 618859 - DNA, 185 bp, Homo sapiens
gaatgaacattatatataaagaacatatcaagctcaagatttctcagataacttttctttcttcaaaatctagctataatgtgttataccatcatctgtaggtagcacagcatacatctgattatcccaagccagaaaacctcatagttattcctagactccaggccagaaatattcattgagtt

SEQ ID NO: 618860 - DNA, 772 bp, Homo sapiens
  misc_feature (149)..(149): n is a, c, g, or t
  misc_feature (407)..(407): n is a, c, g, or t
ggtgaagtcttgtgaaagtgtgtggggttccggaggcggttgttgcttcgggtttcaaccagttggttatccaggccccttccgatctttaggaaggccctatgaatatttttctacggttcctggggctccgccccatgaatgttttngacgcgctgtgaaatgccccctgtgccccttttaataggcaagttgtcttggcgcgtcgttcgctttcccccggagctagctaatggggttaggaacaaatccctgggtttctttgccctttaatgtgtgaactcctcgccagggttgttggggaaaaacaccactgagtcaaggcaaaactaagtggaaattttctgtttaaaatcccttctttttttttgttttgtttaaatcaaccaagcgcttgttttctattntagaattctttctttgggccagaaaatccatttagattacatattccttgggtacaaaaccagtaccagttttagacaacagacactaaattttccaggtggtatctctaacgtcaccctatttctacaccagattggggaaaaaccaagtgatttagggtgttaaaatatatcattggacgaacccataaagatatgctgagtatcactctggtcagccatactcactgctctttagttaacacttggcactaaaacgaggtcgatgactccattttcccaaaaaccaaacactttttataaacaatcaatcttgagaaaaccagtcaattacgccacattttttaaatactaagaaacaggaa

SEQ ID NO: 618861 - DNA, 1232 bp, Homo sapiens
agcggggcgttgccgggagccgggcgcgggctctgtgtggactcggagcaatacgcggttttgacgaagtatattatgcggcagtacatctctctctttacatgaagacaaagtcttctctctttggatgacgagtgggccgcctatttggcacacatggctgctggccttgtggagagttatttacgaggattcgatggcacacttctcctggtggaacagaatttggagcacgatgaatcgctctcagtcagctcagtcccaaggctaactgctattctggaatcacgttgttaactatttttcaagtcctactattgcgccagtagtatagtcactaccctgaaggttctctcaggcttgccaaaagagcaacgaagccgcacttttttcctccttgatcgccttgcgttagcgtctccctcgcgcttagagcaatcattgaccaaagggggtcacgctgtttagctctccctttaggttgccaatgattggtgtgcctagtgctagatcgatagcgactgggcgataggttggtctcacacccggttacccgtttgtcctcccgctctggcgtcgcgaggttcgtattgggcgaggacttgatgcgccattgttcgcttgggggcctaacccctgggggcttgtggtgcacaggaacccccacggtcacctctttgtggttccctaacacgtggtttccttcggttgattggattcttcccttgggtcccgagcattttcgcgtcctcccggggcccgggcagggccaggttgcggcccggtttgtcgggcctctgggggtgtgccacggtcccacccggggcgtcccgactttcgccggtggtttgaccgtgtttagcccttgtttctctcttatccttgagcgggatttccctagcttttctgctcactctattccgttaagggtttccattcgtcacctggcttgtctgttgcggaggtacacagcccccaaatacgggaacacaccgaaaacaagtttcaacgatgcatttgccctaagggtctgatcgcgcgttattcgccgtagacggcggcgccaatggacacatgtatagaaaaggcggtgtccacgggtgacacccattaagcgaccctcttccgtgtaacttgctatctccgcctatgtcgggtgactcccacgcgtctgtccaccttgtgtgaagcgggattgatgtccccgttaattggcgagcgggatataacac

SEQ ID NO: 618862 - DNA, 982 bp, Homo sapiens
gagcggtggctcgggagagaccttggagcgcgcgggaaagagaccaaatataaactgtggacgggatagtgtttcggggtccttgtcccagttagaaacgaccctcggcacgggaagtcaagttcggttactcgtgcctctacctactcttacttgtgtagaacgatggtgcggacataaagctagacagtggttccgaggcgacttaacaagaagagaggtcggtgtgcttgcatcggatgctcctctcaggagacagggatgcatatggtttcatttgccacctgtctgtcacatcttatatatcgagcactgcacgattatcagtacgcaggaagacgcttgatctagtaggactagtgcatgcgacgggaatcgcccgtattttgcggtgacagctccaaactacaccatagattggcacatagaaggcaacttggagagaacttcgttcagggattgatccaccgtaaaggattctgaagagacacgacgaattcatagattcactgaacgacaggcaggaacgcaagtgagctataggaataaggcaaaggagaataagcatgtacctttagcaagcctggtagtcacacagaactgatgaatagagatatacgaacctttctcatgtacatcttttgaactaagcgttctcctatgttttgaacccgtggttgattcgtaagaattggttagcatgtgtacagttaacatggtgttaggttccaaagtatagggtcttggttgggaacaggcgaatttatgttccaagacaatttgagagtttaaatttgtagcatgttccaaaaggtagttgggaaaatttgagaaatttggtaagactaagttattggtaactatagctttagtattgcagttataattgcataggtaaggttggtttgtagccaaatttaaagtgtctaagtggcttggctgaaaaatcaagtccattaggcattgttgttctgaattaaga

SEQ ID NO: 618863 - DNA, 120 bp, Homo sapiens
  misc_feature (33)..(33): n is a, c, g, or t
  misc_feature (64)..(64): n is a, c, g, or t
gacacagagcaactgagaggtatggaacagctnacaaaaaagtggagagagaacgaagaagacnagaattagcctccagatatgcagaacaaatttcagtgcttaaaacagcgctcttgc

SEQ ID NO: 618864 - DNA, 419 bp, Homo sapiens
acagaaaaaagagtctggccatagcagaccaggccaggaaggtgcactgagagtggttctgccttgctgctggtactgataactatctagcatcagtacatctacaatgatctttccctctaaatcacagatcttgatagcaggggcctgtggcagaacacagacagtagcggttagggctgaagcacagggagatatgatgatgtccccaccatctagcgtgtaaaggtgtaagcctacgttgagatcacataacatggcctggacatcattgcactccagaagcacagagggatccatctggagagacagacacacgtgttcagatagcctgtgtggacaatgtggatggtcttcagcttgcagaaagccaggttccataccttgaccagcttgtcccagacacaggagacgatgat

SEQ ID NO: 618865 - DNA, 1345 bp, Homo sapiens
ctgggtggccacgcatgagcacgaaggcaaaccctactgacaaccacccctgactacgcagaccatgtttgtcggcctaaatggctttgggcggggcggagccgagagccacacatttcaatgtaaaccatggctggtggagaccccatcacttggctgcttgcagtggccacatgtccaggcaaatgccaggccattgtccccagatgcccagggcatcccttgattgcccctaatgctctcagttaaacctgcaacacttggaaccaacaacaaaaaaacacaaaaaaacaacaacacccaggggccttctattgcgcgggcgggcgccacagaaacaagaagcgaacaagagacagcgcgcgccacacccggtgacaaaatacaaagagaatacgcagtgcaccccacaacatatcaccctgtgacacaaacacgcgcgcccacaaaccaaacacacgaggaaacaccgatatattagagagagcgcgacaagcaataacaccttctacgcgactacgcgccccacgcgctctaccccccagcgccactaccccgcgagacaacacgacaaacgccacacaaccaccgacacgacaacgtacaacaaccacaagcaccaccccacgacaaacggtgactatatataacacgaacaacgatcaaagaatacgcatggaaccaacatactcacatatccgaacatatcatatctaattaccagccgaccgacccacacaaccacgcccgcaacgcttaaagctacaagatcaacaaggaaaacaagcaaaaaataatcacacaatggacagagacaagaaggccagcacgacacgagagaccaccaaacaagagacagcaaaaaagataagacagcaatgggaatagctgaccacaagaaagaaatacaccaaacacaaggcatagcagagagtggaaagggagagagcctcgcagcaacaacagggccaacagaggaaggtaaggataagcgacacgcacgattccgtgcaggtctgctagttcttgacgcgcggtcagaccgacggtggcacatacgagtgacgcacctgggtacgagcataagcacgctacctcagactagaagtgacggcatggcgtaatcacacctggacaacaaggcatattagaggagaaactatggaacgcgagtagcgatggcagaagagatacgagacaacggacacgtatagctagaacccaggcgaactgatacgagagaaggttgtcatattgatgcacgcatgtacagcggtcgagccaccagtcagtctaacaccataggacaggctagtcacgtacgtgaggcacgatagacaatggt

SEQ ID NO: 618866 - DNA, 140 bp, Homo sapiens
tcccccatttcacctgccacaaaaaagaaaaactgataaattagataccatcaaaattagaatctctaactgctacaaataataccatcaagaatgggaattgcagctgggcatggtggctcacgcctgtaatcccagca

SEQ ID NO: 618867 - DNA, 794 bp, Homo sapiens
tgggttggcttttctcttttgtgttcacagattctctcccccgtgttggcttcagggttagaggtgcgggggctgctactctgggcctcacgtgtacccctcgtgccctcccaggttcacacttgttcttccgggtctgccctccgtgaggttagctgggattatagtgcttgcgccaccacgccgtggctaatttggggtcttctttaaggggagatgggatttcaccatctaggccaggcgtggccgtgggacctctctgactttctttatgtgactccgccccacctgttggttccccaaggggctgagatttacggggtttgacccttggttgccttggccatgtgggtttagacttcttttgaggctacgggaacccccctttgcttgaatacttgctgtcagaaagtgcctgctatttaaacgcttgcttgtcagattctctgtcgtcccctgaaagaggtttccgaagatattttgagcgatccgtcgggtgtgtccaaatttgtggctccacaaacgctgtaacgcgcttggaacactccgtggctccgggttggtgcttcacgaaccttgtgttgggcgtgtaataaccttttcccccattcctaaaatccgcgggaccatcgtttattgggccctgggaccgacatggtctttttctaacccttgcgacgcctagacaaaccgcgtccttggtttatccctctggttccgagttgtactctcggggtttgccccctgggggtccccccgatggtcgtctgggtaacgcccacatgcgcgtcgac

SEQ ID NO: 618868 - DNA, 241 bp, Homo sapiens
  misc_feature (81)..(81): n is a, c, g, or t
agggagttgagtgactcatagaggatccctttgcggtgcctttccaccattttcagcccctcaggcttggaggaccggggncacactcttggagcctcggtgaagtggctggcatgacgccgtttctctgacgtcccccatagatcttggtcatggagccaaacccagcggcaacccggaaggtacaggtgcccgcgctggttggaagcagctcggggtgtagaaccaggttcttcatcgg

SEQ ID NO: 618869 - DNA, 184 bp, Homo sapiens
ctcaacgtcgcgcatgcttaggtggggcgagacgaggcttgatgactggcaggccctggggcagaggggacaactggccggttcccaggcggtgacctcaagggtggcaagagcaaccgggcacgccgacgtcgccttgcggcgctgcgatcgatgatcgaggcagcggcacagccttggcccg

SEQ ID NO: 618870 - DNA, 212 bp, Homo sapiens
cgtgtcgagcactgctcctgccagctcccgctgccgcgcctcctgtgtagaagtccctgtctacagaataaggctggcaataaggctgggggtacgccttcgtaaggcgtccggtcccccgttgtcatagctctttccctgtggagaggccgcctctaaagagcgtagcggagtttctctggctgctctgaaaaaagcgttggctgccgccg

SEQ ID NO: 618871 - DNA, 294 bp, Homo sapiens
cagagtgcagagaaggattactgagcttttcccgcctgcacagacacttctccttgcttcccaaccttgacctggagaaccaccaagtgctgtgtgcagcctcctgtgcctcacccaggcctgaccccaaaattgtccaacaacccggtctcatgcccactccccatccctacttcccaaaaattgcactgtgtcaagtttgcaacaaagaatcccgctggcatcctgtccttgggaaccctttctcattctccaagcctggtcagctgcctgcacaagcagaggcgccctcat

SEQ ID NO: 618872 - DNA, 431 bp, Homo sapiens
tttcctcacttcttgagctgctttccctcctgtggtgccacagttggacaagtatcaatcaacatctgccacctgaggcgcttccgtctgtgccagaaggctgccagctactgaccccctacaaagggagctgctgtcactgatccagctgcagagggagttcccgcgctggtgccgccaaggtaacaatcacacctgtacatggaaggtctgggaggatacccttgaccaaatactgtgaccgggagtaatgctgtgaagacccagcaagcaattgtgttagcggcaaccctcccagccccaatcgggatgagttgcctttgcccggcggggacctaaccccaattttaccgggacattttgaccattgacatcgggcggagtcacccccaacctcattggcaccttcttgtggacaccaaggagttctc

SEQ ID NO: 618873 - DNA, 929 bp, Homo sapiens
tgctctatcgtgtagtggccgtgcttgtgtccgcctgtgtgttcgtgcgtcgtcttgccctgtggattatgggccgccgttttaaatgggagcgtgcacactgcctgcgcctggggagcactgtgtgcccgcgcaccgggcgccgaggcgttcgcgcccgtgttcctggggccctaacgggttgtgtttcgtcggcttctataaatggccacagtgcggacaggtcggttaagggagatttgctagagcgcctcctgtttgttgacagcactgtgactggccgaggtgttcccgcggtacccgcgcgtggggcgtgatctccctgtttgtgccccacggtgagtcccccagtgaacaaaaaggtatatcaccccacggggtcccaaacaacaccggccgggaacatatttctgcccctttttttatagaggcttacaaaaattcttaaagacccccacgtgttaatagctctccaatactataaccaccctttggtctgtaagaccactttatccatattactatgacctctggatcctgatttataagaatttttgcgacgtaatatacacgcccaaacctatgcgtttattataacaaaaaatatttatacaagattgggctgtagcaaaattgttttcgaaacaccattggcttttcgacgaacccacatcaagagaataattatgcaccgcatatttcacaattatggaaagaaagagtgcgcagtagacgcagaaactctaggtaaagcatgtgtttccccacagatatctccgtcgaacctctcgtgtatcatcgcccaaaagagaacagacaccttggggcaacgccaaaggagggtctgattctccccgagctccaaggagtgctaatctttccctccccacaaggggaacccccttttttaaaaaaaaaacaacaaataa

SEQ ID NO: 618874 - DNA, 418 bp, Homo sapiens
gctttatgtttcaagaagggccgactcgcgaattttttagacatcagtgcttcttaatgctacgctattatgcttattagttatgtgcgagctttgtatattcttatatttatatataaatatcctcatttgttacaggcacgtatagttaagagagttttattttgataaggtcatattgttttgcctatgtttaactcactccacttttcctaggagcacatttatattgaggtcattagtgcgtcattgtgttttttgttgggcccttcagcttggggcagtatagtgtgtaattaaccactggattgttatagtttgtactgcattgcgctttattatatatatcgacagtagttctaggcgccattgtaaatttattgcattttcttttggaataatcacacgcatcaaacac

SEQ ID NO: 618875 - DNA, 667 bp, Homo sapiens
gaaggatggcgcgtcctgcgggggctgcagcgaggggctgcctcctttggctcatccacagcctctgccgccctggaactcagcaacctggttggtacagtgctatccaggccacagctgagacctgtgtatgacatcctgtcccctgtgcagcccccgtctccctgctccctgcaggataagctgctctgcgctggagtgctgcgcagtgggccagcagcctgccgacctgcgggagggtgtggccaaggcctacgacacagtgcgagagggcatcttggatacagctcagaccatctgtgactgtggcatcgctggggccatgagcatgaatggggctgactgggcgccgtggtggggcgtgatccgccagctgcccccgacttgttggtgaagccgctcatccttggccacggatggccacgtccagcctgctcggggtgcatggcgcaaccagatttgtcccctgaagcccacaatggaccactgccctcaaagtgtgcgctctggacatgtgcccaaggactgagcctggggttgccctggcacccagagggtgcatgaccaaccaatgctcctgagcctcccaagagcatgcaagcccacgggcccggacacaggcttggcccttcagggcgattggcacatgtgaattgacgccttccca

SEQ ID NO: 618876 - DNA, 433 bp, Homo sapiens
cattttttactttccctacctttatgttgtgctatcctggtccacttggacactctctgatgcctgaagagattcttgtttgggatttagtttcccagggccgtgtttacagtaaaatagcaggcagtccttttagttcctcctctaagtctctgagattcttcatttcagggttttaaacataagcagtccatcttaaggaaagtgtaactgccgcggccacaagtctgctagttgcacttgaatgttctagcagggttgttgactgccctttctacgttctggactccttgctgagactgtttaacttgaagattaaagaaactattgcaaatgccagtgcatcagaacctaagagtggtcaaatattatgtgcaattttttttgtaaagaaattttaatttataataaagtttaacagtttaaagaacaa

SEQ ID NO: 618877 - DNA, 102 bp, Homo sapiens
gtggaagaatgcttttgcgaatgtctcaagctctgggtcgaatagttttggctgggcgtgaaatgactagattggccggttttactgctcggattacagaat

SEQ ID NO: 618878 - DNA, 625 bp, Homo sapiens
aataataataactattatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttttagggtccccctggggggcccccctttcccccggcttgcccccttttttttttttcccttttggggggcgtttttttacccgggccccggccccttttttccccccctgggggggggaaaacctttttttggggtttttttgggggggcccttttttttggggggggcctttttgggccccccccccccccaggttttaagccctttgggggaattttaaatttttaggggtttttggggttaacccccccgcctttccttggcgcttggaggttttccttcccgggtttttttttggaaaattttttcccccgggccctggggttctttttggtggggttttttaaattccacccccccggggtttttttgggccccctgaccctcccagttggttttggtctttatcccccctcccacctttgtgggggtttttctttgtttaaaaaccctccccccctccccttgccctta

SEQ ID NO: 618879 - DNA, 136 bp, Homo sapiens
ctgaaatggctcaagttatgagggcctaatgtggatgggacaggggagccagtgaagaaatgcccagatgaatgctcccacattctatcagtgaaggtatgaagatgcttgcaaagaagctctgtgggacaatgcc

SEQ ID NO: 618880 - DNA, 1017 bp, Homo sapiens
gcgttcgcatgtggtttgtgctgttggcgctgagtggtcggctacgctgtccagccgctaaccggagcttgtcttcggcgctgtataatagctctgcaggtctgcgatagtacttggcctcataccacaaatagcgtacatctgcagtacaattgggacaatctactgaaatgggacgtacggtaacacagacagttcgactgatgcgcatatgcctcgaccgacactcttggtcgtggaaaaaagtaactagattcgacgtgtagtgaactgggaaacgtggaatactttcctgaagtggacagggatttaccagactgctgacaatacttgggaacctgaagacaaactttacgattgtccagaattgattgaagcgtttcttaactctcagacaagctggcaaaacgaaaaccgatggtacaaccacgcacaactctttatcctgacagtgaatctgatgacagcaaatcaaactgaacgaacaagagatggctggtggccaaaccaaagagagagtttgcgcccggggtctctgggacctcgtgaaacaatactctggggtgccagagacaacggaggtggaccaagtttgattgtcttccctcacttgaagagtgcgacatgactcccacgactgacgcgcacgaacttgggtgggatgggagaaagaggaatgtttggaagggtctcataatgtacttgctttatgaagacgagattgagtggatttcatgtacagaagattagtcatgaatggtcgcaatggtgtgatactattattagtattttttatgaaatgggttagattgatgatggtgtgacgaatacaagtgtagaaacaggtgatgtaggtgagaaggtgtaaatgatggagttaagcaagaggggttgagagatataaggtgtgatgatattggaaagttgagagtaatgtcaataagatgtgtgagagattaatgtatagagaactgagagtggtaaaataaacaactatcgtctttgtgtttatctcag

SEQ ID NO: 618881 - DNA, 257 bp, Homo sapiens
actgactcctaccaaagagtacagttccaactgagctgtccagcctttgctaccatacctatgggctgtatacaccatggccttggacaccctgtgaccctatcacttcctcagcctctagtattgtacactttacagagacatggtgctgtatagcctgtatctaggtagcgcatgataagtaaggctgacacgaatgcatgaagaggcgtggtaagcacttgataacctgtaggaccatagcttgattgttctgt

SEQ ID NO: 618882 - DNA, 941 bp, Homo sapiens
ggaaaacactctcatgtcaagatagggcgttaccactcagacactttacaagtagcagctggacttagatctctcacctttggagtacagtgatgaagtgctacccagagatcaaggagaaggaagaaatgaggtaagatcattcgggcagatacggtctcactgggaaacaacaggtgagccctaagtccggaacttgtcagaccgggcagaagtgccgagtgtgtctggcctggctggccatggcagaaccccacacagtgctcttcctggatgaatcccacgcaatcacctggatatcgagaccatcagaggccctggcaggatgccatcaatgaagtttgagggtggtatagactgctggatcagcccatgacttcagactcattcacgcaggttgcacaggaatattggggtctgtgacgaagcagacaattcaccaagtggcctggagacatcctggcttacgaggagcacctcacagtccaagctgcgatgccgacgaggcagagatgagggcctcgcggatctagcatggactggcgtgtcacagctgccatgcagcgcaagaagctaagcagacttcaggacaggacgcctggggctacttctcctgcattgctcgcaatactggctcccccatgctctcccctgcccctcaaccgtgccttagctgggactctcttacctacagctggacagtacctgtctgtttccttgtcctccttccagttgacatctgtcccatagtctcggaactcggctgggccgataccctcacaaggccctttgacttggtaatccttactctggaatggtgaatgcagctcagaacgcaacttggggttagacacaggggccaaagccctgatattggccttgcggacgcagcttaggaatccacgaaactggggtaggacatgttgaagagagtcccccag

SEQ ID NO: 618883 - DNA, 202 bp, Homo sapiens
  misc_feature (78)..(78): n is a, c, g, or t
tacagatcacgtgctaagggatcttgctgtgccatccacgctacactgtctggctttggtgtatgccatccctgggantccagccttctcaagctttcacggtaccttttttatcccattgtctctggctggaattcatcttcattgtcgttgaccttgtcatcttcatcatcttttaggctgtgctttccaaattccaggt

SEQ ID NO: 618884 - DNA, 406 bp, Homo sapiens
  misc_feature (27)..(27): n is a, c, g, or t
cgattctagagaatccccttttgcggngccctttccccattttacagacgagagagttttcatgacattaagaaatataccaaatacggtggagagctaagagttaactccaggcctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactt

SEQ ID NO: 618885 - DNA, 608 bp, Homo sapiens
aattagccttgcgtgttgagcctggtgatcaacatcagtgatccgttgagcacatcataatcgccctctttatcagctgtggtctccatagcaaatgagtcactacgtgctacagcctctgagaggcagaaacctccaacttactctgtagtcagctgagtcatatatgtgacgtactgttagtctgtgccatgatttctaatcagtgtgtcaagtaatgtgttatggatctcacgaatgtcagccgcagatgcatctgcattggctaattcctctatcacgagcgcagtgagatgtgaatgcagctcctgtgcctccatattctgggtcaccttccgaattttcatccatggttgaatccaaaggtgcaagttgttcctgagctcattgtagaactgaacgcagtatcatcatttcatcatctgtgaatgtcagcaaggaagcaaagtgtattccataatgtgttatattcagtacagcttctgactgggaagatttttagacatgaggaggaatcgtacgatgatgcgaacgaggcaggaagtttcttcttagcagcatgcttccgtgcaacaatcgcactgagaggccctacatcctcaccgcag

SEQ ID NO: 618886 - DNA, 120 bp, Homo sapiens
gaacgggtgacgcggtggagggtactgctggggaacgggacctggatgaggttgatatgtcagatctctctccagaagagcaatggagggagatctgacatatcaaccgcatcacccgtt

SEQ ID NO: 618887 - DNA, 1239 bp, Homo sapiens
  misc_feature (1239)..(1239): n is a, c, g, or t
gccgggacgctgaggggcccgaggagaccgtgaggctctggcctgcagctcgcgccgccatggacgctgccgaggtcgaattccatcgccgagaaggagctggttaccattatccccaacttcagtctggacaagatctacctcatcgggggggacctgggggccttttaaccctggtttacccgtgggaagtgcccctgtggctggcgattaacctgaaacaaagcacagaaagtgtcgccgtgctccctccagtagctggagtggactgtacgaaacagttggacgaacgatgagggatcagtgagacgatgacggaagacataccttttatccgccaagtgcccagtcaccttactacgatggaagcttagcgagagctccttgttaactcatgcttcagacaacatcccgcaaggcacgacgaaagtccggaccctggtcaaggatacctgtggtgacacgtcgtatagccaagactccgagtgtctgctgacagctttgtgagacagcagtgaggcacagtgccaagctggataacttgagccttgagtggagatcaacatccagcgggactttcctcacacaagcgctcaacacatgtcaaactccgtacgaacctccagcctctggagagtactccgtctcaggacttctaagagaaagggcctggtgccagcggcttgctggggatgtgagcgctccaagacgtgaattgaaggtacccggggtcctggagccttagacactcttgatgccttgaaacattgtgtggtgcacaggacagggtcagcagttgttgggaacaacattgatatacctcaactaattctctgggaagatctacaactggttgtctgaaagcgagcgttttccccgtgtggacaaaagcacgctgagaaatctcgatagaacatgagtgcttgtaacaaactcgagtgagagtgatgcatacaaaagtgcggaaacgactatcggagatacacaaacgagaggaagatggatctcgactccactgcttctttctcgttcttctctgcctccgcttctccctcgctccagacaggaggcgagcaggagaagagaaaagagaagcgaagaaaacgacgagcgagagacgacgtgccgaacagcaagacgacaacgaagatcaacgaaaacaaagcaggcaagaagagaggacaagcagaaagaaacgaagaaaagaagaaccaaagcaaagagagcaaagaaagacan

SEQ ID NO: 618888 - DNA, 550 bp, Homo sapiens
tccagtcggtacctgcatttactccatggcattccttttttttttggagatagagtttcactctggtcgcccaggcgggagtgcaagggcgccatctcggctcacggcaacctccacctcccaggtgcaggcgatggtccggcctcagcctcctgagtatcggggattacaggcatgtgccaccaggccaagctaaggtttggtattttcagtagagacgaggtttttccatgtgggtcaggcgggtctcgaaactccggacctcaggtgatccgcccgcttcggccccccaaggggctgggattacaggcatcagccacggcacccagccaaaggtgggatgttctaacttacagatggagataagaggtgggcataagatacaggtcactaagacctggcggataaaacaggtggcagtaaagaagcgggtcaaatcccaccaaaaccaagagggccacgagagtgacctcggggtgtcctcacggctacactccctccagcaccatgacagtttacagatgccagggcaacgcctgggagtaaatgg

SEQ ID NO: 618889 - DNA, 138 bp, Homo sapiens
tcatctagagggatccgtgatgtgaatggaccaccttcctggcatagttctctctgggcagcgagcagcttacagtgcactggtggtgtggaatggaattgggagcgtcaagtatctgctcctcaaagttcaaggact

SEQ ID NO: 618890 - DNA, 189 bp, Homo sapiens
ccccgtgattaagcgagagaacttctgcaatgctagtaatgttctacatttcaaaatcttgatagttgctgtgtaataaagtgagctgtacatcttctgtgtacttatctgaacatgtattttcacaataaggtatttatttttcttgggacagggcctcactctgtcaccgaggctggagcgcaatgg

SEQ ID NO: 618891 - DNA, 353 bp, Homo sapiens
ttctcgttcgttatacagctcatggagtgctgggagaagaaggtggagcgcatctgagaacaaccccgtgtggtgggccaattgagatgcaacggtgcgcgatgtactatgagaacgcagttccctgagatccgcaagcagcgcgagctgcaggagcgcatgcagagcagggtgggccagcggggccgtgggctgtccatgtcgtgccgcccggagtgagcacgaggtgtcagagatcatcgatggcctctcagagcacggagaaccgtggaggacagcagatgcgccagcgtggcctgttgatccctgcccaatgctagtacgactgctgaccacgcagcgcatcactgttc

SEQ ID NO: 618892 - DNA, 335 bp, Homo sapiens
cccagcaggtcaggggtcggggcatgcttttgggtctagggaggagagtggaaactttaaatccctgtttccttgttttgtggcttcaatgaggaggcctgattgtggcaagtaagcctccacctcctttccctgggtcctgtcttggaaggacagagagcagctaaatcctagtgtatctaaaatcagtgagggtcaaataagctaaaagcagctgaaattcctttgtcccctgtaagctgggaaaacagcgaaggccttagtcgtagagattgtaagggccatttttggtttttccacaccacagtctgtgtttttcccccagtccttggttg

SEQ ID NO: 618893 - DNA, 820 bp, Homo sapiens
  misc_feature (820)..(820): n is a, c, g, or t
agctgtcggggtcctggaggacggtccccaatagccctcgccccaagtccttgggatcacttgggtccccagagctggggagatggttagtaggcggcttgcactgctccaagaatgcgcttgcgctctcaacgtggtctacatgctggtgagcttgttgctcattgagaagtggatgcttgcgggcaaggagcctgggtctggtgtccagcactccgacatcatcggcggagtcattgctgtgggagtcttccttctccttattgcacgtggctggactggtgggtgcatgtcaaacacgcacaagtcgctgctagtgcttttacgatgatcatccttggtgtgggtcttcatcttccactgtgtgaatctcttgctcgatgtctggctattaaccgaagcaacacagatcatccttaggtgcactgcgttctggcctcttgggctattcgcttcctctgggatgtctggttagatttgtccagtgaggactgatctagagaacctcagaagacagagtgtcactcaagtgcttcttggtgggtcatgagcaacaagacgtcgggatgaactggaaagaagttggactgtgtggcttatgcaacctcacaaccctgtatcaacaagattatgatttctgcactgcaagtctgcagagccagagccacacatgccagatgtgtggagaaaaaggtttcttaagcattcagacgaacagcccttgaaaattcgtaggaggttgttgagactctttctttagcgtttacagaggtaacattcgtccagttccctcacacacatccttttggagactgggaan

SEQ ID NO: 618894 - DNA, 852 bp, Homo sapiens
gccggaccggtgatatgccacaggaccctaagctggcctcgtgcgctggtgcgacgagcttgagcgcgtgtctgcgtcatagggctccgcgtggcacgtcatggaggggattctggagtgatgactcgttaaagctacatgcaagcgcgtcagaaggagttcgatgcgcagcgtcgaaaagggaggttccatcgtacgtgaggagaggcctggtcgtatatcataaccgacgaggttgcgacccagagggtgtgagacgaaagaacgatacttgtcgatatgtggcccacatggtctactcgagctctacagagggctgagtgtgctgcgttcacttgaagcgagcgcgtacgaggcagaatcctggaagactcgcacaccgtgaatctggcccttgcctagagatcatcaagatgctgggcgccgagtggaggcaagctgctagccaagcggaaacagcagcggtacctggatgaggccgagagagacgaagcagcagtacatgaaaggagctgcgggcgtaccagcagtctgaagcctataagatgtgcacggagcaagatccaggagaagaagatcaagacagaatgcactcgagctctggcggctcatgaacgctctcctgaatggacaccaggcgttggggactgcgaatggcttctccagccttacgacgttccccatactttcacctgacagacttcctagggaccaaaatcacaaggcgggttgaggcggcagctaacggctgcttgcgggaaagcatgaatgtggcactatcgaggagacagaacgcgagaactgacgagggaacaaggcagagcatgagcaagggagcgcgcagcgtactgg

SEQ ID NO: 618895 - DNA, 498 bp, Homo sapiens
atgccatgactatttatactttatggaatttactaaaaataattactataagcacctatttactgttaggtgacatatgaagccccttgtcatctgagacccctaagtcccttagaagtcatttttctcccctgcatttttttgatcaatttctttgaaatattgtaaatgaagagttatccagctattggttaaacacctttagtggaggggaaccactttctctgatgacaaaccctcttattgttagacatttcttttatgaaaagtgtttctagaatttgagctagaatttgtttcccaagagttccactaatgttcctggttcaacactctggattgctttccagatattttagtacatcttgccatgtaatgtcttgccaacatttctgacttttttgtttttgagacggatcttgcactgtcaccgggctggagtgcagtggcgtgatctcagctcactgcaactctgcctcccaggttcaaggattctct

SEQ ID NO: 618896 - DNA, 149 bp, Homo sapiens
gtaaaacgctgtcacttaccatattccacactatattcacaacatctgagttactgtacaccaccccaatactacaagaaaccattacctttgcacctggatcactaccaacagtctcttacccttagtatcttatcgtatactctcaa

SEQ ID NO: 618897 - DNA, 967 bp, Homo sapiens
  misc_feature (109)..(109): n is a, c, g, or t
  misc_feature (818)..(818): n is a, c, g, or t
  misc_feature (906)..(906): n is a, c, g, or t
gtggcgcgtggttattctagatgaatcgagtgcgttaggtatatacctattcctgctgcgtatgcttagagaggttctcgtgatactacgcttcaagatcttcagtgtncttcctatctagtggacctataatggaagttctaagatatccgattggtcttcagtaaagtatgcttgactcctcaggaaccacctcatatatctctcctcacgcatcggtcagccttatactcgaagctcgaattgtccgcctatggatcgcttttgtgggacttggcgaggcacctggttggggcgaattccatacatagtgattggtgtccagcttgctatggggctagacgcaaagtatcctaaacgtcattatctgacttgagaggttgtcttatatatatcttagatacagatacaccttatactaattcttcatattagcaatagaccaacttgggccttggaacgttgttggcaggcactacatttcctgagtgttaatgttctgactaaatgaactaaaggctcatcgtttctcccggcttctattacagatactcaaggacgaccaaaataaactctgaatgatgacacgtgggctctacaagccgcctgttgctgcactgatcccacacctaaagcattactaccactacttatggacggaatactgtgcccttcgtgatgtcctcaattgctgtgcgattggctgggactacctgcattaatgggttcacgtatctactcaagaggtgacccctacgtgtaatattactggggcgactggaacgggctctctgcattggtaaataatcagcgcgcangtgtgtccctgtttgaattccgacttctaagacggaggaaatgacttgaaggcgtacatgctcgaggaagcaacgctaataacacagngtggagaatctcgttgaacctggagggccctccgcaagaaggaagaaaacaagctgacaaa

SEQ ID NO: 618898 - DNA, 404 bp, Homo sapiens
  misc_feature (30)..(30): n is a, c, g, or t
atcgatctccattcggcacgttcaacgccnattgcgcagaccccccggaattcggctcatatggccggcatatatccttgattctaggattccttacactgtaacacccattatggcttgaaactactgtaaccgtttgcaaggggattgcattaaatgactagaccaattgcttagtgcagtgccaaaacatttattgcatctaatatagaggccaaaattgctataaattaacctcgggttactgccaagcactgacgccggctttatgtgctgtatgcaactctgacctttgtcatctttcaggaggaaaagcaaggcttacagaaggacgtgccttcagcctgaaccaacactactttcactttgagcaagctaatgctgtgcccgatctactagccaca

SEQ ID NO: 618899 - DNA, 120 bp, Homo sapiens
ctacttgcaggtagggtacgcggcgtgaacatgtgtcactgggcaggcggtgctctcaatactggtgatgctagaggtgatgttttggtacacaggcggggttagatttgccgagttcct

SEQ ID NO: 618900 - DNA, 112 bp, Homo sapiens
ggttttcttttccaatttaaaaaaaaaatcccttttttgtataaagggcttccccttttgttaactaatccctttttttggttaaaattgttaatttaaatgtgccccttta

SEQ ID NO: 618901 - DNA, 918 bp, Homo sapiens
  misc_feature (68)..(68): n is a, c, g, or t
  misc_feature (266)..(266): n is a, c, g, or t
  misc_feature (280)..(280): n is a, c, g, or t
  misc_feature (292)..(292): n is a, c, g, or t
  misc_feature (306)..(306): n is a, c, g, or t
  misc_feature (347)..(347): n is a, c, g, or t
  misc_feature (374)..(375): n is a, c, g, or t
  misc_feature (379)..(379): n is a, c, g, or t
  misc_feature (384)..(384): n is a, c, g, or t
  misc_feature (398)..(399): n is a, c, g, or t
  misc_feature (514)..(514): n is a, c, g, or t
  misc_feature (711)..(711): n is a, c, g, or t
cttacaactgaatttgggcagtcaattaacataaataggctgcttggagaaaatgatggggaaacaanagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacangtgggcctggtccnggaggtactgcntggcctcccgtgtngctgtggcccttgacaaaagaacaccgttgccccgtctgtntcttgatgaggtggctaagaaaattcnntganttaantggcagacagcgannacatggatgttctgcatgagagccatgacatttttaaaagagagcaagacgaacaacttgtgcagtggatgaacaggcgaccagatgactggactctctctgctggtggcagtgnaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactangcattggagggacagagtcggtgtccaccccaacattgcttgaatccattcagcatgtgtttattaagaaagtagctgtgaactctggaggaaagcactgccttgccctgtcttcagaaggagaagtatactcttggggtgaggcagaagatgggaagttggggcatggcaacagaagtccgtgtgaccgccctcgtgtcatcgagt

SEQ ID NO: 618902 - DNA, 847 bp, Homo sapiens
  misc_feature (68)..(68): n is a, c, g, or t
  misc_feature (266)..(266): n is a, c, g, or t
  misc_feature (280)..(280): n is a, c, g, or t
  misc_feature (292)..(292): n is a, c, g, or t
  misc_feature (306)..(306): n is a, c, g, or t
  misc_feature (347)..(347): n is a, c, g, or t
  misc_feature (374)..(375): n is a, c, g, or t
  misc_feature (379)..(379): n is a, c, g, or t
  misc_feature (384)..(384): n is a, c, g, or t
  misc_feature (398)..(399): n is a, c, g, or t
  misc_feature (514)..(514): n is a, c, g, or t
cttacaactgaatttgggcagtcaattaacataaataggctgcttggagaaaatgatggggaaacaanagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacangtgggcctggtccnggaggtactgcntggcctcccgtgtngctgtggcccttgacaaaagaacaccgttgccccgtctgtntcttgatgaggtggctaagaaaattcnntganttaantggcagacagcgannacatggatgttctgcatgagagccatgacatttttaaaagagagcaagacgaacaacttgtgcagtggatgaacaggcgaccagatgactggactctctctgctggtggcagtgnaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaaggtaagagctctttttctatgtcacaaggtcattgagcctgaggcagttgtggctaaaggtgctgtgtggttcttagcacgtgcaaggatctgtactaaaacgtttctcaggattaatgatactgtggtatgcaggaagcagctagagttctaagatatttttgtataatcttt

SEQ ID NO: 618903 - DNA, 401 bp, Homo sapiens
agattcgccacaatagtcatgatgtatagcacagacaacacagtcttaatgattaaagaaatttttgtttttgagacagggtggtgcctttacaccaacgaaaaagatccacgtttgtataggctgctgatcttcaatttcagagtccaattgtcatggtagcatgagatgcatttgaatgtgttgttataagcttaagacagctagccttgcacccacaagttttagaccctagtcgacaaggcaggtcaccttatcgtcagccaggcgcctcttctctccaagcgttgccagatcatgcatcacacccatcagtcgctagtttggcgccatgcgggtttgtgtttcactagcaccacagagagcagtgtgagtcttcgtttgtcagtccatctcacagc

SEQ ID NO: 618904 - DNA, 236 bp, Homo sapiens
ctcaagggaaatttaacatccatttgtgataaaactcctcacaaactaggtacagaagggaacttccccaatctgataaagggcattttcacaaaacctactgctaatatcatatttaatggtaaaagactgaatattttctccctaagatcaggaacaagttgactgtccattctcaaccctcctatcagtatcctactggaagtcctagccagtgcaataggctaaaaaaaaaa

SEQ ID NO: 618905 - DNA, 2576 bp, Homo sapiens
gggtgacccggggtgcaagaattcaggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctc

SEQ ID NO: 618906 - DNA, 424 bp, Homo sapiens
  misc_feature (393)..(393): n is a, c, g, or t
  misc_feature (396)..(396): n is a, c, g, or t
ccccccacatttgcaggagaggaggagatgaaatatttctactttgtgacaaagttcagaaaggtaattatttatttcattgaatttagaataaattttagattaatagatgcagttactttgttttcccatttttttttttggtttcttattgactagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaaggtatgacattttgctggtaanaanttatatatttcttgaagtgtccgcaaat

SEQ ID NO: 618907 - DNA, 316 bp, Homo sapiens
  misc_feature (101)..(101): n is a, c, g, or t
  misc_feature (272)..(272): n is a, c, g, or t
ggtcactgtgcccttcaccttctgggttcaagtgattctcctgcctcagcctccctagtagctgggattacaggcatgcaccaccatacccagctaatttntgtatttttagtagagatggagtttcaccatgttggccaggctggtctcgaactcctgacctcaggtgatccacctgcctcggcctcccaaagtgctaggattacaggcgtgagcacccatgcccagctgggagcgttctttcagcaaaaagtctaattcagagacttcancttccatcctgggacttaaacaatagtactagaggtaagattct

SEQ ID NO: 618908 - DNA, 2482 bp, Homo sapiens
  misc_feature (96)..(96): n is a, c, g, or t
tattaatgtaggacggacaaaaatcttgttttagtctgcggttataaaaaaaaacagaatgttaaaatccattattaatgctatattaatctcacngacctcctcctttttaaaaacttttcaggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctc

SEQ ID NO: 618909 - DNA, 1103 bp, Homo sapiens
tcgggggtgtcttcatgtcacatagcacttcgctgcgttcgtctcgtctgttttcggtcctttggatcgtcgcttcttgtgtcgccaggtgtcttgtctcttgtggggtcgactctagctagatgtcgctccgtagttcggtgtctgcgcccggtatcttgtgtgcttacttgtattatgtgtatcgtcggcgtcgcgaccatctctcgggagttcgctcgcttcgtgggcgtggatgccgcgaccaacgtatatgtcgcttcgcttgcggtatacacagtgctgatccccctgcctggttgatttcctcgttgtgggggtcatgtttagtacgagtcgttcagtgtgtgtgcttgtgcaacattggcggtgtagtggcggcctctcgtcgcgttttgtggcatcatgcacccatgtgggccgctcgtgtgggcccgggccctttggtgtggtgcagagtcccccctgatgttcgttatgccgtggtgccgatgattactttgtagtgatggttgcgccccggtgcatcacatcgcgcttcgttcttcatgtttgtgcgtccgtgcgcgtaggtcgcgtatagggcggggggcgccgtcgacggcggtggtatctaaatatcgctcctgcttcagacgatgtgttctgagatggcggggtctcccgcatatgctggcgttgttgatggatgtttgtggtcacagctcgtggtgttgcaggttgcggcgggtgctcccgcgcgctatgtacacaagtagggagggacctcttggtgtgggttcggtttacgcgacggttggtctcggtgatcctaaatatactggttgttctcatcatgcacggtaggtcgaacaaagatgatggtcggcacagccacgataagtgttcctctgtctcgacacaatgatgtggacccaacaagtaccaaatgggggcgactactcacgcgcccgcagcacttgcgcacaacacatgatagcctccttctttaccacactagatgagcaacacctccttgactgggttacaaacgacccattgcccccctttttctcctttccccccaccccgaaatcctttccggggtttcccttaaaaaaaaa

SEQ ID NO: 618910 - DNA, 889 bp, Homo sapiens
cacatgatctgtaatccacacaataatctgggaaataggtcttttaataacagcttattgagatataatggacataccataaaagccacccttgtaaagatggacaattccagtaggtttttagacattcatagtgccatgacatcaaattagttggttatcactaattccagaacattgggttttttaaaaaattttgatagagatgaagtttcacctgtttttgctcaggctggtcttcaaactcctgagtaaagtgatgcaaagtgccttggcctcccaaagtgctgagattacaggtgtgagccatggtggccagcccagaacattgttttgagcagttttaagttcatagcaaaattgagcagaaagtacagagttcccattcattccctgcccccacacatgcataaacaaggatcagcatctccactagagtgatagatttgttacaatcaatgaactttcactgattcatcattaccccccaaagttcataatttacattagggttcactcttggtgccatacattatatgggtttggacaaaagtataacgatatgtatccacttttgtagtattatacagagtggttgtcactgcccccaaaatctctgtgctctgcctattcatcactctctcctaatccttggcaacctggacttctccgtatttttgcttttccagactgttatgtacagtatttggaatcacacagtatgtagccttttcagattggcatctttcacttagtgatatgcgtttatgggtcctccatgtcttttcatgtcttgatagttcattttttagtgctgaatgctattccattgtctgaatgtactacagtttatcacattcacatgctgaagacatcttggtgctaccag

SEQ ID NO: 618911 - DNA, 691 bp, Homo sapiens
ccacgcgatcgggcgcgtgctcaggtgcggcgcggaccgggccggagctgggtgtagggggcgcgggtggcagtgcgggtagggaaagcgcggacccgggactcgggcgagggagggccctaaatgctgcgggcctagaccccggggtacccattcgtcccagtcagcgcccaggagagctcgtacgccagcccagtgtcgcgggtcaggcagaagcttgtcctctccagcgcgtctgcatgggcacctaaggcactttcgtgccgcgaccgggcatcggcacgatcaggccgagcgcggtgcagccggggtgcccgggcacagagctcgtgggcacgcatgcctggcaccagcaagtatgcggatggcaagcgtcgtgggacacaccttagggatggcatgctcgagctggcaggcacagaacgacgaggcatcaccgctgaggcagggttgccacgttcgtcccccgcaggggccaaaacagtatacgtatgtcatagaaatccaattggggggtattacatcgaaggacagcaaggtgatccaggggccacaggcgcacggtgtacaacacccatgggacaagaaaaggcccgtatactaattatatatcctggagacgataggttggggatcaaagttccagaggatattagaagcagtcaaagaatcaatagtcgagtaggatatg

SEQ ID NO: 618912 - DNA, 1992 bp, Homo sapiens
  misc_feature (1440)..(1440): n is a, c, g, or t
  misc_feature (1833)..(1833): n is a, c, g, or t
caagacacagaacaaacacacagaaaaaaagtagcaacgaggaaaccgcgagcatgttcgtgtctgggcgagtattgaggatctcgcgccgtccattggataactggggtttcctcatttctcaccttacgagcgccggttattgcgcagataggattggtggaaaagtattgagatagacaagagtgcccctgatgtctcttctatagtgggcatatacaacgtgatggtggcacaacatatcttacccacagaatgccttgtagggcactgtgtgagcaacctcgaggagagactcaggaggaggagttcagggcgaggagaatctccatcgcgcgccctctttactctccgcgcgcgacatatttccccccagtaaagagtagaaactatatatagccatagagatagtttagaaacctcgctcgtgtcctatactgtctaccagacattatgtatacttttgcactcgaaggcattaaatgtatttaaactacaggaatatctaattttgtgcaagtgcttgagggagcggtggggtgacagagggtatgtgtgtttgtctctaaactataatcataacaaaaaaaatgaagtagtggaacagacatagagagacgaacatagagtttatctttaacacaaacaatagatctttatcgtttggatggcggtggggacaaacagcactttcgttaggtacgcacacaagtgtggggtaaaacgcgcgcttttccgtgaggtgaatatgtaattttataagccgagaagtgatgtgtggattggacatataatatcttctatagagaggccgcacatgatgttctatgtagtcaacggaaaggggatcgcgtgggaggggaaatattattgtctcttggaacgccggagatgtgacgggtggataaaatgatattgtctttggtacctcctcatataagaggaggaccatggtcctaaggtatgttgttagtaaacaccattgtatgtaaaagcaaggcccacccccgcttgtattcatgtaaaagactttctggttcttatctaacgacgcctcatggcgtgtagccgtgtgaaataatatcccttttggttattaatacactctgctggaagggaagacaacatatcaggcataatcattttggggaccacaggcgtgagttctcaaatccgtttgcgggtggaatttgccccaacgatggagtttgatgcgaaaggattttgcggacatgttttatgagggggcgctggatataatgtgatagatatgagacaccaatgtggtatctggcgaatctattagagccacctttgtaagctggcaatgaataaatttcaaggaaaagcgtgtaaacttcggagagggggttcaatttacaccaggattcaaggagctctcgaaaggggccaaacttattttttcataccgcggatacnatattaattatttcccttctagtgtgcgaaaaaaacggattctcgaaacaggtgctgcccaattcccaagtgaaattgtcgcggaatgttagcatcagtggttttatcagtaagaaaatcggtagagagagtgggtcattacaaacacaccggggggcccaacatttacaaaacacgtgtgggccagttatagaacatagccaccgactgtggtgcacgtcgcgatacaaagcgactcccacgcaacaattaggtgaacccgcgaggagataaatcaactgaggaggagcgctacccacgaggatccgtgccaaccgaactaggcgcacacagcacatattatcagagccacagcgaggacacacaacgcataccagcgacagccgacacaanacaagagagagagagcaaacaacataacctggagagacaacacagaacggcactgatgaagaccgagaagaacacgcaacacgaaacatcaagcggacagaaaatcataccacagcgggagcaaacacaacagcgtacgacaaaacaacgagcaaacac

SEQ ID NO: 618913 - DNA, 847 bp, Homo sapiens
aagcaaaaagctgtgtataggagcggatccggtgtgattcatgacgaggctggatgctagtggtaagtccaaggaagctgtttatgagacaaaatgatatacaccacaaagtattatctctgaacttcagatgaagtgtcatactaaaatacgtcatgtggatgctcatgcaaccttgagtgatggagtagttgtccaggtcatgggtttgcgtagtcataacagtggagaaaccagaaaagataagatttagtgcaaaccgtgtatgattctggctccgtgcaaggcatcgtggttccaaagtaaagttgtgtatgttcacaatggatagtgtttcggttatgcaagatgaagtgttgtggtgagttcgtgagacctgaagcatatgagtgaagcaatcgagcacagcatgcaagatagaagcaggaaccaagaagcaaagacaaccaatctcctgcaaccgtgatgcaagaaacatgctaacgagtaggttactatgaagctccaccctgatgactcaatggccatagcaggcagccttttggcaaagcaatcactctcgatgcaacctgaaacctgagccaggaatctgacacgaaagactgacagagcgtgaaaccacaagtggagggcagaagaacttcagaagaagtagaggagaaatctactaatcctcctccggacagaacctgtatctctgccacaagaaccacaaaagaccaagcagtcgaagctacaaccagaagttcaaatctcagacacctcggtgtgcgtgcacaaggaccctagagaacggactggttttcctcctaagaagacaaggaccaggccgaggagatttggaccg

SEQ ID NO: 618914 - DNA, 223 bp, Homo sapiens
agaaacagacatctacacatatataacaaaagaactacaggataggagataagtggatagtaaaagctactagaccgaataaaagccacggaagtaataccgaaggccatacagcacaactagcccactaacgatactagccacctagaggaataacaacataacataacccctagataatcgaagacagccaaagtaaaaggagtaaggctaggaaaagcta

SEQ ID NO: 618915 - DNA, 843 bp, Homo sapiens
atctcggtcatgcaaccaccacttcctgggttcaattgattctcccgcctcagtttcccaagtagctggggattataggtgcctaccaccactctggctaatttttgtcatttagtagagatggggtttcaccattattgtccaggctgtctcgaactctgactcaagagattcacttgctcggcttcccaaagtgctgggattacaggagtgagccaggtgccggcttaatgtttatttggttcaggtagctagagtcttactgtcttttttaatagcaaatgttactatttataatgtgccattcagtattcttggaattctcaggatatgggttggttaattataaaaggcatctgaaacctttttatacttttaaattagtgagtaaaaatctgtcccacccctgttggacccagcagaggtcacctgacaggtaaatccctgccctctgtatctctagcaatctccctgaaatgattactctttttaatattgatggatgtcttggatccaaggtatatctgagaaaaatgaagctctgtcagataacagtacgttatacacaggagtgtctgatggggaagtaggtatgtatgtatgtattatgattatggagaggagtttgtcttgttggcaggtgggtacaatggtgatctgggtcatggaacttgctccaaggtaagtgttctctggttatcgaagagtggtaaggacacctatgtgggttttgttgagcgaccggtacagggcagggttaactgatgtgacatccggcagtgttggtaccaccgggttttgcacttgcaattgttagtttgcaaaaaaaggggcataggggaa

SEQ ID NO: 618916 - DNA, 206 bp, Homo sapiens
ggtggctggagcatcagaaagtcacctcacagatcttactttactatctagcttcatattggctagcagactcactctatctgacgaacggatcaacaccctagaatcactccattcgataaatcacttcaccttatacaaatcaaagagcctcggttatctcttcttctctcttatgcataacactattctcaccacgacagggg

SEQ ID NO: 618917 - DNA, 357 bp, Homo sapiens
ctctaggtggttgtgggtagcacggactgtttctgaacactcgagcaagaaaagtcattaacatgacaagtgtgatggtgctcctgttccatctgtgggccacagggcaatattggtaaaatccacatcatagggttaagcctgttgggcacagttttcattcttaacccacattcttgtgtggtttaagaaagtctggggcccacagaaaaagaaaccaaggcaaccggtgaaagggcaggtctcacaattgggcagaaacaggggctgttagcccttctgggaggtggggtagggggcaccctcttacccaaaaacaacctgctggtaccggagctcgaaattcggaaatcattg

SEQ ID NO: 618918 - DNA, 790 bp, Homo sapiens
gtgaacccggcgctcgttccccaccccggatcggcctgcccatagaccagaccctaccgtcacctactatacacctgcaccctcgtgtactgtccccaatggacccccgaccagccagctacctagcagcacagcagactagaccgacacagaacacgacatgaacagaccagaacagtacatacacataatagatactgcactgctacatgcactagacaccatgcgataactcacatatacagacaatggatatgcaagctcaaagataaacaactaaccacgagacacccagagcagaatacaaagacacgagtgccgctgacacaactactaaacacagaccctaagacagttacaaaaccattagagaaggctaccttaaaacggccgtacctaaacagcttataccctagtgcccactagtacatataaacatacccaatctatgagaaacgacgccagatcatatgagaaatagatggcagacacctacatatgctacgctcgtcgacacgccagctcaccatcctaatatatatagtcaccacacatcaacatacatacactaaagcccgcaatcctgttccccatataatatcaaactacaccctaaaaaagacattaccaatctcccagaatactagatgaacggcagagcagatagcgcaatgcacggtcgcaacaacgtccacagcatttgtcacccatatcggaacgaagcgcacagagcagacacacattatgagcacacaattagggacaaacaacagagacgccattgtgaacc

SEQ ID NO: 618919 - DNA, 412 bp, Homo sapiens
tgtgtcttcaggaccctcgaataatttctcagacccacccactgtaaccgtgtatcctatatccttagcccaaaatatgagtctctcatgtgtctgtgtctctgggtgcgcatccaagaaaatccggtacccgcggttcaagcacagttcggtgtagaagtgaaggcacacagtagagcctttgagaggcttggttaccggtgctttgagggatccttaggaagtatccgcctctttgggaaccacaaaagccttcctcccagtgtctgtcgggccaaaggctatgagagagctgtggtcaagaccaagacacaccacagtttctcacatggtcagcgttctgctgacagtgacacgagggcctgaactctctcctttggaaaatgtgtacgcgtctgagagctcaggggct

SEQ ID NO: 618920 - DNA, 107 bp, Homo sapiens
ccgactgcgcattgtagccatcctgcaggcgcagcgccatcctgtcgcagccagaagcctgtgatggtgaagaggaagcggacccgccccataaccacgcgccacaa

SEQ ID NO: 618921 - DNA, 185 bp, Homo sapiens
aatgattaaaccccacaccaagcagaagagagtctgtagagataagtcgcgcgggcgcagaaggagaatttgggatctgcttgtacccatgggacacagcccgggaatacaaatgttttcctgactcttctctgaaagccagatagactccacctaaaaccatattgccaaggatgctgggatcc

SEQ ID NO: 618922 - DNA, 608 bp, Homo sapiens
aaaccatctgctctgggaaatgtcctgcgtgcgctgtgctcccacgtctcggaaccttgtccttgtttgtcccccagctcggcaagcgccatatgatgcctggctggctgccagattgcgaatcctgcttgtgggcgttttttggccatattccctgacccctcatgtcttagccctgtggatgtgcacctgacctgcaatagtgacttcgcagtggttgtggctgcagtgaggacgttcgacgtgcatggtgcctcagtaatatctcgcattatggagtgcatgcatccttccagatgctagggacaacacatggagggcccacgctgtcgagtctcccgtacacatccgacaatctatgatatttgggaacactttcctgcccattggcaaggtctccatgtacggatgttgtgaagctcattgtgcatggatgatatatgcattatgtgttggagcaacactgggcactttgttgtcaggcgcattcgaccccccacgatgtatttgtagttaaccagaacatgacaaaacttatttacctcagcaaactacataacttgatcagaccacttcccaagacaaaattgtctggacgattactctga

SEQ ID NO: 618923 - DNA, 617 bp, Homo sapiens
ggcaaatacataaaataaagtctcttcctctcaaaaatcggacccaaagttctcattaaatatttcaaatttataaccaaaaaacccttttggcttcttactctccaatgggataaatgttcctatgactaaatcaccaataacaagaactacgatcaccaaaagaacaatctatacttttacttcccactccattccagctactgatatacctaaaataatcaccactgtaatggctccaataattcaaatatcattgatttcatctatcataaatatggaatgctccttaagcaactccaccacagtttctacaaatccaaccacatacatagcaactgcaacagcattggcaaatgctaacattacaccaattgcaccaccaaattctggccctaaacttctacatattaaataatatactcctcctcctcttacaaatccattcattgctattgctaaactatacaatcctatgatacttatcacaacattggccatcattattacaaggactgatagacctattccaacttgacccacaatccattacaatctaatgacatcacaccccaaatgtttaacatacaacgtacttacacccttgatcccccctt

SEQ ID NO: 618924 - DNA, 934 bp, Homo sapiens
  misc_feature (189)..(189): n is a, c, g, or t
  misc_feature (456)..(456): n is a, c, g, or t
  misc_feature (499)..(499): n is a, c, g, or t
  misc_feature (572)..(572): n is a, c, g, or t
  misc_feature (683)..(683): n is a, c, g, or t
tgaagagcatgccccaagcaggaagctacacctaatgacactaataatcatggctctactgagctccttcaaatatgtgaatacctgcaatcctctgatttaatcatgacataccatgtaactgtggaatctttgttactgtgcagatcctcatgcttgaactgtgagatcacgtcttcatccgaagtnctcgcataagagatgccctgtgtgcggacacacgcgccacgattcagttcgttgtctcactcagtagctatggcgcgacaggtacttctccgtgatacttacgtgcgggtctctatgcgattagtagattaacgtccttcgatcacgttcagtgtatacacctccctctttatctatacttccaccattaatcctaaactccttactgtgtttttaccactgcgtaatagaggacataagactccataacacactaacttgcctaanactagctgtcaacgcagcgatactaccactcatagtaatgccnctagcgattgacatctacaactatctcaccttgcaggctccccataaatgatctctgctctgtcccttgaagnccttctcctaaagtatcgactaggcgcctctagcaaggatatacacacggtgatacatcccatgtctatactaagactaacgagcatacgcgaagcttgactatgcgcttncgtctaaatagaacgttgcctagtcataagcttctagtcttattggacactgtctctttcgactagtacagtcttctatctagtacactactactcactaaggtacgttctaaaactgataacatgccacggatctcaactcattttcctatagattcgaacttcctagacaaagacctacgacctaaacccttcgccttataacccccccccaataatataacctaagggggggcagaactcctactgtg

SEQ ID NO: 618925 - DNA, 550 bp, Homo sapiens
  misc_feature (1)..(1): n is a, c, g, or t
  misc_feature (69)..(71): n is a, c, g, or t
  misc_feature (75)..(75): n is a, c, g, or t
  misc_feature (110)..(110): n is a, c, g, or t
  misc_feature (115)..(115): n is a, c, g, or t
  misc_feature (123)..(123): n is a, c, g, or t
  misc_feature (224)..(224): n is a, c, g, or t
  misc_feature (256)..(256): n is a, c, g, or t
  misc_feature (374)..(374): n is a, c, g, or t
ntccggacgcagagctccaccgctgaggccgacgaggccagctctttatttgtggcgtttaaaggccgnnngttnggggaggacagggcgcttgcatatattaagcacangttcngaacgcancatctttccaggggcttccctactagctcagccccataaagtcactgggttcctccatctggaccagcagccacaccagccaaggcgcccactgggtgtcngaggggggggatgtcaatccccgtggccttcntcaggaggggggagctggccaaaaagagagcgggacagttctggccactgagcaaatgcttccactctgcgcgcaatatcagtgcaacgcctgggccgaaggcggcagttactgtccngagcaggggtcacgtgtcaggagcagagagtgaaatgctgaaacccatgttttcatagaacatcatttcacactcaggtgggcaaagctgacaaacatatgcagctggtcatggcaaagcaacctgggaagctgagtgggctggggtcttaaaatattttcagagagagagaatat

SEQ ID NO: 618926 - DNA, 107 bp, Homo sapiens
aacgtggaaactgatgtggccactgaaagaaattcaagactactgaaacaagtgcatgatttcacattttcagactcgtgtttacttatgaacaataacattgcaga

SEQ ID NO: 618927 - DNA, 519 bp, Homo sapiens
ttactacactgggcccagtctgcggagggtggcaccccagaaagtgccttgtgtatcagaggcgagtagatggagggcaggagtgggggaaaaggagacatggagaaggctgtgggcgagaagaaggccagggtctgtggaaagtagaaggaatagcgggaaagcatccagtccgggactcagattcgaatccgggcttggctacatacgtaccggggtgaggctcttaaagcctcagtgacctcatcggtgaagggggggggagaggggacgggacatttacagcccttttctccctccctggcccacaagtacggtgccccagcagtggcacccgggtcagccccggccagctcgggagcggtcatcatctctccctcttatgcctcttcaggggagggtggccaggctccccgggaccttgtctaccggccggcagcccgggagctcctagacgcccctgaacacttccgtgtgcggcaggggggccacaacccactgggcaactcctctctgagc

SEQ ID NO: 618928 - DNA, 209 bp, Homo sapiens
catacccactcccactccaggagtatgggtatcattctagaagtgtctgtcactacataagcattttcattcaaacacacacacacacacacacacacacacacacacacacacacacagacacacagacacatacgcttacgcgtacacacctatactcgtacacacacacacacacacacacgcgcctggagtggtatctagaatag

SEQ ID NO: 618929 - DNA, 107 bp, Homo sapiens
tgtgaacccccagtaaacctgaaggtgtttgagggaaaaactgctattttttgaatgaaacgtgccctcctattgatgtattaaaatgtttaaaataaaggtcatgt

SEQ ID NO: 618930 - DNA, 238 bp, Homo sapiens
aagtctggcttcttctcctcttggtcctcctgcccacagacgcctcagtctctggaagggaaccactggaagggctgtgttcttctgagctaccatgaatgagacagtgactgtgaggtgcgttcctttgagagtctgttccgaaggggaccagggagcacgtctttcactgagcctgtgaggcggatgtgagtactccactgtgtacgccttcgctgtcccagtttggggtatctgc

SEQ ID NO: 618931 - DNA, 901 bp, Homo sapiens
gacgcgtgggtcgcccacgcgtcgcgatcagtgggtgaccgcggcttgcgaagggactgtgtcatccgtcctccaggatctggggagaagggagccccatcccttctctctctgccaccatattcggacagcctgtaggaactcgtgtgggatcgcactgagcttcaaggaaggacgcgaacccttctctgaccccagtcgggcgtcacctgttttgccgcgtgacccttctctcatgaccctgcggtgcttgagccctccggaatggcggggaagggacgcggacccagtgggggaccgcggggtctgtggaggagccatcccccgcaaggcggcgctgtctggctgagggcccctgcggggagctcggtcagacaggagtggtactggggaagtcatgcacgtgtaaatgatggccaaggagaatttaaaagaggccccagaatggaagcttcttgatcagagatagctcgcattcaggactacctactaacaatatctgtgaagccacatcagctggacctaactaatcttacgaattcgaattaccaaagagggaaaatttcagatggacctctatcatatgtgtcaaatcccacgcttgaaccaattggagcaggtgtggtttccatcatgatcgaggtactagtgttcagatgtgcagaggataaccggacgggtccagaaagcccccggaacggcacggggtccccctttatgtgaccaaagcggtcgtaacttcagcccacatctctgccgcaatctctgtgggctcaccattaaccagtgttccggtggccatcttggggactgccttacccaaggacagactagaagattcttgggagcatattcagttccaggtaataatgttcacattgttaaactgtcctcacataaa

SEQ ID NO: 618932 - DNA, 152 bp, Homo sapiens
catcatcaagttcgctgaccactgagtctgccatgaagaagatgaagacacaacacacttgtgttcattgtggatgtaaagccaaacaagcaccagattaacaggctgtgaagaagctgtatgacattgatgtggccattcatacgcctccg

SEQ ID NO: 618933 - DNA, 89 bp, Homo sapiens
  misc_feature (46)..(46): n is a, c, g, or t
tttcaacaagatttgaaccctccctgtgtgcacgtgcgcgcgtggnaatgcttttccccatctttagggtgagaccggactaaaaaaaa

SEQ ID NO: 618934 - DNA, 423 bp, Homo sapiens
acagagcgatggctgttctggaggcctggctccggggccgacccgaggccacagtgtctacggagcagaccggacttgagtgaccggctgcggtctccacgagggatggaagggtctaagacagtacaacatcagcgccatgcaggtgagctccgtgtgccagcgctgcagtcaggccctgaaactggacacgagtttgaagatcctggaccgtgtgaccatccatgaactcacagctccattacttaccacaggccacgcgaaaccaggagagacccaacaggacgagactaactcatgagaggagccatttattgaaactactggccaggatggtgtctctcgcagattcatcctcacagccaggatgatgtccacaggtgcccagcttgactctgattggggaggcatctgtggcggccc

SEQ ID NO: 618935 - DNA, 505 bp, Homo sapiens
tgcatgagggtgtatacttgtaatcccaggtctgagggaagccaagacagaagaggatttattctcaggcaacccagtgagatcctgacacctgcaagccaaaaaaaaaaagaaagaaagaaagaaagagaagggctgtggacgtggctctggtgctcccttgcctccgtaaggctctgggtgcactgttctagcacccagcacaaggcctgacacctgagctcaatctgtgcaaaccatgggagagagggagaaaacagcccgtgttggctgtccgctgagctccccaagggtagcactcatacatacctgcatgcatgcataaagacacacatgcacttataaaagtatcttaaaagaacatggttgaacttaaaaaaagattattattgggaaccaacaagacggcttagtgggcaaatgctctggctttgaagccggatgacctgaacttaatcctttgactaacaggatggatagagggagagaaatgactttcacacag

SEQ ID NO: 618936 - DNA, 1190 bp, Homo sapiens
ttcaaccccgacacgcctattggccaacaatgaagtgggataacctgtatactttcaccattctatcttactctattagtctcggactctcattccaagaggagctgctgcttctccgttctgaagacaatgcaacacaacagacgctgacgcgcttgactcaaatcagagctttaacacagatttatcgtgcaacgacacggacacacacttctcacacaaagacccccattggggactcagctacgacctctggccatttctaggcgcttccagaacaatcgttatcactggccaacgactgagtcccaaatatatcgcccaccgaattcacactgcgtcccccacgcttctaagagtggcaaattggcacacgctacaacgattgcgacaattctctagaccacacacacgccccaattgcgtccatacctgccctgtcacctcgcacgaatcaacacactctgcacacacacactctggattgacaaaccacaccacatccccacccgtataccaacataccgccccccttgaaccaacccatggtgtaaccgcaaccctacaccaactcttccaccttaggcccacgcccaccgtacagtcagaccaacaaaacacttacgtatttcccggagcattcgaacccacaaccccccattaaacttgggcgctagcccaccaaaagttgggcgcgcgctcgacacccctcggtcaacttggtattgtcaaaccacgagaacaagcaaaggccaaccagcacccatatgagcccgccacgcgcaccaacagttggcaaccacttgggtccattatacccctcagcgcgcgaaccacaaacacaaacacaacgcaacatttgcatccccaaaccgcccccgaacacaaccaccgcgtatcacccaccacccgggacacaatcggggacctggtgcaagagaaatcccatacaagtaacgtcgacaattatgagcaactatgagtctgcgaccccacagacttagcccaaccccctctgcgacactcattatccacccccagttcgggacaccccacaacatcgaccacacactcacgcgcacccccacactcctcaccagcctgggacccaccacaacacactagcatatccacccatctctcacgataactctggaacaacaacaaatataaaggtcccccacaaccca

SEQ ID NO: 618937 - DNA, 360 bp, Homo sapiens
tgatcactcctcccatgcagctcatcccctccatcaaacgtactgagcaccccggaaattactggccccatgtcgtctctctctcctttaccaagacagctgctgaggctgctgctatgacaggtctacctgcccctctctggcctctgtctagctttaacacataatgtgcctaccccaggtagtcagtatctggccccctcccatctcttagccaagcagagcagctatgcaagaaagcacaatccacagactggtcctgtactctaggagcttaagcctcattgagcatgcataacctcaactcaagacataagggccctgctctgtaataaccaggaggccgcaggttgagtgcct

SEQ ID NO: 618938 - DNA, 1241 bp, Homo sapiens
aataggaggtcaagagccagggaatgcccgagccagatcctgtcctggatctctgttatatagcctatcttcctgaccatgctgtagaacataggcgatattagcatatctgtgaaatgtaactcaatttgagttgcgcagggtcggtataaatataatatatatactatctggtattactagaatttatggtagggtatttgagggtagtgtagtagtagtagttttgtagtagtcgtgctggttgctgatgctgctagatgtgcatgatgatagatagataacgcagggatgccaactagttgcgccatgctgtctgtatgaaggttatcaatgctatcatacccggtgtcgtcattcgtacatcatcctgtgtgtcggacttaatacctacacatcctttgggtgggggcgccaagcggtagggggctataacaatcgaaacgacgccttgtataggccgagaggagcgtagacatccacacagtggagtcgtggcagcacacatactcaatgccgcccaacaccacaccatgaagagggaggttttatcactccattgacaggatctgtcaccaaatataactcgtcggtacaaattcaccaaaattttggtgggcgaccagatatcatagatagactagggttaccttaccggacggccagcaggcgaacatatcaactacccgtaggagctggaccaaccttagctgcacaccgacacttccttacgccataatccacaccgtatggcacacgcaaatatgaacagagctgcggccagcggctctggctagggcaacacgattttaccagtaccccaaccaaactaaactacaaccgttgtgcgggacacatgtatcgggctaggacagggcgtcccatcccaataataccaacaccgtcctattacgtttcacacaccagagcacggctttacatttagcgagtgccgaccaccacttcacgatgggggatcgacacacatcccgccctaactatacgagcgcggaggatcgctacatgtaagagtggcgcgctgcctttgtaaagctaatcttgtccaaacgaaccccgctgtagcatcttgtcgttactacacacagaagcagcagcctgaatagacttagtcatttgcactcaggcagccctaacgattgggtacacataaccacacacgtcagtgcggcatgacgcggactcgcccacgtgagtacaacacacagacagctgtcttcgtc

SEQ ID NO: 618939 - DNA, 434 bp, Homo sapiens
tggacagcaacacaaaaacagcccaatacacctaacgaattcccagccctccatgaagattctctaactacaagatcagctttcctggatcctccctggtggccctctacccagcccttataacacagactaagagaggcgtctgcagcctccagttttatctcacacctggtctttgcatgagcatgtttcagtaacacatgtgggcacacacacaggtagtgagtagccacgcagtagttagttcagaaaacggtcttattgtagagggaaatagagggaaaattctttgatataataatattcatctcagaagttatggctctcctatcaaaatccaaagctgccagcacaactgaacctaccacagcggtggcagaaagaaggctcttggcactgtagacctatttggcagaatgtacactggctgaaag

SEQ ID NO: 618940 - DNA, 846 bp, Homo sapiens
  misc_feature (93)..(93): n is a, c, g, or t
  misc_feature (133)..(134): n is a, c, g, or t
  misc_feature (170)..(170): n is a, c, g, or t
  misc_feature (199)..(199): n is a, c, g, or t
  misc_feature (229)..(229): n is a, c, g, or t
  misc_feature (237)..(237): n is a, c, g, or t
  misc_feature (275)..(275): n is a, c, g, or t
  misc_feature (286)..(286): n is a, c, g, or t
  misc_feature (309)..(310): n is a, c, g, or t
  misc_feature (338)..(338): n is a, c, g, or t
  misc_feature (452)..(453): n is a, c, g, or t
  misc_feature (459)..(459): n is a, c, g, or t
  misc_feature (501)..(501): n is a, c, g, or t
  misc_feature (536)..(536): n is a, c, g, or t
  misc_feature (567)..(568): n is a, c, g, or t
  misc_feature (599)..(599): n is a, c, g, or t
  misc_feature (675)..(675): n is a, c, g, or t
  misc_feature (687)..(687): n is a, c, g, or t
  misc_feature (697)..(697): n is a, c, g, or t
  misc_feature (710)..(710): n is a, c, g, or t
  misc_feature (713)..(713): n is a, c, g, or t
  misc_feature (715)..(715): n is a, c, g, or t
  misc_feature (752)..(752): n is a, c, g, or t
  misc_feature (768)..(768): n is a, c, g, or t
  misc_feature (771)..(771): n is a, c, g, or t
  misc_feature (795)..(795): n is a, c, g, or t
  misc_feature (803)..(803): n is a, c, g, or t
  misc_feature (806)..(806): n is a, c, g, or t
  misc_feature (828)..(828): n is a, c, g, or t
  misc_feature (831)..(831): n is a, c, g, or t
  misc_feature (834)..(834): n is a, c, g, or t
ggcggacgtcacgtcactgccatcgctgtcttcatccggcctgtcgccatccaccaactgcactcaggatcagcttgctaaagcccagcagcngaaggagaagcagccaatcagaaaagaactgggaggcaanncaacaggagagtgtggtgctgggaggatgagacagnatgagaaagccaaggacctggcatttcanaagagggattgtcttctaattgcttgaaancgcagttngccactcaccacacgttttatttaaatttaaattttanttaattgttancatttaaattctatgtagagacnngggtcttgctgtgctgcccaggcttcancagaaccacgagaatatcaggcggtgactctgatcctgtgattcattatgacattggcccagaggcaccctcgttaaactcaaagctgattgagtttaggaaactcaggggttnnctttanagctgtatgccggaaagttttcaggtgtgctggatctggaancccaagtcgctgagggagtattctatacacaggtntcttgaattcagtgtccactctggagatttnnccactgctggcgtggctcaggagccctgtanaagagtcctgtgagcttctgctttatcgcatctggcagtctctccgccttctagagccctcatggtggtcctgtcnaatatcctaatngatgcgctgntccgccttctggnctncntgaccttgttttagaaggtgagaagcccagatgtganttctaaatgtgttttnatncccatgtgttcctgatagaaaacntaacaganttnaacactaagacatttaaatggnggngtngagtataccaag

SEQ ID NO: 618941 - DNA, 95 bp, Homo sapiens
ggggaaaattttaaatttagggggttttttttttttaaaaaaaaaaccccatggttataaaaaaaaaaagaataaataggttcggttggccctga

SEQ ID NO: 618942 - DNA, 297 bp, Homo sapiens
  misc_feature (24)..(24): n is a, c, g, or t
ccccccccttccggggtgggtccncgggggtccttttttcttttttgccagctccccgtgggccaaggcgggggggccccgggggaggttttttttttttcccttttggtttggggttttgccccccccttccccccggagggcctttcccctttcccgggttttttggtggggcgggcgggcggcccccccttcccggggtttttcggttgccccgggatttttgggccggtccccgttttttttttttcccgggcccccgggtgggattttagcccccccccctgccctggggga

SEQ ID NO: 618943 - DNA, 154 bp, Homo sapiens
  misc_feature (3)..(3): n is a, c, g, or t
ttntattgtggtgttaccgtatagtagaatatacggctgtgattagtactgatcagacaaacaggggtgtttggtattgagacattgcgggaggttttatgttaataattgtggtaatgaaattaatagcccctaggattgatgatacacctgc

SEQ ID NO: 618944 - DNA, 166 bp, Homo sapiens
ggatccctcgacggacgcattcagtttcacctccaaagtatgacgtgtcctgcacaaattctcccaggatttttcccacggaacaggtgacgtgtctgatgttggctagggaagggacggtactacagtgtaaattgtgcccacttcagggatggcactacaaaga

SEQ ID NO: 618945 - DNA, 831 bp, Homo sapiens
gtttccttgcttggaaagctattgaagattgctatgtattaccactgcaaagtggtatgcatacgggtgaagaacaaggggagtagccaggctgggatggctcaaatagtaaatgaatgaggaatcctgttatgaagtatctagatcgatgatgttatgatattaagatgatgtaactatagcgaattaatgtaaaagggagagagatgtctgatagtgatcttatgtagagaggtacttgagaccgctctcttgattggcataaagttgctaaggcttatagtattcgccctcccttgaggtcgtatagtccaaggtgttttaacatgccaccgggttgtgccttattcgttccacttctaaattgtatcgtatcgattccactcgaagtactagtacttggtgagtgtgatagccaatcacaccagaatactcgagagaagagctgagagcatgtgttgagtcgcttgagacccagtgaggaaggattggtgcagccgagtctatttgagctccgaggcgctgcgcccaaatcgagaggtagcgaaaactctgttcttccaacgaggtgatcacccagagaggggaaagcgcgacggtaaagcgaagaagtgggtcgtagggaatcccccacatcgtttgtaaacaaaactccctcgctgcgtgggacaagacagagtggttctttgaaactagtatgccatccttgggactgcgtggaatgaacacttgacggcggagctctggtctcaacgggggagccccgcgacactcccgccaatttagaatttatcgccgtcgttgggggaaattctaattggtggttccaaa

SEQ ID NO: 618946 - DNA, 298 bp, Homo sapiens
cgatgtgccagggatgcatttttacagactcggtccacgctaccattctgggggcccacagtagaggtcacaagagaagcacctgcctcctgtctgtcacacacgcaactgcgctaggatgtgctgctggtgacccccaaggttcgccacatcagtatgtggtggccgtgttggcggcgccagtctcttgggtctcacagggtgggtatggagcacaccaaggtgacagtgccatgctgcacatcatcctgccctgagtcggcgatggtaactgtggcggtggtcttgtctgtagtcg

SEQ ID NO: 618947 - DNA, 591 bp, Homo sapiens
aaacctgatgttgccaagataaaatatttaaagaaatcaagcaaattaaaatgcaagaaggtaaattctaatctaaatcatgctcctttctgaattctacatcagctggattttcttttttttctttaaaaaagagtctctctctgttgcccagggtggagtgcagtggtctgatctcagctcaatggaacctctggctcctgagttcacgcgattctcctggctcagcctctcaagtagctgggactacaggcatgctaccatacccggctaatttttatatattttttagcagagacggggtttcactatgttggtcaggctggtcttgaactcctggccttgtgatccggccaccttaacctcccaaagtgctgggattacagggattagccatcacgcctaacctaacagactggactttcttcgtggctttcagtagcatcacaatccttaggcccccaaacacaatcattttctactaattgtgaattaccgaaagaacagcttactcctttctctaagaaaccgtaccccgagcttagacctttggttctacctctgggtatcaaactgtgactcctcctattt

SEQ ID NO: 618948 - DNA, 405 bp, Homo sapiens
gttgtgttttgtgataaggtgtttcttctgtcaccgtcgctggttttatttgtgcatcatggctcactgcatgcctcaatgtccaagctctatcgatcctctcaccttagcctctctcgcagctgggaccacagctgcatgccaccatgcctggctaattttgggtactatgtgtagagacagggttttgctatgttgctcaagctggtctcgaactcctggactcaactgatcctcttgccttggtgtcccaaagcgctgggattataggcgtgaaccactgtgcctggcctttcatacattaagtgaggtttggggcagggcacagtggctcatgcctgtaatctcagcgccttgggaggccaaggcaggaggatcgtttgaggtcaggagttcgagacctgc

SEQ ID NO: 618949 - DNA, 936 bp, Homo sapiens
  misc_feature (355)..(355): n is a, c, g, or t
  misc_feature (419)..(419): n is a, c, g, or t
gcggaaaacttaggctaggtacgaggctgggtggtgcgtacttcgacacctacgacgatcgggcctacagcagtccttcgtgcggcggcagagggtcccgcgtcagtgctggtgagccatggttcccgtagccatggaaggagttgcccatcagagcccccctacacagcatacgtacggacatctacctttcaatagcggttgcagggcgcacatagatgctatctttaaggagtctcacgcgataagggagtggtacggcatagatcagcacggacgaacagacagcagaataaactctataaaaggacttcgtgcgtatgtaatcaaatctcgaatgaaaggtaggacttcncctgttagagtgaacgccgttggacattacgaatggatcgcactagtgtaggcgcgactcgggntcgacctctccgtgggtgagactacttgccaggacatggcgagcaacacatacgaacgcagttaaacggtgggctttcgcggcacttccagtaaccagaaggtcggcaccacgattgaccacggaagcgaatgggtaagcgtctcgcacgaaatctcagcaggtgggatcgggaattccccggggatgacttcaattctggcttcagggaatgacttcttagggtggcagcgggagtgtagtcgcccagagcgagccgtgcgacacaggtgccccccccatggagcatgccgcttcaggagattggccgctccgcctccggtggagtcccacatggatttcaggagaaaccccgcaggaaggaggaacgcagcacagagagacacgactcccggcttaaaagcttcgaacagttgacgaaggcccctcaatccatgtaggccactcccacgtcgggatcttccggggaggccggcaccaaaaaaaggtccttcaaaggacaaaaacccgcgaggggg

SEQ ID NO: 618950 - DNA, 1410 bp, Homo sapiens
tcctaaaaaaaaatgtgaaataagggattcctaaatgaaaaaaaaaaaaaaaaaaaaaaaaaaaaaaaaaaaaaaaaaaaaaaaaaaaaaaagagagggggcgcgcacacaaaaaatccccgcgcagggcgccaccacaacgagcgcgacgccaacgaagcaatatcagtggcagacaacagtgaggccccacacaagagagagaggcacataactatacaacgccgcccgcgcgagcgccgcgcgcccgacgccacctaaataacaaacagcggacaaagagagaggaggaaaaatacgaagcgaaaccacgccggacacaccacacaggacacgaaaagaaacacaacaaaaaacagagagagaggagagcgacgacacaaaccacacggcgcgcgcacccacaaccaacacccacccacacacgacgaatataaacgacgacaacacgacagaggggacaaacaacaaaccacaaccaaaagagaacagcgatccataagtgcggggcacaccaacaaaccacacgaagcaaatgccccacgcacagcagcaggaaaaaaaacagcccgcaccccacgcagacgtacatatccatctactaaacccgcacaccatcatttttatatataagaggagagagagcgcactacgtcaccataaaaaaacgacgcacacacaaagacaagaacgagaacaaaaacgacagaacaaccaacagagcaaacagcaaacagacacaagcaacagaacagccagaaaacacacaccaaacccacacaacgaaaaaaagaaaatgaagaagacaagagagaaccagagcagccacaaggaaaagacaaacagaagagagcaaaaacagccgaaaaaacagcagaaagaaagacaacacaaggaaaaacaacacacgagacgcgaagcaaaaggaagaatacaaaaaaagacaaccggcaagcaagacagacacgcaagagaagagcagggggagcgaaagaagagaaggcaagaggaaacaacaaaaacaaggagaaagaggaccgcaagaccgaaagaggccaagagcagacagacagacgaagaaaagaaaccacaaagaacagggagcgagggaaaaaaccgagcaaaaagaagaacaaagagagagagaaggaacaggagagaaaggaggacaaacacaaaaaggaaccgcaactgcgacaaaagagccgaatacaaccatcaccaggacaaacagagccaagcgaacgaagtcaaagcaaagacaggggcaaggacaacacgccgacaggaggaacaaaggaagtaagaaaggagccgaagacgaccgagaaagaaccgaggaggaggacgaggccacgaagcgctagcaggagggcgaacgtagcagaggcgacacgacggaggaccgtc

SEQ ID NO: 618951 - DNA, 225 bp, Homo sapiens
gggggggaaaaaaaaaaggggttttccctgggccctccccccccccctttttttaagggccccccctttttttttttgggggtgcccccccccttttggggggaggggggggggggggggggccttccccggctttttttttctttttggggggggggggggggggggggccccccccccccccccccccccccttttttttttttttaagggggggggggttta

SEQ ID NO: 618952 - DNA, 329 bp, Homo sapiens
ttttttttttttgggagtaagatcagagagaaatttctcctctgggtcctgatgatattacctgatataatggatagtacttgatatggcagacactgtcctcaagagtgtccatacaatcaatgcaacattttattgcttacagcatatgccaatttgagccaagggcacactaccaaagttcaattaagaaaaaacaattatgtaaaggaacaaagtactactgtgcaagtacacaattgtctgacattctgacttaatccagagatgaaatccaaaatatctgcagccataattcttaaaaactatatgtatgtcagaattttatc

SEQ ID NO: 618953 - DNA, 408 bp, Homo sapiens
  misc_feature (10)..(10): n is a, c, g, or t
gctggtgacntacaggatccgcacaggtcacaggattctcctttcttctgaaggtttacgatgcattgttatcagttaaccacgtcttgttactactagatcgtacatggtcaattgaaacaaaccgttctgagaccgttcttccaccactgattacgagtggggtggccggtcttagggatcctattcatctagccttctgagctttctgggcacgacttggtgatcttgccacgctccacgcagccttcttgttccacctgctttgactggccccccgcacctgtctgtctcatactcacgaccacgcacacgcgaccccacggtggatagtctgcgacgctctcaacctccctgggcttgccaggacccactatacacactggcagcatctcccgaccttcaaga

SEQ ID NO: 618954 - DNA, 275 bp, Homo sapiens
  misc_feature (246)..(246): n is a, c, g, or t
  misc_feature (250)..(250): n is a, c, g, or t
ggccaggcgccggtggttcacgcctataatcccaccactttgggaggccgaggcaggcggatcacaagatcaagataccgagaccatcctggccaacatggtgaaatctcgtctctactaaaaatacaaaaattagctggacgtggtgcatgcgcctgtagtcccagctactcagggggctgaggcagcagagtcgcttgaactcacgaggcggaggttgcagtgatgtgtcacgccactgtactncacngtgacggcagagcgagactccatct

SEQ ID NO: 618955 - DNA, 745 bp, Homo sapiens
tggaaaaaggtcagggaggccagggggtgggcttgaaaccagcttgggggggtatcgatcccttcctttttggtgctaaattttatggtatacgggttcttcgaatgtgtggtaggggggggggctatccatatagtcaccccaggttaatgggaggggttcttctactaattaggacttttcggcttcgaacgcaggaagggcttctcaaatcatggaaaatttattaatattactggcgtggttagaagaaatgagaatggacgcctacagatagataggatggttccatggtgggtgggtatggcatcgggggtagcccgagtaaacgtcggggctatcccgggataaggccgaaaaaggtgtcggggggaagcaaagttagatttacgccgatgaatatgatcagggcaaagggatttgggcgtaaggttgggtctaagggggtacgccggagaataggggaaaccagtgaatgaagccccctatgagggcaaatacagcccctaatggatgggacactaggggaagtggagctacaagcgtagctacgtcgtcgcggtaccaacgaaggctctaagggagagagtcggctaaatacaaggccagtcagggccacctacgggtggaacacgaaagatgaatcctaaggggccaaagcatggcgaagactcattcaaattcggcccggggagtgagagagacagcaaaactagagccgggggaaacggaaaaaggaccggga

SEQ ID NO: 618956 - DNA, 120 bp, Homo sapiens
tcatcgagctcggccccactttatatccaccattcaaatactcctttgtgtagttctttgtactaaaaataaaatatcccttgcttgcacaaggccttgttgcagcaagggatatttagt

SEQ ID NO: 618957 - DNA, 688 bp, Homo sapiens
  misc_feature (23)..(23): n is a, c, g, or t
  misc_feature (145)..(145): n is a, c, g, or t
  misc_feature (192)..(192): n is a, c, g, or t
  misc_feature (227)..(227): n is a, c, g, or t
  misc_feature (239)..(239): n is a, c, g, or t
  misc_feature (243)..(243): n is a, c, g, or t
  misc_feature (248)..(248): n is a, c, g, or t
  misc_feature (253)..(254): n is a, c, g, or t
  misc_feature (258)..(259): n is a, c, g, or t
  misc_feature (261)..(261): n is a, c, g, or t
  misc_feature (290)..(290): n is a, c, g, or t
  misc_feature (302)..(302): n is a, c, g, or t
  misc_feature (307)..(307): n is a, c, g, or t
  misc_feature (311)..(311): n is a, c, g, or t
  misc_feature (343)..(343): n is a, c, g, or t
  misc_feature (345)..(346): n is a, c, g, or t
  misc_feature (350)..(350): n is a, c, g, or t
  misc_feature (405)..(405): n is a, c, g, or t
  misc_feature (433)..(433): n is a, c, g, or t
  misc_feature (468)..(468): n is a, c, g, or t
  misc_feature (472)..(472): n is a, c, g, or t
  misc_feature (684)..(684): n is a, c, g, or t
agttaaattagcatatctcggtngtgaaggttgacttttaataaagcaaaataatgagttaggtgaatcaacagaaagagtgaaaagtgttaacagtgacatttaaatggttacatgattttaattattcttttgataataagcnaccttgtgatatctattcaagaaaagccagagcccactatggaattngcagttgaataagagctttgttccctgcttttggnaatgttaaaganacanatggnaatgnnttanngnccttataccactcccccacctagcaaaanactctaaaaggngaggngggnagcattagaaagagagtgagaagggaaatggnanngggngtcacacgcagcattgggtttatttgggagagagggcaagagagaatgaggtgtnggtgagagaaggtgctggtaggtcagcngatgccaatcccttccttatctgttcttggctgcnaggngtttccggctgatctttttcgatttgtcattattcttcttcggtggttctgggttggcctgcatgtgtctgcgcgtagaggtatttgtatgtctcagaacggatatactcaaaaacatgggacacgccaagctggaactggtctgcaatgggggtcacccagggattgttctctgctttgaatacctgcttctggccagttaaatccaagtntcct

SEQ ID NO: 618958 - DNA, 771 bp, Homo sapiens
  misc_feature (771)..(771): n is a, c, g, or t
ctgaacactgtcggggccccggcgacaccagtgacccactgcagacagatctgcaagatcctcaatgcgcacatggactcactgcagtggatcgaccagaactcggccctgctgcagaggaaggtggatggaggtgaccaaggtgtgcgagggccgtgagcaaggagcaggagcgcagcttcctggatcacctttgactgagcgacagcagccctggggcccgcaggtccctaggtgagttcatgaggggaatgcgccctgattgtctgtagtaaggggtttgtggcaagatacttgttgtatacttacttatctattcacatgacatgcccttgaccatgatcgcatgtgtgctattgcagtaaatccatttaggagggtattctgggccttctgcccaggcagcagcctcatgggtgatggcttcatgtggctttcattttgagtatctttggcacccttttcacctactgacgaccaacgcacatcatcctggctcagacctggtgatggagaaggtgctgatggtcttggaacccaggccagggtcaatggttggcggacactcatctccacagcatagtacataggtgtcatgaaaaagtaccaaaatgtaagagcaaccgtccaagtcaggggcgcagtaggctcacgcctgtaatctcagaacttagggtgcacaaggcggacacgatgactatgaggtcaggagatacagagaccaggctaggccaacatggtgaaacaccggctctctaaaacatacacagn

SEQ ID NO: 618959 - DNA, 131 bp, Homo sapiens
  misc_feature (26)..(26): n is a, c, g, or t
  misc_feature (86)..(86): n is a, c, g, or t
tacaacgggaagtaaaatctgtcganatgcaccatgaagctttgaatgaaactcttcctgaggacaatgtgggctacaatgtcaanaaatgtgtctgtcaaggatgttcgtcgtggcaacgttgctggtga

SEQ ID NO: 618960 - DNA, 166 bp, Homo sapiens
atccccccccccaaaaattttttggccttaaacccagggggggtttgggtttttggaccccgtttttaaaaccccgggggcccccccccagggaaaaaaaaaattggggtttttttccccccccttttcccccggggtttggggaaaaaaaaggccccctttggga

SEQ ID NO: 618961 - DNA, 212 bp, Homo sapiens
  misc_feature (158)..(158): n is a, c, g, or t
  misc_feature (168)..(168): n is a, c, g, or t
aggtcctgggccttgatgggctctgagctcgtgctgtttgtgctacttgaccctccaagtgtagcactgatgattagacaatgactagtaccatgctcatctctattcattttttggcatggatatattcaccattgatgtaatcacttattattatngtcactgtgnttctcctccatatcattaattctgatgggcaggactttgttcaa

SEQ ID NO: 618962 - DNA, 115 bp, Homo sapiens
gtccattcttgcatgggggacctggaagagcggacctatatgcttatgcaagctgtgcagtgcatccacagcactcactcctttgtgtcccatcagaattctcttaaaatcactc

SEQ ID NO: 618963 - DNA, 285 bp, Homo sapiens
  misc_feature (14)..(14): n is a, c, g, or t
acccggtctctcgntactctgtctctctctgttctctgtctctctctgttttctgtctctgttctccgtatctctctgtcctttctctgtctctcccctgggcctgggcccctccaccccttcaccccacgtgctgctcatctctgtctctcttgtccttttccgggccctggcctcttccccagctcagcctgcaggaggcccgtctcctgcacccctccccgtcctccatcctttctggtcccccatctcctccagctctctgcatcctccatctgctggtcc

SEQ ID NO: 618964 - DNA, 202 bp, Homo sapiens
ataccctgtgtcgatgacagcgaactcatcgtctcttataggctgaactggtattccatttcgtatatgtactatattttctttattcattcatctctagatggatacttaggtcgattccaaatttgggctatggtgagtagtgctgaaataaacatggagtgcagatatctctctgatatactatgtcctttctttgggt

SEQ ID NO: 618965 - DNA, 208 bp, Homo sapiens
ctgctccacttggtgccaggagtcgagaccagcctgggcacgtggggatataccgtctctgcaaaaatttagaaaggtgggtcgggcatggtggcttgtccctgtggtctcggctgctggggaggctgaggtgggaggatcgcttgagcctgggaatctgaggcaacagtgggctataattgtgccactgaattctagcctgggtgac

SEQ ID NO: 618966 - DNA, 991 bp, Homo sapiens
gctccggtccaggcttgcttctgcaacaggcgtgtctcacgctctcgctcggtctttctgccgccatcttggttccgcgtaccctgtacgaaatgcccggcgaagccataggagaccggtcgccatgttgacagatgtcaggagtttgcccggaggcccaggcctgacgacaggggtctggtcaagacgcagatcgtgacagtgattgatagtcacggtaccagagtattgaagaaagaggattcctgcctcgaggcgaaacacaacgaagcaagcccggttggtgggagcaacatgaaattggatggatggaaccagtcgagttaagatgcaaaaagcagagtcggagtgatctagcaatgcccggagggctgatgtgtcgaaacctgtggttcttgcgactgggcttccctgtgacgtgactagacgtcacgaatccggacactccgaagaatttcctctaggtctatccaggaaggcatgagtgtctacgagaagaccctgaatggagatactttagttagtcctgggggggagagccacgatcgaagtaggttagttccgaggcacagtactggatagacaagtgctgggaaactcaggggtccaggtgaagcgcctgtcggtcggacattgctggataatcctggactccagctgtacactgagcgagacgtgcagacggccagtaaggtcgtgtgcaatgctgtgtcacaacgtctaggacttgcactgggtcatgtctaagcacatgtgtccagagcaggaggtccgaagccttgaaaacacgtatgatctggaacgcgctctggatacacaggtccttgtggaccagcttctgggggtccaaagcgctgcgctgttgaactgtccggtccacgcacacgttggttgttggacgcgaacacaaaattgcgggggcaaaaataaacgggggcgcgcaaaaagatgtcaagccgaaggccacaaacggggggcacgtagatgtcga

SEQ ID NO: 618967 - DNA, 1380 bp, Homo sapiens
  misc_feature (1380)..(1380): n is a, c, g, or t
ctaaaaagcaaagacctgcaggccatgtggtcatgtctcaaaatcttattcatgttgcagatactgaggccttacataagggtttgacataccgtcgagattttgcgtgcacttcagttgttgggcactctcattgatgggagtcatccacttctcgtggtatacacaagatttacgaacatatataagttgttctgagttgtgaaccctagacacacgcagtcgtctacctggagtactatatcgagagaatccttgcaatcacaaacagtccagcccatcgtaggtgattcttagatcatgcgtagtagcacagcatgcaagcatttcaagtagcaccttctcatattacaccgtgtacctgtgcgccgttacccttcaccggcaatacatcgtcgtggtatagtcagtgcttgttaggtctgatcagttcagcacattcactgggaaccactacctgctcgtaaatacagatactcgatcgtcgttcacagcatccatctggtcgttcagtgcgcttgtgaattgtgtacatgttccaatacgtttaacttcgtgtatgtcctgtgaagcggtcatacgcaaccacacacattcacaatttcgaaacaccaaaacctggcgggttccaacccaagaggtagcgcgcgcgcacacggggggcacacggggcagcagcaacatcaattcgtctgggggcgtttataaccatcgtctctgccttaagaggcgagtacaaaactattgcgctagataacaaaattctaccgagggcaactaaacgctcaggcctaatacaagcgcgcgggtgaacacagcagagtatcacagagaagactctaccctagcaggcattttacacaggcggccccttataaacatatgagcgcttctaggtcgccaccctttggcaaccacagtcaaaacgatttaccgtattttggaaacccaagcacggcccagttcacttcgggcgtagtggggttattaaactcttacagcggcttcaaaccctctcaacaaacggcttatctcggccaactttacacggcggaaatttggggtgacaaaacacattcggttccatccggacatgaacggataatttgtcccaaatattcgcccttagaaagggggtgatggagaaaccccacagaatattaagctccgatttatgagcgaacttgctacacaaccaggcggcccaaacacatgcgagactatccgtgcggggacaaggaagcccactcatatagactgcttccccatgtcgctgtgccattggattttaatatcaactgtagcccctgccaagctgtcatacatctccaggagaacacaatacacagctttgtcatcgtatccgcgagaaagacgcgn

SEQ ID NO: 618968 - DNA, 311 bp, Homo sapiens
  misc_feature (24)..(24): n is a, c, g, or t
ggggggttttcccccgggtaaaanggggcagggggggggaaaaatttttttgtcccccaccccctttttcccccgtggggaaaaggaaggggcaatataaaaagggctttttttggaaaaagcggggataaataaaccctgttgggcccccccggttttcccgggaattttggggggggggggggttttttttccccttttggggggggtggggacctttttttttctgttttggtcccggggccccgggaaatttccttttcccttttttgggaaattttttttgaaaaaaaaggggggggggttcccca

SEQ ID NO: 618969 - DNA, 233 bp, Homo sapiens
caaatcatcaacttatttataaggtaaatgatggggcttagcgtctataaactctggaagaagttctatgtgtacagtctaagacacttgtggattgattggctgggaaatcacattctccaataaggggcagccagggcctgcttaacagtgctgggagagggccgccagcataaggaccatcagcaacttcatggtgaggctgctgctatcgatgtagcaggcgtatgaag

SEQ ID NO: 618970 - DNA, 173 bp, Homo sapiens
acccccccccccccccccccaaatttttttggggggttttaggggggacccccgttccccccttgggaagggggggggtttttttttaaaacccccccttttttcccctgccccaaattgggggtaaccccatggctgtgcccccgggggggaatttaacttttttttttcca

SEQ ID NO: 618971 - DNA, 440 bp, Homo sapiens
ctgggctgtggacgacggggcgcttccacttcattgagggctttaatgccgagaacagcaatgtggatgcgctatgtgaatccagcacactctcgccgggagcaaaagctggttgcgtgtccgagacgggatgaacatctacttctacaccattaagcccatcccggccacacaggaacttcttgtgtggtatggtcgggactttgcagaaaggcttcactcaccttgatcccggagaggtgagaatgatgatgtctcagagaaacacagagccagtctatagcaaccgagcacggagaaacatgaactctgcccaaagaaggtcccaaagagagagtcgagtgtgcaagacatcctagacttggactccaacccctccaaaggcacggcactctaccgttctaacattccacccctcagatccgaaccggccctcgatg

SEQ ID NO: 618972 - DNA, 296 bp, Homo sapiens
cctgcagccactgtaggacaccggaggctcctcctctcagtgattggggatgggccgtcctgcgccgggaaccgcccaccttcgggatggtccgggcctgcccagagtctggtctaaacgcaggacctgcatgaattttcagtctgggaggtggggcaggaccacggagaagtctcgaagaagtggaggaagcactcactggcttccgcgggaaaagttcacccagcaactgtatcagctttacattagaccctcctttgctgcatggcaaaaagaaattaaattcccatttctta

SEQ ID NO: 618973 - DNA, 249 bp, Homo sapiens
  misc_feature (22)..(22): n is a, c, g, or t
  misc_feature (24)..(24): n is a, c, g, or t
  misc_feature (149)..(149): n is a, c, g, or t
gagacagggtcatcttgctctntngcccaggctggagtgcagtggtgcaatcatagctcactgtagccttgacattcccagcacaagcaatcctcccacttcagcctcccaagtagctgggaccagaggtgtgtgccaccatgcctggntaatttttttttaaatttgttttaaatataggtaatatagcgtctccctaaattccaaattccaaagtgttgggattacaggcatgagctaccacacctg

SEQ ID NO: 618974 - DNA, 349 bp, Homo sapiens
  misc_feature (2)..(2): n is a, c, g, or t
  misc_feature (4)..(4): n is a, c, g, or t
  misc_feature (98)..(98): n is a, c, g, or t
  misc_feature (275)..(275): n is a, c, g, or t
  misc_feature (299)..(299): n is a, c, g, or t
tncngcagcccggccttcaccatgagcgtcccggccttcatcgatatcagcgaggaagaccaggctgctgaacttcgagcttatctgaaatcaaaagnagctgagctctcagaagaaaactcggaaggtggacttcatgtagatttagctcagattattgaagcctgtgatgtgtgtctgaaggaagatgataaagatgttgaaagtgtgatgaacagtgtggtgtccctccctgttgatcctggaaccagacaagcaaagaagcattgaattgnaaagtctgtgtgaaaagctggtcnaagtttccgggaaaggccgaaccccaatctcctggagacttaaagttgct

SEQ ID NO: 618975 - DNA, 225 bp, Homo sapiens
aatacaaatataaaatatggaacaatgctaacagacgctgaattaatccagactagaaaggaagggtctcgaatgcaacaaggcaacagcactgccacacaccttagggggcaagcacttcactcaggcttaaccaaattcttcagcatcatgccaggcatgacagcaacaatggcagcgaggccaaacagtgccctgcacaaaggcttgcagcttcgcgtgcac

SEQ ID NO: 618976 - DNA, 504 bp, Homo sapiens
tctctctacactgtatcatctatcataattcgacgttgctactgactatctagagaaatcgctcgtcgctcttcctccaagcctacgtaccacatgtactagtaagcctctacctcacgctccctcaccatggaccatatgaaataagaaattataacaaaccctgagaaccaaaatgaacgaaaatctgtatcgcttcattcattgcccccactatcctagagcctacccgactcgaaatactgatcattctatttccccctctattgctccccacctccaaatatctcatcaacaaccgaataatcaccacaccaaaataagactaatcaaactaacctcaaatacaactgatagccatacacaacagtaaaggacaaagctaatcccttacagtattcctcatcacccaactaaaacatattaaacacaaactaccaactacctccctcaacaaagcccataaaaatacaaaactataacaaaccctgagaaccaaaatga

SEQ ID NO: 618977 - DNA, 118 bp, Homo sapiens
  misc_feature (110)..(110): n is a, c, g, or t
atgtgtggtgatctagaggatcgcgggagtgcatggtgatgaggaaggaagaggtatatttataattacttgattttaacttattttaacttttatttgatattacatcntattcatg

SEQ ID NO: 618978 - DNA, 115 bp, Homo sapiens
aggcaggagaactgcttgaacccaggaggcggaggttgtagtgagccgagttggcgcgtcagagtgagactccgtctcaaaaataaaataaaatcaaatataaattagctgggga

SEQ ID NO: 618979 - DNA, 241 bp, Homo sapiens
cgcttcggtaaaatgcattttattctttaagttcacgctaagatacaactttcaaggcatggtctgaaggactggattggccaaacatcagacctgatcttccaaggtagaccaacgtcctcggctacatcccagacctgctggttacagatgcacacagcgccgatgtgagccacatggctgcccagcacagatgcgtcctctcccccaacgagcctcacaaatgggccccatcaacgag

SEQ ID NO: 618980 - DNA, 232 bp, Homo sapiens
  misc_feature (15)..(15): n is a, c, g, or t
  misc_feature (44)..(44): n is a, c, g, or t
  misc_feature (69)..(69): n is a, c, g, or t
  misc_feature (75)..(75): n is a, c, g, or t
  misc_feature (104)..(104): n is a, c, g, or t
  misc_feature (110)..(110): n is a, c, g, or t
  misc_feature (134)..(134): n is a, c, g, or t
  misc_feature (189)..(189): n is a, c, g, or t
  misc_feature (216)..(216): n is a, c, g, or t
cccgtaatatgtacnatggcaaggaacagcaacaaagagggacnattctctgaaggtacaacagtaacnatctcnaaggaggaggaaacttgtccccacccccnacatcnataatcagatgatggatctggtcnaaatggaaaaaaaaaagaaagaggatgacgagaggaggaaaggaatctgtaaccnaagtaacagttcatgaaaaaaagaaanggacatttgctacata

SEQ ID NO: 618981 - DNA, 756 bp, Homo sapiens
ggactctaaactttggttatacctccagtggaaaataaggatttagaaaccaggtggaagagattcactatcaagactattgatatattttatgtaatgttagccactcgcatgttgaccaaccttgaggaaactgagtttatggtagaacacacatcttgtccattgtaagatccatctgaactgtcccacaatgtaatttggcaaagagctgcaagacagtcaaagaatatagccattgttgataggcactgtggtagactaaatgctattatgacttcagttcattcgattgttgtagcatttgcaacaattgttggtggagcttttaatgtacctaatcatcattttgattctgaatggtgtaattgaagtaggacattgattaattttctaaaagtctgcacgacagttgtgatgtacctttaggtgtcgagtgagttttcttttgtacatacgaccatttagtcttatcttgaaaacgcaaggatatggccgtcggtgtcgtgggagtttcaaggtgcccaataagtgcctattccagtcgcccttcacaatccgtataatggtcgtagttggggtgtcatagaatgggtcgcctagtgcactcagtgagccagattattacgcataatggaggttgctcttttgaactacccttaaccagtcattgggcttagtcagttgctcaataaaccgtccagtcgcaacgagaggcccgtaaaggaattggcttggacaccaaccgagtggatg

SEQ ID NO: 618982 - DNA, 115 bp, Homo sapiens
cggcacgagggccctttccacctccgcctccatgtgtgtgagatcaacctttttccgagcataaagctgcaagatctttaagcagatttcctgaatttcttcttcagttgctcca

SEQ ID NO: 618983 - DNA, 800 bp, Homo sapiens
acccgcgagacttgagtgggccacgtgagccacgggcacgggcgcgtaggcaacgcaccggaatgcaccccggcggtcgcggtaatgctggtgtgtcttgcatcaccaccggatcaacttcgacaaataccacccaggctactttgggaaagttggtatgaagcattacctactttatataggaagggtatcctaggtagccttcttgcccaaccttgtcataacgctctgaccaaagtagtggacgtttggtctagctgatacagaacgacgggtggaagtgctcgctaagacaccaagacggtggctggtcccagtcattgatgtggtgcgactcgggctacgtacataacgttctgggacaagggaaatgctcccaaaagcagcctgtcatgcgtgacacggccaaaagtggcttgcagtcgatgatagcagctgatggagaacgattgaatgagtgttgagcggggtgcctgatggtccctgagtagagcctctgcaagccatcgatgggaggggagtattcattaagattgcgtacactacgtatttacacaactaatacgaaaggatacagctattcagcacgccatagagaaacctcacggaccggagcgggaagtactccacgagagaataggcagagataggcgcaccggccgggaggagacgcactagcaaaccgccgtgcaccgggaatgcggatcctcttaaccacggagcacgagggtcccgaccgacagggctcacccggggccaagtgacccggggccaaagtacaccccacccgggcccaaacc

SEQ ID NO: 618984 - DNA, 111 bp, Homo sapiens
tctcaatggcagctaaacacttgagttcaccagcttctacatggtttagagcaggtggtgtgtgtgtgtgtgtagtcgagtatcgtctgtggtgtgttgtgcgctgctggt

SEQ ID NO: 618985 - DNA, 873 bp, Homo sapiens
attctagaggctgaggcgggcggatcatgaagtcaggagatcgagaccatcctggctaacatggtgaaaccccgtctctactaagaatacaaaaaaaaaaatattagccgggcatggtggcaggtgcctgtagtcccagctactggggaggctgaggcaggagaatcgctgtgaattggggaggcggaggttacagtgaacccacagtggcgccactgactccagctgggtgatagagtgagactctatctcaaaaaaaaaaaaaaggaaaggttttttagggaaccaaaattatttggattgatggaaaaggtttcccggggacttggtcacgaggtggtgtaataaatttccttgggtccagacaggtggtttagggaaactctcactcagggcctaaatggctggtcgcaggggctctggcaattggctaaagagggggggaagtgactggtcctggttcccaaggcagatctggctcctaggggggaaacccggacaggtgtccaggtccctccagatggggccctcagaaagagtaacgcctttaggttagtggtttaagaggtgtggttacaaggttggtgtggaagacttcatagggctgcaaaggtcagagatttcacaggttccaacccttttatatataagacttggattggttaaggagacggggtgtaaaggtagggctgggtgttccccttcaccgggggtggtctaaacccacgtgggtgggggggaatggtggaggatagggcttctttttaattaagcggaggtatggtgaagcagttcccaggaattagaatcttacttaaaaggcatttcattggaggggttgtggcgagaataaaaggaggggaaatagagggg

SEQ ID NO: 618986 - DNA, 254 bp, Homo sapiens
agagacatgatacgaatcgagctggtacccccgactagcccgacaggaagctgtctagtctctcctgtaaggccctgtctagtctctcctgtaagccctgtctagtctctcctgtaagccctgtctagtctctcctgtaagccctgtctagtctctcctggaagcccgtgtctagtctctcctgtaagccctgtctagtctctcctgtaagccctgtctagtctctccggtaagccctgtcgagctactcgggg

SEQ ID NO: 618987 - DNA, 551 bp, Homo sapiens
acacaaaggacgtatttgtggtgatggagtagctctgtatttggtttggtgggcttaaatatacatgtcacaaaattgcatagaaccacacacacagatagtcaaatcagtgcatgtaaaactggtggaatctgaatgtggtccgcgaatagtaccaatggcagtttcctggtttggatactgtgctacagttatgtaagatgtcaccactggaagaaactgggtgaagggtacatagaagctctctgcactattttcccaaatctacaattatttcaaaataaaaagttaaaatgacaccaccatagtagcaaagcatgaacaaatgcttcatgttaacagaaaaggtcagtttcagattaaaaaatttacatgtcagctgggcacagtggctcacgcctgtaatcccagcacttagggaggccaaggcaggcggatcacctgaggtcgggaattcaagactagcctgaccaacatggagaagccctgtctctaataacaaatacgaaaattagctgggcgtggtgccgctggctgtaatctcagctact

SEQ ID NO: 618988 - DNA, 105 bp, Homo sapiens
gtacgatggtgcaggtggggataagtgtggtttcgaagaagatataaaatattgattagttctgtggctgtgaactgttatatattcaggagactttgtagcgga

SEQ ID NO: 618989 - DNA, 132 bp, Homo sapiens
agagacatgatacgaatcgagctggtacccccgactagcccgacaggccactagcccgacgtctgtcttcccgagcagcaggcggagaggagatgaataacttaggaagacgccctgtcgggctagtcgggg

SEQ ID NO: 618990 - DNA, 1547 bp, Homo sapiens
  misc_feature (3)..(3): n is a, c, g, or t
  misc_feature (329)..(329): n is a, c, g, or t
  misc_feature (1077)..(1077): n is a, c, g, or t
tcncgtctttttccttttcttcgttgttcggtttgtcgttcttcgctctcggtcgtgtcgtctgtcttctgatcctcgctcgctgtgtgtctgttgcgtgctcgcgactgctcgtcgcagtgtcgagaggtcgagtctctattggttcgtgtgagtcactcgaccgtcgcagccgcctgtgtggtctctcctttgttttgcttgtgccctcctttcgctgtcgtttggcctcgtcgcactgtgttttgttcatgcatcgcgcgtcgtgtctgctctgcctgtaagtctgatgcctgcgggtcgatcgacgctctgaggcgccttcgttngtctcccccgtgctgtgagtggatcctcgtgctctcccccttcttgtgtgtgttactccctgcccgccctaggttgttgtggtacgcgcctcccccttatcttgggcgcgttctgcgtccccgccgacggatggttggtctgacggtggcccccgggtgtattctttggtgcgatggtgatgctcgccgccccacttagatttgttctgtgtttcgccgccgcctcgttcgttggccgaggtttgtatcccgttgttccgcgttgttcctacgaggcaataattgtttcgagccgggtggtctttcgcgcgccccactattatccgccccgcggggggacaacacactttgtctcgccgaaccgtcccgcgtgcctccccccccgacgtcggactacagtggggggtttttgtgcgtcgcggccgcgccccccgtctctccccgccgggggggaaaaatacatcctgtgcgcttctgcttggtgttggttccctgtggtggccgtgtcacgcgctcccccacagcgggggacccctggggcaccccccttttgtgttgtactatgagtgtgtttttgtggactcggcccgcttctgctgacacaaatgggggcgcccctgtagattgtcctatcgtcgcgtctagggcttgtgcgacgcctctttctctattacttgggggcggcgccctcagaatagtacctctctctccctcgtctccgcgattggttctcccccccccttttggnggggcccccacttttatagggcgtgcccctcgcgctgcgccttttcgctgcttgcgagattgttggtctccccccttttttctccgtgcccacgctcgttcttgcgggggggtcccaacacccaccccttgttgctcccatggggggcgccaccaacttggggggagccgcccctaacaggttggcgcccctcccccctttttggccccccgctcccccctgtgtgtccccctggcggcgttctttagacaccctctttgtgccccccgcgtctctctctgtccccaccgcgccttctggggctcgtaacaggggactcgctcctccggctcctcaaaggtgccgcccccgggggcatctcccgcataaccttgccttcttgccccccctctcaatccgtttattattttatcccgcgcgttctctgaagagccctctgtcttttctcgccccacaatatcagaaaacac

SEQ ID NO: 618991 - DNA, 412 bp, Homo sapiens
ccttcggtgtttcactgaagatcctggtgtttccatgggccgccgccccgtccgttgttaccggtattgcaagaacaagccgtacccaaagtctcgcttctgccgaggtgttcctgatgccaagattcgcatttttgacctgtggcgtaaaaaggcatatgtggatgactttccgctttgtgttcacatggcgccagatgaatatgagcagttgacctctgaagccctgctggctgcccgactttgtacccaatttgtacatatccgctgcgtaccacctgcctttcatatcagtacgcgcctctaccacttcaagccatgcgcatcaacaagaccgtttccttccctgctgctgacagcctccaaacatgcccgcaacgtgcttccgtctctcattaccttccccttttcg

SEQ ID NO: 618992 - DNA, 367 bp, Homo sapiens
  misc_feature (6)..(6): n is a, c, g, or t
  misc_feature (74)..(74): n is a, c, g, or t
  misc_feature (94)..(94): n is a, c, g, or t
  misc_feature (96)..(96): n is a, c, g, or t
  misc_feature (107)..(107): n is a, c, g, or t
  misc_feature (134)..(134): n is a, c, g, or t
  misc_feature (137)..(138): n is a, c, g, or t
  misc_feature (161)..(161): n is a, c, g, or t
  misc_feature (163)..(163): n is a, c, g, or t
  misc_feature (196)..(196): n is a, c, g, or t
  misc_feature (199)..(199): n is a, c, g, or t
  misc_feature (203)..(203): n is a, c, g, or t
  misc_feature (218)..(219): n is a, c, g, or t
  misc_feature (222)..(223): n is a, c, g, or t
  misc_feature (345)..(345): n is a, c, g, or t
tgcggnggtgcgggtgggcgctgggagcccggggggtccgcctgccccggcccccgctacctggttcttcgggntttggcccagagcacggttntnggtggggacgncgggctggctgggccacccggtcactnttnntggggggcatttgttccctagtntnggccaaggttttttggagaaggcggcgccgttngcncgtnctcctcgcctctttnnatnnccgtccatcctgccgccctccccaccccgccaagacgctgtggggacccgagtttcatgggtgcagcaaaccggggcttctagcttttccccgggcaggacggggtagcactggctcctgtncttcctgggccccggcccggcc

SEQ ID NO: 618993 - DNA, 254 bp, Homo sapiens
  misc_feature (226)..(226): n is a, c, g, or t
  misc_feature (241)..(241): n is a, c, g, or t
gaaacaaggtaaattagtaaagaataatataagcagatgtaattggatctttaggaggaaattatgacctataatgttacagcagttttctgtagtacattttcaaccataatgtggaaaattagaaaataaatgttattttcaacataaaaattaatcacttggaggatacatctggttctgccaagatagaggacccctattcctccttgatctcccttacagngaaaacacttttggncattatcaaacaa

SEQ ID NO: 618994 - DNA, 428 bp, Homo sapiens
  misc_feature (26)..(26): n is a, c, g, or t
  misc_feature (164)..(164): n is a, c, g, or t
  misc_feature (357)..(357): n is a, c, g, or t
cgggaattacaggtgtgaacccaccntccccggccctgaaatttgttaaaaaacaagttttttggtttttttaattttccttttgagacaatcctcatgctgtcactctggcctagagttcagtggggacagagtgaaagtgccaggttgaggcccgggcgtgngtgtcacgccctgtaatcccagcactttgggaggccaaggcgggtggatcacttgaggtcaggagttcgaaaccagccctggccaacatggcaaaaccccttctctactaaaaatacaaaaattagctgggtgtggtggtgcgcatctgtaatcccagctacttgggaggccaaggcacgagaatcgcttgancctggaggcagaagttgcagtgagctgagatcgcgccactgcactccagcctgggtgatagagcaagaccc

SEQ ID NO: 618995 - DNA, 186 bp, Homo sapiens
cgtcgacgattgagctgcagagagacaagttagtagagacgaaaggaaaggttctgataaaagcggtagggagaagataaccagggcgttgaaggggggaggcccgggaggcagaggttgcagtgagccaagatcgcaccattcactccggcctgggcaacaagagtatgaacattggtctcagaa

SEQ ID NO: 618996 - DNA, 1539 bp, Homo sapiens
taacgtgagcattaactttcttatatattctcgatggtggtcccaggtaaaataatccaggccatattggcacatacatatcaacaccaccagttgtctctatgaatccgtcagtacgcttggtgcagatatgtctggcactatgcactcaacaagtcctggcagagcgcaccttcctgagttctcccatcgatggaaaccactagtggaacagatcaacgacatgaacacaccaccagagacactgtgagcgatccgtggaagatcactaatgggccacctaacagtgggcctccacaccaggtatggcgcttatcatccagcgcatatcccccgctaaaaaggttgcccaagggggacaaccagattacacaatcttgtggcagacaactgaacacacagaaaaagctctcgtgtgctcccacgctatttcaacacccaggaccagacttggcgacgaataaaagacacaacatgaggcgctgttgagcaaatctaactatcccgtccttgtccagtggcgaaagttcttataaacaccgtgcggcggggcgcacacagaacacacataagccccagagatgattcacgcaactttgtgcccccagtgtttacaccggcctatttgtgtctcacaccaacaacaaggtagacaccgttcgtagcccaatgggagggcctaactaccactggatcacaataaccttacacctatctatcataacttatctccctagagggacataaatccacgcatggaggtaccccctctctaaccaccatcacgttagggcaccctcacctgaggctaaaatacacaacctcgcctagggccaccccactgggcccccagcacccatacaacatggcctgtggccagtatccccacccccgggggtcgaccacagcggacgctccagaccaccacgacctccccacggaagaacacggcaagcgcaccatcaaaacgagcaccgcggacagggagccacaacagtggaacagaaataaacaacgcccacgatgggcacacacatgcaggcggcaacataaacaacagaaccccacagcggtgcacacagcggaccagttgacccaacggcctacagcggcaacacaaaagcccccgaaaatagaggcgaccatcatcaaaaacaaagggtccaacgagaggcatactggcgaaccacaccccaaaccaatcccactaaccgcccctaacaagaccgcccacaacaataccacagacaccaacccacatatcaggacctatatgaccccctgtgcaaaagcactaaaaatccccagagggcgaacaactactatgaagggaacaataaagcgccagcattctcaacatcgaatcatttacaaacacacggaaagacaaaacacccgcaacagcagatccacgcaacaagctcggcacactagggactcaactgcccgacacaacacgcggacaaacaacacggactcgtcgagaactttcttctctgctcccgctttctaaaccagcgagcagagatcagtacaaca

SEQ ID NO: 618997 - DNA, 180 bp, Homo sapiens
agttatattatggtgttcaaagattaagctgccttggaaacaatattttcttttgaaaaagaattttttttttcatttgtgatttttaaaaaatgttgccccagttatgcttcatgcatcgttacattttcatcaggttaatgtaatgtttagttcctttgcaataaaaatattgctgca

SEQ ID NO: 618998 - DNA, 322 bp, Homo sapiens
gagatgaagtctcgctctgttgcccagactggagtgtagtggtgcgatctcagctcactgcaacttccacctcccaggttcaagcaattctcgtgcctcagcctcccgagtatctgggattacaggcgcccaccacaatgcctggacaatttttgtatttttagtagagatgggggtttgccatttagccaggctggtcttgaactcctgacctcagatgatctgcccacctcggcctcccaaagtgctgggattacaggcgtcagccaccacacccagcctttatgttttgttttctatgttaacacactaatgtgtttaa

SEQ ID NO: 618999 - DNA, 960 bp, Homo sapiens
  misc_feature (216)..(216): n is a, c, g, or t
  misc_feature (586)..(586): n is a, c, g, or t
tgtctagcttgttctcttctgtctagccccacacgccttctggcacaatgaagtgggtaacctttattatcccttcttctctctctttagctcgggttattcctagggcgtgtagtctcgtcggagatgcgacgacaaagcagtcgtagcgtagctccatcggcttgagacgattaagcgtgcatggaatggaaaatcttcaaaagcctcttggtngttagattgccgtttagcttgcagtatcttcacgcagtcgtcctatttggacagcatcattgtcatagggatctgagttgcatatcgatacgtcaactcgcatatttgccaacagaaaccattgtcgttggctcggatgagatcagcgtgtataaattcgtgagcaaaatccgacttcgagtatccctgtttctggacgacgaagattattgcacgatgcttcgcgaaactccttcagttgaacacgctgatgcgttgcaacaccagtggcctgaagctgcttgtgccataatagatcaatggacacctggagcgagaagacttgacatggcgtgtcgtttggcaaacaactaaatagaattgaactaancgcgaaataggcatctcgcgccgtagtttggttgagcaccccatgatggttgcacttgctgcactgtgtcgagtcttgcttttttcacttgcatcgagatgaacagagtaccattctctgggatacacaacttactctatcattgagacatttgtcgcagaagtactatgtcctctatcttttaattggccccgtgacacttcgcttttatctttttggcgtaaagagcgttatcaaacagcttgcctgtttcacatgaattgtgtgaccacagcatgcttgaattgagagcttggcttgtcttgtttgcctaacatcttcggaatgaaactctttcggggcattgaacggggaaagggcttccgtcctgtcaa

SEQ ID NO: 619000 - DNA, 895 bp, Homo sapiens
agaagagttcagcctcatagatggacgagccatcctctgtgcccgtcagcagtgtctgtgtgtctgcataaaccctcctgtcctggaggtgacttcatcctgaggagccacagcacaggccgtgctggaactttctgcacactggctctgggactggcagagaggtctggtgctgccctgcggatcagtcctcttccagtcacatctgtgccagagggctgtctgtgacctgggcccgtgcttcgaatgccacctgtctgcctgggctccaagtgggcaggaccgaggacagaacctacgaggcacggactgagggggcagtgtggtcccctggctgtcccatccccatgtcctccgtccgcgggttgtggctggctgctgtgcattgtccctgcgatgggagtcttgtcttcccgagccgtgtcgagtttcctccccaggcagagcgtcgccttcctgcggagagtctgggaggcggtgcaggctgtcctggctgcgtctggggaagcctgagggacagcataacacccccgggacagtaggtcttgggcgggccactgggaacgtctggcacttgagtgtgttttgcctctttccgtgggtatgaactgtgtgacgttcacccagagggcctggtcttcctccacagatcggtgtgggttggggtcactgcatggggggggcacacctcctcataggagggggggcccacctttcgcggggtctccaggatggggggtgccgggctgtgcggctgttaccatttgtgggctcgcgtttgtgcgcgccccctcgggggggcccggttgttcaacgggttttgcccctctttgtggccctgttctggagttcttttggaggggccgcgcccggctttgtggggtcgggtcttcgc

SEQ ID NO: 619001 - DNA, 1137 bp, Homo sapiens
gtgcctcgctaagctcattgtggcagtgaaaatattccacggaattttatcaccaaacaaggtgacctgtaaacatatcacgaagctgaaaccttggggccttttagaggttcgtagtggagaagtatgagtggtcgcaggaagaggcagctggcattcacagatttcttactgcccatgtaggagctgatccctgagaagcagagccactgccgccgcagtgtctccggcgacccttggcttaacatcctaagcccctgcccaggcaccacagcagagatcacaacactgacccatccgccctatcccttcaagcattttcctcttcccattttcaggggtgaagctcttcctatcaagagatttctagatctatgtataaggttgttactcccaacatgtaccataaggggttagcattactagacccattgtggagatcccacaaagccatggggccatcctaggtgccttagggcctggcttgggctctgcccacacagactacactggactacacatgtgaaccaggcatcttgcccctgttacccttaccttccacattaggacatccctttaaagttataagcatcctatatgtgaaaaagaagctatgaaggtgtatgagcccatcctttaattcattgagtataagagtcagattttcttagtgcatatctattgggccagaaaagggtgagagggggaaggcgtcaaaatctatgtaccgcagaaacaattcacaccgacggcggtcaggggatgaaacaaccacccgggcacgcggcccagaggaccacaggggaccacatataaacggacacataaaagcaacggacaagcaacaacggaatgaaacaccacaaggggcaccaaaacaggacaaaacacagcaacacgcaacatcaaagagatagcagcagggacacatcaagctaggagaacgcgtgaacaaaccggcacacgacacaataaaacacacctgggggacttaaggaacacatgacataccaccaagagacgaacccacgcagccagacgaagagaagcgacaaaagaaagagacaccaaggaggaaagcagcaacaaagaagcaaaaacagatgatcaacagcatagcacatggcctgtgcgaca

SEQ ID NO: 619002 - DNA, 174 bp, Homo sapiens
  misc_feature (92)..(92): n is a, c, g, or t
gtttcccttttttgggggggggccccctttttccccccctttttttttcccccccaaaaaaaatggggggaaacccccccccaaattttttnccctggggtcccgggtaaaaatttgggggggggtgggtttgccccccaatttcccccccaaaaaaccctttcccccccccca

SEQ ID NO: 619003 - DNA, 110 bp, Homo sapiens
agctcggtaccctgattactgtggggtttgtttttgtttttgtttttgttttgagacggattcttgcatcttgctctgtcatcccagctggagtgcaatggtacagtctc

SEQ ID NO: 619004 - DNA, 356 bp, Homo sapiens
ttcgtgtcccgccaggaaggcgcggtccagcctcagtcactagccgacatcccgctgtcctcctcagacgtgaatctgtcgatcattaccgacgttgcgtggctatctcagactcggttgtgcgtgctgggtcgtgcaatcgacgctggtgtcacgaccccttacgagatcgccgtcgacggatctggcgcgacgtcaatgggtcagctcaccgccactagcatggcggccgtcgtcgcgttgccgaaggaaacgggcaccgaggcagtcgtgttgagcgaggacgggatattgctgcgccacgaggacagtttccgctggcgtcagatcctccaaggtgtcagcgccgttgcggt

SEQ ID NO: 619005 - DNA, 201 bp, Homo sapiens
taacgcattcgacgtgcacaccataccactgtgtagagggctcatcatataaaggaatgactattattgaaaacaacaatagtagcaatcaaagtcctgcggccacatatgtgaactttagggggatagctacgctaccaacctgactagctgtcacctatcaccgtatccagtttttaaaatcctgagatcaagccaaag

SEQ ID NO: 619006 - DNA, 241 bp, Homo sapiens
ggggagggacaagggggtttttttttcccgggtttttccaaccccccgggttgggtttacaaaattccccccccgggtttttcaaccccccgggttgttttttttttgggggggggttaaccccctaaaacgcctttgtttttttcccgccccccggcccccccctttttggggggttgggtttccctttggggggggccccgggtttcccctttccccccccaaaagggaccccctttta

SEQ ID NO: 619007 - DNA, 244 bp, Homo sapiens
cggaggaagagagagtgaacacggaagtgcacacactttaaaatgactagatttcatgacatctcatgatggcgaggatcgtaacgaggggatggtgctctctactgggcaatctgcccccatgatccagtcacctccccacaggctccacctccaccaacttgctctggctactataacatttctaatttatcctccaaacttagtacgacactaactaagacttctatcactgagggctgtc

SEQ ID NO: 619008 - DNA, 509 bp, Homo sapiens
  misc_feature (78)..(78): n is a, c, g, or t
ccaccatgcccggctaattttttatatttttagtaaagatggagtttcaccgtgttggccaggatggtctcgatttcntgacctcgtggtccacccgcctcggcctcccaaagtgctgggattacaggcgcaggccactgcacccggcagaagtcccactcttaataatacaccaaagagagactcagatgcatatgcaccaggacacatgtgcaagaatattcactggacatttttgtaataaccccaaacaagaaacaactgcaatgtccactagtgccagaaaggataaatgaattgtgatgtaatcatacaatggaatactatacagtgatgaaaatgaatgaacaacagctacatgcaatgacatgggtgaatccttaaaatatactgagtaaaacgaatatgaaataatccatatagtacaattgtttttatataaagattaaaaacaaggaaaatttaacagcattgttaaagatacatatttagaaagaagaaaaaaattc

SEQ ID NO: 619009 - DNA, 766 bp, Homo sapiens
  misc_feature (104)..(104): n is a, c, g, or t
  misc_feature (125)..(125): n is a, c, g, or t
  misc_feature (149)..(149): n is a, c, g, or t
  misc_feature (227)..(227): n is a, c, g, or t
  misc_feature (230)..(231): n is a, c, g, or t
  misc_feature (238)..(239): n is a, c, g, or t
  misc_feature (283)..(283): n is a, c, g, or t
  misc_feature (303)..(304): n is a, c, g, or t
  misc_feature (318)..(318): n is a, c, g, or t
  misc_feature (323)..(323): n is a, c, g, or t
  misc_feature (325)..(325): n is a, c, g, or t
  misc_feature (351)..(352): n is a, c, g, or t
  misc_feature (367)..(367): n is a, c, g, or t
  misc_feature (381)..(381): n is a, c, g, or t
  misc_feature (389)..(389): n is a, c, g, or t
  misc_feature (409)..(409): n is a, c, g, or t
  misc_feature (416)..(416): n is a, c, g, or t
  misc_feature (421)..(421): n is a, c, g, or t
  misc_feature (437)..(437): n is a, c, g, or t
  misc_feature (452)..(452): n is a, c, g, or t
gcagccacgccactccctcctgagagcccaccgcgccacagcttggaggaagagcctgcggggaactggctgcaggacgctctcttcttgagtgcaggtctggntctgctgtgaccatgcccgtnacctttgccctcctgctcctcctnggccaggccactgcggacccatgctacgatccacagggccgccccaattctgcctcccgccagtgacacagctggcangcnngtggcgnnctcctgccctcaggcctgtgccctgtccccaggaaaccaccttngcgccagggaaacctgcaannggcagcctgacatntggcncntgggtggccccttcctcctgacatcnngtcagcttgcgcttnctgtaccccagganccccagcncctcatcctgtctgctgccntgggccntcagnggggtccctggaggcntgctgttgcacaggncccgaccatggacctggggaccattaggagggcccatgaaacgggtgaccttccacatccacacacaggtcctaagtgacactgtggcaggcacaagaccaaacttccacgatggtgggaaagatatgggggagaccagtgcccgaggactaagacgaggaaagcataggggagcatgaggaagggcccgagcatggccaagaatcgtcaatgggaccaacagcatggaccggcatgataggaaccggccaccagtgaaccaaggaaccacacacactgaagatgaaaaaactggcaagaacaaaacataaaca

SEQ ID NO: 619010 - DNA, 1107 bp, Homo sapiens
attttaccaaaagactcctaaggttaagaaatgacttctagcgaaagtctcaggatacaacacattgatatacaaaagatgcaatagcattgccttgacaccaagtaacgattcaagctgagaacaaaatcaagaacagttttctttacaatagccataaacaaaaaataatatacttagaaatacatcaaaccagggaggtacaaatagtctctacaagaactagaaaacattactgaaaggtaatcagagacaattcaaataaaaaagctttctatgctcatggatttgaagaatgaatagaaaatgtctatgctgcctagagcagcctacaaaataagtttttgttatcttttatcaaaatgtcgattactttttttttttttttggagacggggttgctctggggcctaggctggagtgcagtggtgcgatctgggctcactggtaacctccgcctccggggtacagggggagtctcctgccttagcctcccaagtagctgggattacgggtgcccaccagcacaccgggctaattagggggtaaaggggggagatcgagtaaaggctgtagtaggccaggcgggtctcaaactcccggagtccaaagtgctgggataacgggtgcgacccgaccatgcctggtcccaacccattataattccgtggtacccaacgcacaggaaccatgaatactcggaaattaggccagggatttcaattttccagacacgaacaggtgactgccctacacagggtgttaaaaacatcccacacaaggagcaacaaaagcacaggaggccccctggggggcccccacaaaacgcgaggctaaatataccgagagggcgcaaaaacccacaaacacacagagcagcagggcagcacacaggcgccgccaataacaccacacaatctgacgaaacaacaaaccgtcgccgctccaccactctgagagacacacaaccaaacaaaaaccaggggggacgcacgagggctgaacacacaccagtgaggcccacaaaaggaaggcgcaccacacacacgatactaaaccaacgaacgaacgcctccctacaatcttcaacgccacacacgcaaagca

SEQ ID NO: 619011 - DNA, 680 bp, Homo sapiens
  misc_feature (104)..(104): n is a, c, g, or t
  misc_feature (125)..(125): n is a, c, g, or t
  misc_feature (149)..(149): n is a, c, g, or t
  misc_feature (227)..(227): n is a, c, g, or t
  misc_feature (230)..(231): n is a, c, g, or t
  misc_feature (238)..(239): n is a, c, g, or t
  misc_feature (283)..(283): n is a, c, g, or t
  misc_feature (303)..(304): n is a, c, g, or t
  misc_feature (318)..(318): n is a, c, g, or t
  misc_feature (323)..(323): n is a, c, g, or t
  misc_feature (325)..(325): n is a, c, g, or t
  misc_feature (351)..(352): n is a, c, g, or t
  misc_feature (367)..(367): n is a, c, g, or t
  misc_feature (381)..(381): n is a, c, g, or t
  misc_feature (389)..(389): n is a, c, g, or t
  misc_feature (409)..(409): n is a, c, g, or t
  misc_feature (416)..(416): n is a, c, g, or t
  misc_feature (421)..(421): n is a, c, g, or t
  misc_feature (437)..(437): n is a, c, g, or t
  misc_feature (452)..(452): n is a, c, g, or t
gcagccacgccactccctcctgagagcccaccgcgccacagcttggaggaagagcctgcggggaactggctgcaggacgctctcttcttgagtgcaggtctggntctgctgtgaccatgcccgtnacctttgccctcctgctcctcctnggccaggccactgcggacccatgctacgatccacagggccgccccaattctgcctcccgccagtgacacagctggcangcnngtggcgnnctcctgccctcaggcctgtgccctgtccccaggaaaccaccttngcgccagggaaacctgcaannggcagcctgacatntggcncntgggtggccccttcctcctgacatcnngtcagcttgcgcttnctgtaccccagganccccagcncctcatcctgtctgctgccntgggccntcagnggggtccctggaggcntgctgttgcacaggncccgcctttgcctgtgggccttcgtggttgccctgacaacgtggttgaccttccactccacaccagtgtcctaaaggccacttgtctggcgtgccagcctacctaccgtattggagttttggggtgcccatgcctggtcttagcgtgcagctaggttcagcgcaggccgctttcctagttcttcggccacgcttgccgctttgccgcccgtgccggcccccgcttcca

SEQ ID NO: 619012 - DNA, 468 bp, Homo sapiens
  misc_feature (111)..(111): n is a, c, g, or t
  misc_feature (174)..(174): n is a, c, g, or t
  misc_feature (190)..(190): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (221)..(221): n is a, c, g, or t
  misc_feature (227)..(227): n is a, c, g, or t
  misc_feature (231)..(231): n is a, c, g, or t
  misc_feature (234)..(235): n is a, c, g, or t
  misc_feature (238)..(238): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (261)..(261): n is a, c, g, or t
  misc_feature (263)..(263): n is a, c, g, or t
  misc_feature (268)..(269): n is a, c, g, or t
  misc_feature (271)..(272): n is a, c, g, or t
  misc_feature (274)..(274): n is a, c, g, or t
  misc_feature (276)..(276): n is a, c, g, or t
  misc_feature (278)..(279): n is a, c, g, or t
  misc_feature (281)..(281): n is a, c, g, or t
  misc_feature (286)..(286): n is a, c, g, or t
  misc_feature (288)..(289): n is a, c, g, or t
  misc_feature (292)..(292): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (303)..(304): n is a, c, g, or t
  misc_feature (307)..(309): n is a, c, g, or t
  misc_feature (316)..(316): n is a, c, g, or t
  misc_feature (320)..(321): n is a, c, g, or t
  misc_feature (325)..(325): n is a, c, g, or t
  misc_feature (328)..(329): n is a, c, g, or t
  misc_feature (331)..(333): n is a, c, g, or t
  misc_feature (338)..(338): n is a, c, g, or t
  misc_feature (340)..(340): n is a, c, g, or t
  misc_feature (342)..(343): n is a, c, g, or t
  misc_feature (345)..(345): n is a, c, g, or t
  misc_feature (348)..(348): n is a, c, g, or t
  misc_feature (350)..(352): n is a, c, g, or t
  misc_feature (354)..(355): n is a, c, g, or t
  misc_feature (358)..(361): n is a, c, g, or t
  misc_feature (363)..(363): n is a, c, g, or t
  misc_feature (369)..(371): n is a, c, g, or t
  misc_feature (373)..(373): n is a, c, g, or t
  misc_feature (375)..(376): n is a, c, g, or t
  misc_feature (379)..(379): n is a, c, g, or t
  misc_feature (386)..(386): n is a, c, g, or t
  misc_feature (391)..(394): n is a, c, g, or t
  misc_feature (398)..(398): n is a, c, g, or t
  misc_feature (400)..(401): n is a, c, g, or t
  misc_feature (414)..(418): n is a, c, g, or t
  misc_feature (420)..(421): n is a, c, g, or t
  misc_feature (423)..(423): n is a, c, g, or t
  misc_feature (429)..(429): n is a, c, g, or t
  misc_feature (435)..(435): n is a, c, g, or t
  misc_feature (438)..(439): n is a, c, g, or t
  misc_feature (451)..(451): n is a, c, g, or t
  misc_feature (455)..(457): n is a, c, g, or t
  misc_feature (460)..(460): n is a, c, g, or t
  misc_feature (462)..(462): n is a, c, g, or t
  misc_feature (464)..(467): n is a, c, g, or t
ttagtttcttgaacctatttatagcgtcaaaagttagacgcaggtgcaggcctccattccatctattggctggctctcgactgctgagactggcctgccaacctgtgtttnaggagggcacgcgtctgcggctgaaccgcggaagggccggtgaggaaccgggcctggggaganggccctgagggccccncactnctnccnctnctnctgctactactgcngctccngccnccnnctncccancanctnccnctnctacancnccacnntnnantntnncnccctncnnttncncntcntcannctnnnaataagnggannaacncanntnnngaggntntnnanctncnnnannagnnnntngaggannnanannaanagggggngaagnnnntaangnntttattttttttnnnnntnnanaaaatnttaatnaannaaaaaaaaatgngtgnnntanangnnnna

SEQ ID NO: 619013 - DNA, 548 bp, Homo sapiens
aattctccttcatcttatgtacatttctacctctgacagtatgcatactttgtagttactgtccgtcgcccccaatgagacacaaactctgagagagcaggagctttgttttcttatgtcttaatccctagttcccataacagtagctggcacatgggaagcattcaaccaacaatggttgaatgaaaaaatgtgtagaatgttccctctgcctggaatgtcctcccctgactcatcaccctgaaaaactcttattcatccacctagtcttggctcagatacaacctctgccatgcagccttccctgactgtcccactgaaactcaggtgcactttatccgagctccagcgtactgtgctggcatctccactgcagctgccagattactgactagaccgtttgcctgtctctcactcacaactagaactttacctctttgaggacaggactctctctacatatgtgtgtccccagctagtccagagtaggtgttaaacaaatgcttatggaatgaatacatcaatctttaccagagccctctgcaaaa

SEQ ID NO: 619014 - DNA, 423 bp, Homo sapiens
tgtggctgtctagaggatccctcataggttcgcaggaggatcactagtggccaggagttgagactagcctgggcagcacagggaaaccttgtctctacaagaggaaaaaaaaaaaaaaaaaagaggtaaaagcaacataaacaatttttcccccaataatatggtctaagttcattttcggtggctatgacagaatccctgaaagggggtaatatataaagaaaagacatggatttctaaataagctggtgaagtcggggaaggtcaaagggtaggaggagccatatctggatggaggggccttttgggcctcatatggatgggagggcgacctcagggggagagacgcaaggagggccacgctcagggtcaggtctacccacttctaaaaacgcccatatccccatcaggggggaccccacc

SEQ ID NO: 619015 - DNA, 88 bp, Homo sapiens
  misc_feature (1)..(1): n is a, c, g, or t
  misc_feature (72)..(72): n is a, c, g, or t
ncttttgcgggtggcggcgaaacgcggaagagcacgccatgaaatgcctcgggcacgctacgagagtacaangtagtgggtcgctgcc

SEQ ID NO: 619016 - DNA, 1101 bp, Homo sapiens
  misc_feature (267)..(267): n is a, c, g, or t
  misc_feature (321)..(321): n is a, c, g, or t
  misc_feature (379)..(379): n is a, c, g, or t
  misc_feature (419)..(419): n is a, c, g, or t
  misc_feature (427)..(427): n is a, c, g, or t
  misc_feature (433)..(433): n is a, c, g, or t
  misc_feature (439)..(439): n is a, c, g, or t
  misc_feature (484)..(484): n is a, c, g, or t
  misc_feature (513)..(513): n is a, c, g, or t
  misc_feature (608)..(609): n is a, c, g, or t
  misc_feature (612)..(612): n is a, c, g, or t
  misc_feature (622)..(622): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (648)..(648): n is a, c, g, or t
  misc_feature (714)..(714): n is a, c, g, or t
  misc_feature (723)..(723): n is a, c, g, or t
  misc_feature (753)..(753): n is a, c, g, or t
  misc_feature (765)..(765): n is a, c, g, or t
  misc_feature (770)..(770): n is a, c, g, or t
  misc_feature (804)..(804): n is a, c, g, or t
  misc_feature (1040)..(1040): n is a, c, g, or t
atgtgcctcaccgggtctcactgtcatgcaaaggtagatggaacgcagctgagaggtctgacaagatgtaccaggtcccactaccactggatcggagatgggaccctggtacggctccgctatcagcatggtggccctggtcacggtctgctgtccatcttgtccgccttcgctcttcatgcatccatctggtcccttgctcgttccacttcgagagggacgacagacggcgcacagcagcttgtggggtgccgcaattacctgccnctcggtgagctcagccatcggcggggaggtgccccagcgctacgtgtggcgttnctgcatcggcctgcactcggcgcctcgcttcttggtggccttcgcctactggaaccantacctcagctgcacctccccgtgttcctgctatcgcccgntctgccgnctcaanttcggnctcaatgtcgtggagaacgtcgcgttgctagtgctcacttatgtntcctcctccgaggacttcatgctttcatngtgttcattgcctcatccctcgggcacatgctcctcagctgcattctctggcggttgaccaagaagcacacagtaagtcaggaggatcgcaagtnntanagctggaaanagcggctcttnatnatcaanttcatntccttcttctcggcgctggctgtctactttcggcacaacatgtattgtgaggctggagtgtacacnatctttgcnatcctggagtacactgttgtcttaaccaanatggcgttccanatganggcctggtgggacttcgggaacaaggagctgctnataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaanatcacctttacctgagaggccccaagaagctgagctggcagagagctcaccatttggtgct

SEQ ID NO: 619017 - DNA, 657 bp, Homo sapiens
tccacacatgaagcgcgcggcgggtggacatggaagaacttatcttcgaactctccgcttcttcgtcgaagaagaagagagtagtgcacaattcctcatcacaccgcccccctcttcatgagatataataccccgcccttccctggggtggcccacatcaagttcgtcgggcgagagaggtgtgacgatatagcccccacaccacatcacctccttgtcgggggcgcgcggtatatttgtggaccccctcttctccttcacacattttacatatcccccatcatcttctaccgcgcgtatacatgtggcgtaaatacacacgcctccctgtttatacactctcacgccacgcgcgttcaaaataggtttttctctcctacgcgtatagtatctcctcccccaccattatatatatatatggtaagtactctaccctctccccgttgcgtgcaatggtaatactatatacaacaatactatgtattttttatgggcaatatgtgtaaattattctctcgccgcgcgccacattgttgtgcatacgaggccaacaaaatgtgttcccgcccaaatggcaatatcttcttcctctttttgggcccgacaattctgccccatacgtcccccgttggaaaacagctccgccatataccaaga

SEQ ID NO: 619018 - DNA, 826 bp, Homo sapiens
  misc_feature (267)..(267): n is a, c, g, or t
  misc_feature (321)..(321): n is a, c, g, or t
  misc_feature (379)..(379): n is a, c, g, or t
  misc_feature (419)..(419): n is a, c, g, or t
  misc_feature (427)..(427): n is a, c, g, or t
  misc_feature (433)..(433): n is a, c, g, or t
  misc_feature (439)..(439): n is a, c, g, or t
  misc_feature (484)..(484): n is a, c, g, or t
  misc_feature (678)..(678): n is a, c, g, or t
atgtgcctcaccgggtctcactgtcatgcaaaggtagatggaacgcagctgagaggtctgacaagatgtaccaggtcccactaccactggatcggagatgggaccctggtacggctccgctatcagcatggtggccctggtcacggtctgctgtccatcttgtccgccttcgctcttcatgcatccatctggtcccttgctcgttccacttcgagagggacgacagacggcgcacagcagcttgtggggtgccgcaattacctgccnctcggtgagctcagccatcggcggggaggtgccccagcgctacgtgtggcgttnctgcatcggcctgcactcggcgcctcgcttcttggtggccttcgcctactggaaccantacctcagctgcacctccccgtgttcctgctatcgcccgntctgccgnctcaanttcggnctcaatgtcgtggagaacgtcgcgttgctagtgctcacttatgtntcctcctccgaggacttccgtgggtgcctggcatgcacgggaggacgtgcgggaacgtgttccctgcaggggacgggcctgtccctagccacattctggaccttcctacttcgtggtgtgggcactccgctgtcgatgtggctcccgaatcctcttttcccttccagcctatccgactgactgatgctttcatngtgttcattgcctcatccctcgggcacatgctcctcagctgcattctctggcggttgaccaagaagcacacagtaagtcaggaggtacggtctatccctagcgggggctccaaggcagaccagaagagaatcaggacatctgtcctca

SEQ ID NO: 619019 - DNA, 834 bp, Homo sapiens
  misc_feature (30)..(30): n is a, c, g, or t
  misc_feature (83)..(83): n is a, c, g, or t
  misc_feature (87)..(87): n is a, c, g, or t
  misc_feature (94)..(94): n is a, c, g, or t
  misc_feature (97)..(97): n is a, c, g, or t
  misc_feature (115)..(115): n is a, c, g, or t
  misc_feature (119)..(120): n is a, c, g, or t
  misc_feature (128)..(128): n is a, c, g, or t
  misc_feature (130)..(132): n is a, c, g, or t
  misc_feature (134)..(134): n is a, c, g, or t
  misc_feature (141)..(141): n is a, c, g, or t
  misc_feature (144)..(145): n is a, c, g, or t
  misc_feature (150)..(150): n is a, c, g, or t
  misc_feature (158)..(158): n is a, c, g, or t
  misc_feature (173)..(176): n is a, c, g, or t
  misc_feature (180)..(180): n is a, c, g, or t
  misc_feature (186)..(186): n is a, c, g, or t
  misc_feature (191)..(192): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (224)..(224): n is a, c, g, or t
  misc_feature (232)..(232): n is a, c, g, or t
  misc_feature (238)..(239): n is a, c, g, or t
  misc_feature (264)..(266): n is a, c, g, or t
  misc_feature (268)..(268): n is a, c, g, or t
  misc_feature (279)..(280): n is a, c, g, or t
  misc_feature (285)..(287): n is a, c, g, or t
  misc_feature (289)..(289): n is a, c, g, or t
  misc_feature (292)..(293): n is a, c, g, or t
  misc_feature (419)..(419): n is a, c, g, or t
  misc_feature (423)..(423): n is a, c, g, or t
  misc_feature (518)..(518): n is a, c, g, or t
  misc_feature (539)..(539): n is a, c, g, or t
  misc_feature (547)..(547): n is a, c, g, or t
  misc_feature (570)..(570): n is a, c, g, or t
  misc_feature (593)..(593): n is a, c, g, or t
  misc_feature (601)..(601): n is a, c, g, or t
  misc_feature (636)..(636): n is a, c, g, or t
  misc_feature (640)..(640): n is a, c, g, or t
  misc_feature (734)..(734): n is a, c, g, or t
  misc_feature (756)..(756): n is a, c, g, or t
  misc_feature (763)..(763): n is a, c, g, or t
  misc_feature (786)..(786): n is a, c, g, or t
  misc_feature (788)..(788): n is a, c, g, or t
  misc_feature (797)..(797): n is a, c, g, or t
  misc_feature (809)..(809): n is a, c, g, or t
  misc_feature (816)..(816): n is a, c, g, or t
aaccaccagtgtcggaggtgttcaatacantgcccaagagtactgcagagaagcgacgaggaggccaggctctacgggggatnagcntgtgctnatnacaatgggcccggagagnaggnnaaaatgtnannnanataggtnaannaaatnatgggggntgtggggaagacacnnnntgcntgggcnatggnnagctctagnggattntgattnactgtaaatgntgggttgntaaaannaaataagatgttaatggaagttggnnncntttatgaaaannaattnnnanagnnagtgggaactgccagaggaagatctggcgtcacatggtcccaggaaagtgctgtgccctatccccactgataccatctgattccccgatgcctgtgcctgttccacctggacggtggccccctcangccnggcagcctctggacagagaggaaggaaggattggaaaagtccccgcagcacagcgacggtgggaagatgccttacgtctgatcttgatgggggcnctggcctggagcctgggcccncctgcttntggggggttggggagcaggccanatggaggtggtggtgccaggaanaaatggancgatgactgactgtggggtgggcccaggatttccncatnttggtgaagttgcccctgggaagggcagctgggggcagtggcgccagttcccttccatggtctcccggctggcaatgtggtgaagctgagtttntgtccaatgagcaggaagattntgagacntttcgcctgagatataagttggncnggggatgcngtttttcccccnaaaattnaattgcttttgccaatca

SEQ ID NO: 619020 - DNA, 534 bp, Homo sapiens
tcggcagtcctacggaaagtccattttacaaaagttatagtataaataatttttctgaaccagaaccggttggcgggatctcagttaagtccacttggcagtttccagacacaaggactcatattcaacttttctcttaaaggatccaggggctggatcccggacatttcctcttaaagaggaatcttatgtcatcttcggaaatcatgtatatgggtaataatataagtgtcttctcttcggaagaggtgatcctttaaaggccaggttctcttccctcgtgtgaccgtgacttagatggtagcagcactagaagctataaggggattgggggcagttgaggaagccttaggtaatggtcaagagtagaagtatttttaaaaagcggtggagaggggttggggaggggatttggtcccgggctgaagcgggtccaggccggggtaacctttacttataaaagaatcccaggaacacacaaaatattcttctcctcttactttggcaatccagttgtggaggcaaaaaataatc

SEQ ID NO: 619021 - DNA, 186 bp, Homo sapiens
tgctgtgtgctgggctgtctgcttcggagggtccttgtttttatttatttattattatttttttgagatggagttttgctcttgttgcccagggtggagtgcaatggtgcaatctcggctcactgcaaccaccgcctcctgggttcaagcgattctcctgcctcagcctaccaaatgaggtgagat

SEQ ID NO: 619022 - DNA, 102 bp, Homo sapiens
actgctgctgactattgttgctgcgaagcaagatgactcccatctccagtcctctccaaggttctgcttgctcacaccctggatacctgtggaggaaggaag

SEQ ID NO: 619023 - DNA, 403 bp, Homo sapiens
acagtatgtgccctagaaaaccctctaatgtttataccaaaggcacagtatagggccaacagcttagggtacacagggactcaaaagttgttacatagcagagagcatctcacaagaccgagcttgggacctctattggctcaaggtcctccggaacaggtgctaagagcacacacaaagaaaaatgtggttgttctcccatgtcaggctcagttgagccaaagtcatggtccaggaattagagcctcttcatgtccgtgcgcagattatcaaaccccatgcgcattcacaagctgttccagttccagagcacatatgaggtgtctgcacagttgagtcacagaagagcgagctctagagatatctctagtgatcacatattgataatattatcaccccatca

SEQ ID NO: 619024 - DNA, 615 bp, Homo sapiens
tcatttgttaccccggagtaaggatatcgtcgacccaggcctcgcaccctggagcccgccaccagacttctggtggtgacagaaggtcccggaagagcccatcacagagagccaccacacgtctccactaccatggctaccacatgctgccacaatgcacaggggacccgactgtggccacagtgcctgccacagatggccaccgacacccccagcaccccatgcagcacccccgttttacggcatacacactgctgattataaggaccacatggcgtacggaggcttctgcctctcccactgaccacagtggctacggcacgggccactacccccgaggacgccctccaccgcccaaacacggcaggaatgtacttggacaccgaggccaccaacaaccagagctggtcaagacacagactaacatcacggacaaagagcaacttacacaggaacggaccaccaacccaaggagaccatgacaatcacatgaagagggagcaccgctgacacctgggggaccaactagacccatggaacccacaagagggtgggcacacgacacccaactccagagaccttccagaacacaaaccggatgagccagaaagtccg

SEQ ID NO: 619025 - DNA, 280 bp, Homo sapiens
gcaggagaatcgcttgaacccgggaggtggaggttgtggtgaaccaagatcgtgccattgcactccagcctgggaaacaagagtgaaactcggtctcaaaaaaaaaaaaaaaaaatttaataaggttggaggaaggtttccaattttgtgtgggccttatttaaaggttgcattgggttgaatcccccttacagccgggggttggcacaagcttgttttggggggttgttcaccttttggatccccttaaatcgtgacttaacttaaataaacacctttg

SEQ ID NO: 619026 - DNA, 158 bp, Homo sapiens
tacaggcatgagatggtctagtaaggataaactatgttaggaaaaacaagacactctctgctgcatctaaatcaacgtgcagtgcaccaactcttggaacacaactacagaattccactgttcagtcccatcaatattataatacccagaagatttcc

SEQ ID NO: 619027 - DNA, 517 bp, Homo sapiens
ctttctttgaggcatccccgccgaagaatgctgtcctctactgcttgggtgtgttgaggatagctgaatgtcatcgactggcgccggtaagcctgtttagtacaagcctggagactgctttctatctgggccttcagtaatgctctgtttgcacccttcatgtcttgtctcagagtagtcattagtagaacgatacatgctggtggacttcttagactcaggagttccagggccctggtggggctctagggagacccgtatgcgctgctgccgggtggtgatgccagtgccctcggctatctggattggctgcatgctggctcggcgcagggtctcttgggggtctccagttttcatctcctcatctgtgatggtgcccaggctcagggaaggcctggactccaggggatagcaggtcttcagatgtggggggcacactcgattgcgctgctgcagctctgcaaggaacccacgggcagaggaggaagaattccatcctggagttcaattactgtga

SEQ ID NO: 619028 - DNA, 320 bp, Homo sapiens
actgctgtcactccacccagttcctctccatgtgagatgtatcaggccctgtgcctggcggctgtgctgtgaacttcaccaggcggagtgggcttcgctggatatttcgcagaggaaactctacagggaagtgatgctggacacttacaggaacctgacctctatagggaaaaagtggaaagaccagaacattgcatatgagcaccaaaaccccaggcgaaacttcaggagtctcatagaagggaatgtcactgcacttcaagaagacagtcattgtggagaaacttttacccaggttccagatgacaggctgaacttcc

SEQ ID NO: 619029 - DNA, 936 bp, Homo sapiens
gggtatttagagcgcagcggatgacgggccggatctgcttcgccggcgccggccgtaaatcttcgtgcccggtgctgtgtcgctggcgtgagttcttatggcttctttgaaagtacagtggatgcatcaaaggactgtcgaaaatctccctatcccagaatgctgacggatgtcacatggaaagctggcacttggccaaactttgtggccctaagaatcgaagtgttaggcatcttgcctgtgaccagatgcgcttcatacggacttggtgctacgtgggaggatcccgacagtacgagattccatgggacccatggacccttgactacatgctcaccccccgagggcgaccattcaccaaagtaaagcagtgcgtgctagtacaaagcggtcatctccataactgggcaatgaacactggaagatcgtgcttcaatgtgtgctcaagcaaggggatcctctaccagtagccggagcgcgagcgaggtcatccctctggtctcggtgaacatggggggggagcaagttgcggggcttagggggcacaaggaaccgaatactgtgtgtgcattgatcttggatgtcaattttctacccgacagtgctctgcctggtaatgaataatcgataggaaggatgcaaatgcgcaacgtgagatgcctctaacgaatgccacagagtggtgaataattatttatagaccaggcgtagttactaaagaatgaataaactgattatatatccatgagcatgatccccagttaatgggcatgagattgcagagtcaatagtccgtaatggtccgacacggggagaaatagagcagtataataaagggagagactgcttgtagattaaagaaagaatcttacacggtgtattctaaataattataagaagagtatatagaatataaataaaatgatagcagagaaa

SEQ ID NO: 619030 - DNA, 351 bp, Homo sapiens
gagtgcaagatctggaaaaggacagatgctggtatgactgacctcacttctgtgcaagagcttggagcactgtctttcaagcctgagtctctctctctctctctcttttttttttttttaaacagagtcttgctctgtcacccaggctggagtgcaggggtacaatctcggctcactgcaacctccgcctcccgggttcaagcaattcttctgcctcagaatcctgagtagctgggattacaggtgcccaccaccatgcctggctaattttggtattttttaagtaaagatggggtttcaccgtgtgggtcaggctggtcttgaactcctgaccgcaggtaatccacccgc

SEQ ID NO: 619031 - DNA, 306 bp, Homo sapiens
acgctgcacgcgttcaaattgctttgtactccatctgccgtcgcagaactgcccaccctgctgcaaaatacgtgcgttgagctgggcttagcggattgctgccggtggggtcatcaatcgcaatccgtaagtcttcaagacagacaaccgcttgtgtctcgataagcgctcggttcagttaatgcatggcatcgtacacaaatccgcacaaggcgcgcttgtactttggcaagcctagttttggcccgttgccgtctgcgcaaacccagttgtttacgagacatacaccgttgcaagtaacgcagg

SEQ ID NO: 619032 - DNA, 353 bp, Homo sapiens
  misc_feature (163)..(163): n is a, c, g, or t
  misc_feature (198)..(198): n is a, c, g, or t
tctagatgatcccggctatcacatatcatcagtgttctctattcaacttgttataccttatgaagcttctctcttcaagataagcaaagtattagaatccacttggaatcccaattcaatttgtgcctcaaattctgcagatggataccttcggactcccaanaaatccaactacatacaaaaacttaatgcagcctntgtactacatttaaggcactatgtgagaacaagttaaaaaggtgtaggtcactttcccacttgtttaactttgatgcttaatttttactgggaggtcattaaacagaaataatggataaatgttgataagccggggtaccgaagctcgagatttc

SEQ ID NO: 619033 - DNA, 256 bp, Homo sapiens
caacctcagccttacaagtagctgggattacaggtgcccaccaccatgcctggctaatttttgtatttatagttgaggtggggtttagccagattggccaggctggtctcgaactcctaacctcaggtgatccacccgcctcggactcccaaagtgctgtgattacaggtgtgagccactgtgcccggccagcacctaatgtgtatcttcactaattttcccctactagaatgtcagctccaaagcctgttaggcc

SEQ ID NO: 619034 - DNA, 265 bp, Homo sapiens
gacagaggggaacaagatggcggcgccgaaggggagcctcttggttgaggacccaacttggggcttccggcgcttctgctgctgaccatggcctttgcccgaggttcggggaccccttcggctgaagcatttgactcggtcttgggtgatacggcgtcttggccaccccggcctgtcagttgacctaccccttgcacacactaccctcaagggagaggagttgtacgcatgtcagagagagttgcagactgttttcaaattgtca

SEQ ID NO: 619035 - DNA, 291 bp, Homo sapiens
caaggtctctggaaaagggtgtaatgttagacagtgaggattgttaaaggcacgagccatactcctactcggagtagcttgacagatgtccctactggtgttggaaatgagttccttagctccatcaccacagaggacagagtacgacagcgacgccggtcaaagggcaggccacaagataagttgcaggtggtcactgtggaaacactctgtagcaacccttccctggccctgacccttggacctggttccatgtcccccccaggcctggctgggtggccccagtgcagg

SEQ ID NO: 619036 - DNA, 175 bp, Homo sapiens
taggctcatggcgtctactatgacactttgacgcatcgttcttaggaatatcccgcgtcatacacctagtcacgatgttgttggttgcattgtttacgcgaaaagcacgcgatgagatggagaatgtcgcgcacgtctcatcgttgcgcaagcgtgggtaccgcacgctcgatac

SEQ ID NO: 619037 - DNA, 671 bp, Homo sapiens
  misc_feature (327)..(327): n is a, c, g, or t
  misc_feature (477)..(477): n is a, c, g, or t
aggatgactattttcccacacagtactagcagctgcttgggaagcatagtgttaggtatttgacctgacctggcctgtaggccccaaacgatgatcgcctgcacagggctgcatgcataataaagtcctacttttcttgcctcgctcgtgatcggtggaactgcacctgagaacaggtgctgcagaccagtgacgctggtacatgggacttatatttttacttactaactacaagaaaggaaaggagccagctcaaacttgatttggagcctgatgactgtgcatgctatggctgcgataatatattatataatgaaactgcatgtngcaaccgggacgaagatgagatgggaaacgccaaacgctttggttattagatggtcataagcatgctctgtttcactaggtggttgagttccagaatgttcttttgttttctaggccttgaagaaacacgtgcctgagcctagatgagtngactacaatttactgcacttaatacctcacacgttgaactatctatacgcctttgttacccacggcaatgctgttggagatatgtgatgttacacagcatactgcatagctgtttcggcccgagtggctataaccatatagggaatgcatgatggtttattgagagacccgttatttcatggcaatgcttcttc

SEQ ID NO: 619038 - DNA, 276 bp, Homo sapiens
cggacttgtgaagaatggacctgtgcaataaagcatgacagtctgagactaggtccctgccctcatggagcacatgaaccataatcatttccatttgcacctttttcacttcccctcattcagaaaattgcacacagaatcacagtaggagagctctatccgtggtcatcataaaacttacaaatacgcaaacatggaacaactgctaagcagaaagtttctctatgttctgtacactccatattctccctcttatgggtgcatcctggtatctgg

SEQ ID NO: 619039 - DNA, 1040 bp, Homo sapiens
gatgactgcctgtgtgcatgcgtgtggtgtgtgccctggtggtgcccgtgtgtgtgccctgtgtgatggggaacctgctgtgtgtgcattcctgctgtgatgtgtttctgtgcatgtgtgcatcctgtgtggcctggggtctgctggcctgtgtgactgtgtgtgcctgtgtgtgcctgatgtgcctgctgtgatgcatctgctgtgatgtgcaatggcctgaggataatgtgagttggatgccctgacaccaatgtttggtgcctgcttgtgtcaatggacatgaagatcaatgtccctggatgtgagatctatctcttctccctgcccattaatggaatcagagatcattgatttcttcctgggggcctctctcaaggatgaggtttcgaagattatgccagtgcagaagcagagccgtgcctggcagcgcaccaggttcaaggcatttgtatgctatctggggactacaatggccacgtcggtctgggtgttaagtgctccaatggcagtgttggcaacgccatcctgtggtggccatcatcctggccaagctctccatcgtccccgtgctgcagaggctactgggggaacacggatcggcaagccccacactgtcccttgcaagggtgacaggccgctgccggctctgtgctggtacggctcatcccttgcacccaggggcactggcatcggtctccgcacctgtgcctaaggaagctgctcatgatggctggtatcgactgccttgctacacctcaggcccggggctgccttgccacccgtggccacttcggccaagtgcccttttgatgccatttctaagacctacatgtaccttgcccccgactctggaacgggcagacgtggaattctccaactgtttccgtatcagggaagtcactggcgagcttggtaagaacccaagcaagagtctgcggacagggacctcaggtcccaatgttgctaaacatagggtttattccgtaacatctgtgactatcgtgaacaaacaagtcgcgccagaatcgtaggtccct

SEQ ID NO: 619040 - DNA, 360 bp, Homo sapiens
gagccctgtgattgtgtggtgtatgaaagaggagatcaagttgctcgcgaaaaatgatacatgggaactcacttctctaccgcccaacaaaagtctcataggcgtgaaagtgggtgtacaaaataaaaaaccaatccagatggttctatcaccataaacaaagctcgattggttgcgaaagggtataaacaaaaggaatgagaagatttcgacgaacagcgttgccgaattgggaatacgaagcaaattaagtttacgggaggcattcttgaagtaaactaaatttaattaacagccttttagtattcttactttaaataaatgtctagaaataaattagggacataacaccacacaatt

SEQ ID NO: 619041 - DNA, 154 bp, Homo sapiens
gccccccccccccccccccccccgcccgaacaacaggggcaaaacagccttcctttaaagtttttccaagtcccctttttaccctttttttggggcccaccctggtttgggtttcttttttttagtttcagtaaaactttacccttttttccca

SEQ ID NO: 619042 - DNA, 459 bp, Homo sapiens
ctgtcgctctcgcggccgcctcattctgccgtgggcgcttctgcgcctgctgcgccggtgccgcttccgggggtttggctgcgcctggctgtccctccgcgggctctgtggctgcttgccgcgtctgccctgcgcgcttttcggtctgtttgtcgtcggccgctggcgcttgctctccttctgcctccatcaggcatcatcaccaggccggggtcagctcatgtgttttgtccaggggttgcacactgcagtgtgcaggcgtcattcatcaccatcaccgcctcagttttccagcagtcactgcggcccagtcatcattgcaccccagcgcatggggggacttctgcaccatggagctttcaaggcagtccatcacagtggcagtcctgtccacgcaggtcatctttcatcataccacgctcattgtgtccagctcgtcctcttccagttgttggctcc

SEQ ID NO: 619043 - DNA, 237 bp, Homo sapiens
  misc_feature (194)..(194): n is a, c, g, or t
  misc_feature (202)..(202): n is a, c, g, or t
tttccgtgtaagtttggaaggtgatccttggaaacaccaattatttactccataccaacatccaaaagatcacttgacattttcattggtttgacttcagaattagaaactctactttttataaaataaacattataaactataaattgtgcctacccagtcaacagtcattgccgaagcttttcatgactttntgattgantaatctgaattagagattttttcaataatgttaca

SEQ ID NO: 619044 - DNA, 612 bp, Homo sapiens
tgttctagaggatcctccaacgctgctgcacagacaaccctatgaagcaggtacactgtggtttccatttgaagatgaaagatagtgaccagggacagtggctcatgctcagcactttgggcggacaaggcaggtgggtcacgggaggtaaggagtttgagaccagcctgatccgaacatggcgaaatccatgtctctacgaaaaatacaaaaaaagattgggcgggtgtggtagatacgtgcctgtggtcccggctatttgggaggctgaggcaggagaattgcttgagcaccagaggtggaggtccaatgagtcgagatcatgccactccagcctgggcgacagagtgagactgtctcaaaaatttttttttttagagtttaagatgagaaagcaaagggaaccttttcctctatgtggaaatacttcctgggaatcattgggtagattctcatagaagggtagtcagagtcttccaccagtagtcaggaaattcaagtttcacaatccttttcataaacccctctgatcttctaggtgaggacactgaggtccagtgagtgcaagtgattacttctgggcagagccaggcccgtgccagggcctctggt

SEQ ID NO: 619045 - DNA, 386 bp, Homo sapiens
caaggaaggctctcaatcactgaaacttattaatattactggtgttagagaaatgaatgagcctacaaaatgataggactgttcctgtggtgtatgcctcggggtaatccgagtaacgtcggggcgtatccggataggccgagaaagtgttgtgggaagaacgttagatttacgccgattaatattgatagtgaaatggattttggcgtaggtttggtctagggtttagcctaagaataagggaaatccagtgactgaagcctcctatgatggccaattccactcctaattgataggaccatagtggaattgggctacaacgtagtaacgtgtcgggtaagtccgatgtctagtgaatggacgtttagctagtgccattgccaggt

SEQ ID NO: 619046 - DNA, 1063 bp, Homo sapiens
cgggcgtgttcgctggtggcgtcgggaagccgagccggactggttacaggatgatcacggacgtgcacgctcgccatcttcgtcctaacatgctgggcgtgtcgctcttcttgtcttgtactgttctctatcactacgtggccgtcaacaatcccaagaagcaggaatgagaagtggcgcttgtctccgccgccagggttccaggacatagtctgaggcaagatggagggtatgaggggccttcagcacttcacttcatcccttctaccgcatctacaagcatacagaagcaattacgcctggattatccaaacaacttttagttgtccgtcgagagtcttgccttaatccgtatggaacgaaggaagcgtgcctagctggaataggggcccagatatagggggcttgctattgacgtactcggcgtccccgcactaatatcaaagacgtatagacgttttgaacaatgaagcaatgaatagggaattctcccaggtcagacttaccacactacaaagagtagagaggaaggggacttagaaaaaatgccccgggggtgaggcggcccataaaccagggtacagcaccacaaaggcagctctgaaaagaaggaggagcacacaacactagaagtcgatgtggataaaggcgacgaactacaagggggcacgcgggacagaaacaggagcacatgacatcggacacacgcgcaggaaagagcagtgaagcaacccctggtcaagcgaagcacgcacaaactgggcgcgggggacgaaccacaaaaatgtggttacctcaaatacaccccctacgaagaaaccagacccaaagaggccacacctaaaacactggaacaactgatatagctgaaagctactcaacaagacctagtatattgccagctaccggtacacaccagtattttagaataatggaaaagattgatcaaacctctattatacacgagacagacagtaaagaaagaaagaaacgcagtaaccgtgacgccgtcccccagtggtccaaacagcgtcacattgacgcttagtgccaagacgatccg

SEQ ID NO: 619047 - DNA, 1028 bp, Homo sapiens
  misc_feature (94)..(94): n is a, c, g, or t
  misc_feature (157)..(157): n is a, c, g, or t
  misc_feature (232)..(232): n is a, c, g, or t
  misc_feature (248)..(248): n is a, c, g, or t
  misc_feature (334)..(334): n is a, c, g, or t
  misc_feature (364)..(364): n is a, c, g, or t
gctggagtctggggctgcggcttcccagaggcgcgagtcgcttttccagtgagcctgaggcccaaacggtggcctgggcctgaagggtcccccngccatgccctgctggcctgcgccatcaatctgcctgcctgcctcgtccctgcttctctgtgcntgagtgctgcctgctgctggccatggcagctggtgtccatgtgcctcatgcctgctgctgcccagggtgcctccngtgggccctccctggngtcagcatgcccggggtgaaactgaccacccaggcctactgcaagatggtgctgcacggcgccaagtacccgcactgcgccgtcanacgggctcctggtggcctgagaagcagaangccgcgtaaggagcaacatacacctgggacggcccggcagcccaccacacccatctatcagtggactgcatccccctcttccacggacaccctggcccatcagcccccatgctggaggtggctctcaccctgatcgattcatggtgcaaaccgatcatagctacgtgatgctggtcattatcaagctactgagcgaataacacaggatgccagtccaaaccaggaagccaagcacgtggcctccagaatcgccagaggctacaagcgagaaatgagaccatcaaggacgagaacagcacagaaacgatggacaggaagcgactacgagccacgagaacgagcacaagagaacagatgggaggagcagaagacccaacccagcacaaagagcagaatgccaaaagacaaaagagaaccagcacgccctggaaggccgcctcacaaaccacggagccgcacaccccgcgctacaacggcaagccgaaaaacagaagaaatagagggggcatagcgttgtggacggcggacgcgtggactgctccggactacctacttagccggacctagtaacgagaaaaactggaaggtggaggggcagacgaagagagaagcaagaaatagagagcggtcagaggagacagtacaggaagcagaggcggatcag

SEQ ID NO: 619048 - DNA, 392 bp, Homo sapiens
cctgacgaccatccaccccaacacggccgtttctttctttcttttatttttttgagatggagtctcgctctgtcgacccaggctggagtgcaatggtgcgatctcggctcactgcaatctctccctcccggtgagaggtgaagccagctggacttcctgggtctagtggggacttggagaacttttctgtctagctaaagatttgtaaatgcaccaatcagtgctgtgtctagctaaagtttgtaaacgtaccaatcagcactctgtaaaaatgggccaatcagcactctgtaaaatggaccaatcagcactctgtaaaatggaccagtcagcaggatgtgggcggggtcaaataaaggaataaaaagctggttaccgagccggcagtggca

SEQ ID NO: 619049 - DNA, 653 bp, Homo sapiens
  misc_feature (28)..(28): n is a, c, g, or t
  misc_feature (146)..(146): n is a, c, g, or t
  misc_feature (174)..(174): n is a, c, g, or t
atgtatctgtatgttggtccttctttgngaatgtttttcgaggatgagaagcttgccttcttatcctagatagatgcagaatttgagaaggtagaatttctatacatgacacaatctgttagtggacttgagaatctcattaagantacactgttgggtgtagtggtgtatgcntgtagtcccagttactcaggagcttgaggaaggaggattggttaagtgcagatgttttgggctgtagtgtgctatgccagttgggtgtccacactaagttcagcattagtattgtgacctcccaggagctgagaccaccagttgcccaaggagaggtgaactggcccagatcagaaacagagcaggtcggccaggtgcagtggttcatgcctgtagttccagcgctttgggaggccaaggcgggaggaccccctgagcccaggagtttaagaccagcctgggcaacaaaatgagaccttctctacaaaaaaataatcaaaaaattagccaggcatagtggcacatgcctgtggtcccagctacacaggaggccaaggtgggaggatcacctgagcctaggaggttgaggctccagtgagccatgtttgtaccactgtactcaagcctaggccacacagagagaccttttctcaaaagaa

SEQ ID NO: 619050 - DNA, 244 bp, Homo sapiens
tactaactctgtgaagttgggcatttaatttttctaaacatctctgaaccccattttccccatctgaaaagtgggaatgctaatactttgcaagactgttgtagagatgcaaccaaatagtgtgcaggcctggcatggtgcccaaagcagagtgggcacacgcagtgttggctgcacccaccttccttatacattgattgcagaacatagaaatgaacctgagaagaacgtgaaagtgaacctg

SEQ ID NO: 619051 - DNA, 1545 bp, Homo sapiens
gctgccacctcacccaccgcaattcatttatgtagcatgtgcacatgtggtgcatgctccgtgccacgtgctttctcagtgcctatgcctgtgagcctcgaggtgcttggatgagctgtggaaggacatggctagttgctcggggcagttgcatgcagtgacatcaccatggagggcgaacgcggccacgcggacaggcggtggccccgtggacattgcagcagcacagggaggctgcaggggcgctcaggcctgcggtgcagcgcggtcccacgagggcacctggcggcccaaggggtctgggtgctgggagagcggccccacagtgtggactatgggtggactgctggtaatgcccttcaacctgctcaaggccccttgggggcttggccttttggcgcagacgaggtacagcaatccgatggtggacgtccaaggtgcaattggagtgcaaaggacccaagaacataggggcgaatggcggggaccgggtgcctggaggtgaagtgacgctcttcagggaacgggagggattgcgtggcagggcacgggatgtgacaccgaagcgcaaggctagggccgcgcgaagccgggccgaggggcacctgggcgccttcacgagaaagccccaggtgggcacaaagggcgcggaggccatcagccaggatgccgggaagacgaggaagccccggaggaatccgcgagagccctaacaaagcgcggtacacgggggcctgtggcgaggcacgaaagcggtccgaggagtcctacccaaagcttggggaggagtggcgaccagcgttagccccaaaaccaaacagtagtaggccccaagaagagggccaccagagggaacaggccaatgggtcacccagggagtgggcaacctcgtttgaactaaaacgccacgaggagcatattggcacactgggggaccccggaggtatgattggacacgggccagagagcgcaccccggcgagcagacagggcccacgaagtatccagcgagctcttcccgcgtgagtaacccgaacccgctataatgaggtccactgtgggctgtgcggtggacctatgtgcggtgtagacagaacatagcgcgaggaggaatacgtgtgattctctcgttatgacactatttccactgacgccaagcggcgggcattagcgcgaagcacactatattgtgtcgtgtgtccaccttcttggtgactcccccccagaaagccgcgaactcatattgtttagtacaaacaggtggtgggtaaacccacgcagattaacgacctgtgtggcgccgctgtatcattctcgggacacaagatacaaccccgctcttttgtcgtgtgacgcgaggtaagcataagtcgtccgcccagtcctacaacctcactagttgttcagcttcgtagatggaatacaactatcttcataacatgaatgaggatggaaagtcacccgtcttttgagtcatattaattatcaacatggatggtgacctggcgtagcaagccacatgctgaggtatctttgtacaacgctg

SEQ ID NO: 619052 - DNA, 198 bp, Homo sapiens
cactcactaatagctccaaatgaaccacagttatatcccaatggaggatttatatcttaagttcttgtactaaaaaaaaaaaatccataccaaaatatttatacaaattaagattgcatgtaggttttaaaaaacggcatttgtatgattgtaagacatacattatggggctcaggtaattatcattagcttacaaaa

SEQ ID NO: 619053 - DNA, 107 bp, Homo sapiens
acccgtcttcgaatcagcttcacgaagtcgggttgtgacttcgatccgaactgagagaggataaagggattagcatacggtcacccgctagctgccttctgtacccc

SEQ ID NO: 619054 - DNA, 302 bp, Homo sapiens
tgaggtcccgaagatcactcatcggtgcttgggagagacagagtgtgagggtggagagttcagcatatcaaagcaccatattcccaggtatcattttctgagccccaacaatacacacacacacacacacacacacacacacacacacacaaaaatatagtgtgtctttttttttgtgacgcgggggatatcttgggtgagacagagacgagtgagtgggggggggggccccagcgagtggctacagaatgagggggctgctccccagaagacgcccaggtgcgaggtgcacttgtgcaacg

SEQ ID NO: 619055 - DNA, 364 bp, Homo sapiens
caaagtgggaatgaaggaccattaagaaatcatctctgtgccatgcgcggtggctcaagcctgtaatcccagcactttgggaggccgaggcgggtggatcacctgagctcgggagttcgaggccagcctggccaatatggtgaaaccctgtctctactaaaaatacaaaaaaaaaaaaaaaaaaaaaaaatagctggatgtgatggcatgtacctgtagtcccagctactcaggaggctgaggcagaagaatcgcttgaacccaggaggcagaggttgcagtgagctgagattgctccattgcactccagcctgagaaacaaaagcaaaactctgtccccaccccccccaaaaaaaaggaagga

SEQ ID NO: 619056 - DNA, 1393 bp, Homo sapiens
  misc_feature (691)..(691): n is a, c, g, or t
  misc_feature (828)..(828): n is a, c, g, or t
  misc_feature (1272)..(1272): n is a, c, g, or t
gaggagaagcaggagctgtcgggccataggatcaataatccagtcgtggatgaccagacgcgatccttatctccaagcaagtgcagctgaatctgcccgagtggcttgggccggcgccctggggccccgtcaacggagccaatgctgcacgaaccgttgcgcaggccgcgtgctgacacacggcttgttgtaaccactcgcgtaggatgaagctctgcatcacttcgtcgtggacacaggcgcatccaacggactaacttccgtgtaacccaagctagtagcgtggtcagtgcatggtcaaacagcttgaacagatctagcttctcaggaatcgcataggcaaaggcatgaggaagaagaaccatagcagaccaattgacatgttgtttgctctccaaatgtcgcttgcggcactagatgtcacttagcttgaaaggaccaaaagggactgccgacgaattggaccaccacacgcgcggtcgttggcataggaaatagggctatgtggtcgtcgtagccactctagtagttggtagggcccccataggggctcccaagggaggccctcgaatttgtccaggaaacttggcactgcgcagaaggtaaatggagcggacaattgagcctatgcaggagcatgcaatgtctcggagtggctaataccggtagctgtccctatgtgagaatgtcnttggacccacccctggacacggggtgggtacctcccagtccctaaccatgcataggagcggtcgcaagacgtttcgcccggtgaaaggtatccctccgatggatgaatcaatccttttaatgaataactaactcatntggtacagaacacccatattaagaaccatcgggaaaaggggtccttttctggacggaagcttggtgtatttggccagacccgaatttggtgaccttccccttggtttttgggacacattgaaaggccaaggggccaatctttcacctttgggggcacgccatgagagatggcctcccaatcgttggaagccggcctccccaaacccctgaaaaaaggacagttccaccttgggaacacctggggcagggggaacaccccggttctttcgtgagaggccattgcgagattgtttgagcacagaaaaggccaatgaggaacatccttggggggaccccccaaagagtccccccccaaagtttgattcgaaaggaaggacaaggcaagaagaggggcggggggtcactatttacaaaaaacaaatttcctgttgtggcaccaagganccccacaaaagcgaacgagagggtttaccaaaggcttatttcattttgggcatccccactttttacaagggaccgccgacacgaggtacgccctataccccatccaagtttttttccccaa

SEQ ID NO: 619057 - DNA, 167 bp, Homo sapiens
gacccagatgatgtggtacacgtggccaaagaagagcctggtgctggtgcatgtgcttggactagcatttatgctggacgggtgttattctacggaggagcatacttgtacaaaatatttggcacttcaaccacgatgacgtgtactacctgtggacataaacgtac

SEQ ID NO: 619058 - DNA, 273 bp, Homo sapiens
  misc_feature (51)..(51): n is a, c, g, or t
  misc_feature (121)..(121): n is a, c, g, or t
gccactcatgcactagtactctcctggtccggaaaatcctcagactcctgnccataaacacccatgctactggggtggtcctgtcggaatgaactctgctgcccgtagctgctgctctgtnggctatattgacttggagcttggctgtaggatccagttaggggagggtacctagtgggaggctgctagccatagctgcattgttgaccatagctactctgctgtccatagctgctctgttgtccatatgtgttctgctgacagtcactgctc

SEQ ID NO: 619059 - DNA, 627 bp, Homo sapiens
  misc_feature (1)..(1): n is a, c, g, or t
  misc_feature (24)..(24): n is a, c, g, or t
ncttgtgtcccgaggcaagccagncagtgcctggaggtggtggcaatgagcggtgctataatatccctagaattatggccttatttcactcaggtttctatatatgattcctttgttgctgttaaatacaaattggttctgcttctcactccagcctctggtccaagtgctgtcccacctccaccctgagtctggtcacctcacagctgtgtaaggtcagcagcgacagtcggctgaaatttccacatggaacaatgcattgggagagcattatttgctgggaataagtcagttattactcaattttttaaaaatggttcaattaattgctaaagtcaaaaaatagcatgttttcaagttgacaatttaccgtagaaaagaaaaaagaataatatgtaataaatctgattttgaacattaagaggtactcagtttttatcaactaaataaatgttgcagaaatatttagagaaccctagcttggaagggtgccaaacttattctgctggggcattcccagtgttctagacggccttccggactgtgcagaaggaagagcggcacagttgctctgcatctgtggatttggtgtgaagaagtaacaacagacaatgctcatctgctgtg

SEQ ID NO: 619060 - DNA, 115 bp, Homo sapiens
catcttccccactgctgcaccactttgcactgtgcctgctgtctgctggtgccctgcaccctgctctctgttggtgcacagcaccatgcagtctgatggtgcacagcacactgtg

SEQ ID NO: 619061 - DNA, 614 bp, Homo sapiens
  misc_feature (21)..(21): n is a, c, g, or t
  misc_feature (29)..(29): n is a, c, g, or t
  misc_feature (53)..(53): n is a, c, g, or t
  misc_feature (59)..(59): n is a, c, g, or t
  misc_feature (65)..(65): n is a, c, g, or t
  misc_feature (76)..(76): n is a, c, g, or t
  misc_feature (96)..(96): n is a, c, g, or t
  misc_feature (108)..(108): n is a, c, g, or t
  misc_feature (154)..(154): n is a, c, g, or t
  misc_feature (193)..(193): n is a, c, g, or t
  misc_feature (197)..(197): n is a, c, g, or t
  misc_feature (205)..(205): n is a, c, g, or t
  misc_feature (211)..(211): n is a, c, g, or t
  misc_feature (219)..(220): n is a, c, g, or t
  misc_feature (226)..(226): n is a, c, g, or t
  misc_feature (232)..(232): n is a, c, g, or t
  misc_feature (235)..(235): n is a, c, g, or t
  misc_feature (261)..(261): n is a, c, g, or t
  misc_feature (266)..(266): n is a, c, g, or t
  misc_feature (273)..(273): n is a, c, g, or t
  misc_feature (279)..(279): n is a, c, g, or t
  misc_feature (283)..(283): n is a, c, g, or t
  misc_feature (295)..(295): n is a, c, g, or t
  misc_feature (309)..(309): n is a, c, g, or t
  misc_feature (312)..(312): n is a, c, g, or t
  misc_feature (342)..(342): n is a, c, g, or t
  misc_feature (359)..(359): n is a, c, g, or t
  misc_feature (370)..(370): n is a, c, g, or t
  misc_feature (372)..(373): n is a, c, g, or t
  misc_feature (382)..(382): n is a, c, g, or t
  misc_feature (411)..(411): n is a, c, g, or t
  misc_feature (422)..(422): n is a, c, g, or t
  misc_feature (429)..(429): n is a, c, g, or t
  misc_feature (446)..(446): n is a, c, g, or t
  misc_feature (453)..(453): n is a, c, g, or t
  misc_feature (460)..(460): n is a, c, g, or t
  misc_feature (491)..(491): n is a, c, g, or t
  misc_feature (495)..(495): n is a, c, g, or t
  misc_feature (498)..(498): n is a, c, g, or t
  misc_feature (504)..(504): n is a, c, g, or t
  misc_feature (594)..(594): n is a, c, g, or t
tccaaagtcagtcccctttantaaaacantttcacagaccagaaaaacaaaangaaagnagaaanaggccccaggnaggagccacaggcctggccncacatgaccccngccccagcaacttgaacaggacaagcagcagccacatccttaaggncgggaaagtaagatgaggatttggatcctgcattgcccngccncccacccnatctcnccccaaannaaaaanagccanccntgggaagcagcagagttaagacgtcnccccnctgcccnagtganaaanacaccaacaggngagcatgttcaganggnacagaatccagggactgcatttcatgaggngaaactgggaccaaaanatggggggggngnnggggggggngagaaggcaagcgcaaagagaaccttccnccgtttctacncatcggntcctgacgctgagtccnctgagcnggggggngtactggctagttcttcttcttcagagtccncgcnccncccccncttctttttgctcttgttctctcccgaagagctctcatcactagacacaaactctttgctcttgaagctctcgcttagctgccttgaggncgacttggatgatgagcccc

SEQ ID NO: 619062 - DNA, 613 bp, Homo sapiens
  misc_feature (589)..(589): n is a, c, g, or t
caagaggaccccgctcccaccggagtgagggggcaagaggaagagccgcgggcgggggagaaggagcgtaccggcactgagtactgcatggggagaagtgagaatcagctatggataagggccagagatatccacagctgggaggagcccagagacggttggctttatacccacacagcaacgggtccacggctttacggtcggtcggataagggcggtaaacatgtttaaaaacaaaacaaaacaaaaaagaggcactagtctatctgcaatcactcaaggaggcatttccataggaaacagactatgatcactccatttattcttcccacacacttacctaactaagtcttggctttaataaatgagcaacccggggtatagtcttaaaattctgcacaataaatttggagaaagaatggtccctctgggaaggtatcggggggtggcaatcattctcaaccggggaggtgatctggccccttgactccagccgggggacattcaaaatggtcgggggacagtttgcattgtcatgacgtgggggtgcaactagaagccaggaatgctgtcaaacattctaccatgnacagaacaatctacaagagcaaag

SEQ ID NO: 619063 - DNA, 765 bp, Homo sapiens
gcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcagtttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaaggaccaagattcagaagctgggcagggctatgcgggagattgtctaaaagtgttggtttcctgccatcagtgaaaattctttaacttggagcaaccctttatagcttccagaaccgtttgcatatcgcc

SEQ ID NO: 619064 - DNA, 277 bp, Homo sapiens
  misc_feature (51)..(51): n is a, c, g, or t
gggcttttttaaaaaaaaaaaagtcccccaatcaggaaaaaccctcaaaanctttttcctagtggggggggtaatcctaaccccccgggtggccgccaggtgggccctgcctttttccagaaggcccctggtcccagctttttgtccaactgttgattatgtgatttttttgaaacgccccttttcaaaagcccgggggtttccatttttcctttggccagccccttttgttttttaagcttttggggccccataaaataggacgtgctgtttccca

SEQ ID NO: 619065 - DNA, 413 bp, Homo sapiens
ttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagtttcactccagcctgggcgacagagcaagactccgtctcaaaaaaaaaaaaaaaaagagaaaagaaaaaagaaatgcagtttgaaaccctgtctctactaaaaatacaaaaataagccgggcatggtggtagtctcctataatcccagctactcgggaggctgaggcaggagaattggttgaacccgggaggcggaggttgcagtgagccaagactgagccactgcactccagcc

SEQ ID NO: 619066 - DNA, 158 bp, Homo sapiens
aatatggcaccagcgccgggctcctggttgagggcctcaagaagcttacaagtcagtggcgaaaggcagaggggcaggcatatcacagtggcaagagcaggagcaagggggagggaggtagcagattctttaaacaaccagctctcagcacaaactcg

SEQ ID NO: 619067 - DNA, 89 bp, Homo sapiens
aattcaagcttctaacgatgtacggggacatgggtaaaattattaaatagttgtataataaaaataattttttcccttgtttgcgaaaa

SEQ ID NO: 619068 - DNA, 529 bp, Homo sapiens
  misc_feature (280)..(280): n is a, c, g, or t
  misc_feature (300)..(300): n is a, c, g, or t
  misc_feature (384)..(384): n is a, c, g, or t
  misc_feature (413)..(413): n is a, c, g, or t
ttagcatcaatcccgtttgtagaatttggatcaggtataggactgaatgcctcagtactgacttaatgtttagagatcaaagagcgaccctgtgcagcagacatcggattgctaagaagatcattaatcatttttaaaatgtgatcactccagatttactattcaatggtcattggctatttgcctgtgtgttaattacggtgaggaaactttctatctgttgctttcaacaaagcttatacactgaagaagagcacacagactgttctgtcacctcacnattcacacactctccgcctnctctaggtttgagctccatgttctgcgtttcacgtcttgcttagtgatgggcagagagcaaagtcgttaaaagtatactgtccnttaccacgattctcgtaaacacaacaccnatacaccctggtacttcaacgcagagtcacagtgtggggccagatagcttctgtaggtaagtaggactgagagagaaagtcctggttacctaattccttttcagaggcctcatttg

SEQ ID NO: 619069 - DNA, 325 bp, Homo sapiens
  misc_feature (16)..(16): n is a, c, g, or t
  misc_feature (21)..(21): n is a, c, g, or t
aaaaaaacttttcctncacangtttttgggggggggtttggcctccccccccggtttggggccccttttcgggaaaagcccccaccccccccttattttttttttggggggggggccgggggccttttttttgggggcggccccccccaataaggggttggggcccccccccgggttttttttttgaaaagggccccccttgttaaaatggggccgggggggggggtgggggggtttttccaaccccccggggtgggccctgggccccccggggccccccccccccggaggggggccccaaataatttttttttttgtgttttta

SEQ ID NO: 619070 - DNA, 276 bp, Homo sapiens
ctaagaacagcagagtgtatgctgagacttgaatatgtccggagacttgtaatacagctgaggtctcaggcgacaacatgcaaacgactgaccgcactcagcacggataacacagttatacgtgcagttttcagcctgactaacgcgttaaaccatcaggatgcacgactgatccgatctgagcaactgctgtgtcttccagaatgccttggcggattgacaagtggactatccacagtctgcacccatctgtgcacgtcgagtctatccgtgctg

SEQ ID NO: 619071 - DNA, 600 bp, Homo sapiens
tctgcacatgtatcccctacatctaaaataaaagttggaaaaaatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaaaaacaataacaccccaaattcccctaaaatggggctatataacacaaaaggccccatattttaaaaccttcaagacttgaaaaaacttgtgttaaacccaaattaaacggtttgcactaaaaccccccttttacaaaatgggataaaaccaaaaagccccgcacaaatggcttttcaaaaatttcccatcacaagggcctatgaaaattcaaccccttaatatttgaaaaaaatccccgaaaattttttaaaactcagcaattttaaaaccaaagggcaaaacctaaaaattctttcaaaatcaaaaaaattccccaaatttagttcatagggaacccaatttcgaaaaaggcccctcttttaaaaaatgggcacccaacgtacactgcgccctctttaaagcttaagcccctctttcctaccct

SEQ ID NO: 619072 - DNA, 259 bp, Homo sapiens
cctagtaccggggaccacaggtgtgcaccagtacaccgggctgatttttaaaactttttggtagagacagaatctggcggtcatgttcaggcgggtcgtgaattcccggcctcaagcaatcctccggcctcagccttctaaagtcaaagggcggggactacagatgtgaaccacggtgccgggcaatacgtgggtttaagtttaagcttcatcactggcctttcttaactctgaaaccctctgacctctgtgtgttcat

SEQ ID NO: 619073 - DNA, 110 bp, Homo sapiens
tagtgtacataatttacttcatggtctgcagttaggctcagtgacttacgacataattcctgcttgagtgatatgaaattgatagaagcctgaatggcagtaggtgagtg

SEQ ID NO: 619074 - DNA, 269 bp, Homo sapiens
ctgtctagaggatccaccctaatcgcaatagctcagacatagtataacccaaatgcccaccagtgatagactggataaagaaaatgtggtacataaacaccatggaatactacgcagccataaaaaagaacgagatcgtatcctttgcagggacatggaaggagctgggggccattatccttagcaaactaacacaagaacagaaaaccaaatatctcatgttcttacttataagtggaagctacaatgatgaggcgattagggttagt

SEQ ID NO: 619075 - DNA, 243 bp, Homo sapiens
atctacaggatcctttgaattctcctgcgtgttcaggcttctcccaagtgaactcacactcttggttgacccctataaagtgtcctacagaattggagaggatggctccatctgtgtgctagtatgaagcctcaaccacaggaggtagcactcaaaacagcaccaacctgcaaatggtagaacagccgaatcagctgtaagggaggaacttctccttgggcagaacgagcccttccaaaaact

SEQ ID NO: 619076 - DNA, 769 bp, Homo sapiens
gacctttccccaaatcatgcacgtattgagttattgacttgttaaatctattcccatgccataactcttatcaatacatacatgaacatttcaggaagattcaggttgccaaaatactcctagcacaatactttgtatatttttaggtacgctatacagaagtaaaagtcccatggaagctatgaacatctagaccttgatgtggtttattccttcgaatcatttcatagacagttgaaagtagggcctacatggttatttgcctgctcacgtttatcgtttactatctcccactattcataccaatatacgtcaggtttgcttaaccagttgattgattatttttatgtacccattcttagggggcataattgaaacgttgtcttccatgtttctctcctaactttgtgcggtaattgcaagaaaagtctcctattctgggacatattgctaggttagtcccaagaagcagctatgttcttggaatggtctgaccgaactggaagagtcttacgtgaaaatttgaacctggtggccctctcgaggtgcctctctttcaggggagaggccctggtcataacgaaactgggaaggaaggccctcagcacacgctattcttgttagccaacatagttgtttgcccttgtgctcttgttgccacacttttctgtacaaatatgccaccttaatattggatctaaaccaataatttttttaagaaagggttacacaaaattgccttggggaactttagtgacattccttaaag

SEQ ID NO: 619077 - DNA, 324 bp, Homo sapiens
gatgatggtggtggtggttgtagtgtgacaggtcccttttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggccggatctctcgagctgtcttgctgagtgccctgtgtgtaagtcctaataaacttagctactcgcctaaaaaa

SEQ ID NO: 619078 - DNA, 366 bp, Homo sapiens
  misc_feature (41)..(41): n is a, c, g, or t
  misc_feature (46)..(46): n is a, c, g, or t
aaaatattacaaaataatttaactcatactacatattctanattgngaagtttcatagtgtaaaataaaagtaagggtatgctgggcatggtggctcatgcctgtaatcccatcattttgggaggctgaatcatttgaggtcaagagtttgagaccagcctggccaacatggtgaaatcccacctctaacaaaaaatgcagaaattagccaggcgtggtggtggcggtggcagtggtggcgcacacctgtagtcccagctacttgggaggctgaggcaggagaatcgcttgtacctaggaggcagaggttgtggtgagctgagatcgtgccactgtactccagcctgggtgacagagtgagaacct

SEQ ID NO: 619079 - DNA, 127 bp, Homo sapiens
  misc_feature (98)..(98): n is a, c, g, or t
  misc_feature (115)..(115): n is a, c, g, or t
tccctcctgctgctgctggtgtccctgctcctgtgccagagcgtggccccttgcccatctgtcccggcggggctgcccgatgccaggtgacccttttnagacctgtttgcccgcnccgtcgcctgtc

SEQ ID NO: 619080 - DNA, 161 bp, Homo sapiens
  misc_feature (69)..(69): n is a, c, g, or t
  misc_feature (86)..(86): n is a, c, g, or t
  misc_feature (89)..(89): n is a, c, g, or t
  misc_feature (100)..(100): n is a, c, g, or t
  misc_feature (105)..(106): n is a, c, g, or t
  misc_feature (108)..(108): n is a, c, g, or t
  misc_feature (115)..(115): n is a, c, g, or t
  misc_feature (138)..(138): n is a, c, g, or t
tagttgtaggtcgcagcggggaaattttttgcgactgtacacatagctgcagcattaaaaacttaaaanaattgttaaaaaaaaanttnggaaaacattncatanntnttttttngataaacagttacaccttgtttncaatgtgtggctgagtgcctcga

SEQ ID NO: 619081 - DNA, 226 bp, Homo sapiens
ctctctctctttctttttctttctctctctctctccccgtgtgtgtgtgtgtgtgtgtgtgcgcgtgcgcgcgcacacgcgcgcgtcatgtggaaacacagcacaaaggcagcctttgcaagccaggaagagggttcacgagaacccaatcaagttggcaccccaatttcaaacttcccccctccgaaactgtgagaaaataaatttctgttgtttatgctcccta

SEQ ID NO: 619082 - DNA, 725 bp, Homo sapiens
  misc_feature (319)..(319): n is a, c, g, or t
agcgggcttgcgctttcccctccgcggttcctccccgagccgcccccagtgcccacgcttccgcggctccgccgtcccagggccgtgccgactgggaactctgctcaggggcgtagtcccctgctaaggtcctgggggtccgtgctgagtgccgcattagtgcgggatgggcctgagtcccgggcgccgagggggagtacgcgctccgcctccctatgattcccccaggcgttcccaaaccctgcctcgcgaaccgttcgtgtaccgggcccatgggaccatgccaggctgggcatctagatcgtccagcttgtggccnccagctcaggagagaagtccagatgggcactacagccaagcgttgaggtttcacgtttcaccgagccccatagacagtttctcacgcccgaagacaatggtttaagaaaccagtggacaagaaagctgttcccaagcatatagtgctgaaccccaattaaatggaagctgtggtcaaaccaataatctgttcccgagtaaaattaatccaatttcggcgccccgtgtgggagtgaaaaattaagcaggtctggtcctggaaggaattggtgtccagaactgcgcctgtgtgtccatgctaagaccgccatttgagctaataggccgtagaacattgtaacaggtgagacatggacacctttggcccagggatgagtagaaaggagtccaattcccgggggactcaa

SEQ ID NO: 619083 - DNA, 150 bp, Homo sapiens
aaatgagccggtccacttatttaagccctgtggtcaggttttcttactctacacacagtgatatgctacccccggctctattcattgttgctgtataggaatgctggctcggtgtcacaagattttctgatttttcaagagaagatataa

SEQ ID NO: 619084 - DNA, 166 bp, Homo sapiens
tgtgcgaggtgatctagaggatccctaagggtctttctaatagaaaaggtctctacagactatctgagtaaaggaggtgggcaaaatcaagttcagggaagatgctcaacatgcacacgcttactggtagtcttaaaaatatctgggatagaaatacaaaaacatc

SEQ ID NO: 619085 - DNA, 966 bp, Homo sapiens
gctttcgtgaacaagcacacctgtagataaactgagaccggtggaggtcacggaaactggaaacccagattctgcatgatggggtgtaccgtaggtgcctgcatcatggaggctccctgtgagggctactttttaggtgcctctctgtgctactaggaacttacgtgtccgtagacacccggatggctgatgaaacacgaaggtcgttgaatgtcatccgttatgacctaaaggagctcatgcaagatggaagggcttggagagaatgccaataagcctgatggccgatcatagacgatagtcagacgtgtgatcctgcaaatcgtacgatcgtacagaggatgatggtcatcgaaacctctctcaccagagtaacacgtagccgtgagacgtgaggggcgtgcccttggagcaccaactcgacatgtgcgcaggaagactatctttgactctgtcttgggcgcctcacagtgggaccaccgtaccatcagcgaaaccatgtccctgtaccccccgtggctgtaagtgtcgatggtccgtctatggggcaccttggtgactgcatgcgcccaggcaaagggtcgcgagcctggcgaaacctcaagcaaggacgtacgggtgagaaaaagcttgtaaacagtctacggcgaaacaggggacgacaacttcaggttccagtaggtatagacttccaaagaggcggcgggacgttgacccccccatttctcccgtacccgccagggtctgccttgggggagaatcccagaaagcccgtaaagacatacttgaacaggcgggtagggagaagaccggggtatggatgccccccttttgcgcccgcgagtggacgcatggggctcccagggagtcacaacgcaccaccccactgaacatggtggaggggaaaacacaagcccatgtaccggcggcaaatcaaacagacagattcccccaggcgaaaggaac

SEQ ID NO: 619086 - DNA, 1117 bp, Homo sapiens
  misc_feature (537)..(537): n is a, c, g, or t
ccccccatgcactgcccaaccgcaacggcagcctgttctatgacagcctgctcaatcctgggctcgcctggtggccacgcctgccctgtcgccacccagacaggttgagcgtggccggatatccattcaccctactctgcatcctggggcagacgggcgaaccgtcacggtccctacccctgcagcttcagccccgtgcatgtggaccaccggccgcgcggagccctcggcctgtgcggctacgactaaccttgtcctaggaaccatcatggctatccatccacggagctgcaaggacaagggaggcagcgtgagtcgcctgctgcgcttcccaggccagagtcactcattcggcgactcaggcgtctatgacgctcccaggttcccttacagcctgctagcagggccagtgtgctgcccgatggtcccccgaggtcccgcgctgcgtctatggctccagagacgaccttgtgggctggagcccggtcttcggtggcgcccggcaaccctgcccctgcgagacggtcacgtggtccntccgcttgtccaagctcccgttgagcccggtgctaccgccggcaccgtcggtcgctccgtccttgcggcggcttggatcggggccaggcaagcaagcgcccccggggcccacggggcccagtcagttgggtctcacacaggcgtcacccttgtgagctcccaagagggccttgcgcctctccctgaccagggatttccccaaatgtcgagcaatccttaacggtgggcctcaaaaagttgtcccccttcatacacacacgggactcccaagagaccaacggccctctttttgacccgcctgcgcaagctttgtcgtcccgcaggatctcgtcagcgcgcctcctcggccacagcgctcgtggtcccgccgcgcgttctggaggggcccccccctgtggttgtgcggcacccttcgttggtcccccggggcgcgcgttattccccgggggcgcgccgcagtgcggctgcttctccccgccctctcgacgcgcgtgttcaggtgtggcgcgccccacgagctgcgcccccctgctacgcgctgcctagtccgtctcaccgccgcccttttcgttgcgcccgt

SEQ ID NO: 619087 - DNA, 720 bp, Homo sapiens
ggctgtaccggccggaagtagggatcggcgacgttaagctgagcgaccagtgccactggagacggtcagcttctcactcaggctcctccagccgagccagaagaccccctccccccgaattctgggggccgatggaagggagccgagtcagatcgcgaggtacccagagccgatgacggagcgacagtgtagttgccagaagcccctgccctagagtgatcggaaagcctcacccatcgggtgaggaacccggatggaccgctccgggcggagcccgccgacatggctagcccctggtggcgggtcccgtcagctctacgcttcgccggcgcggtctagcgtggcaggttgtgcgcggacgctgcttggtaacattttccgcgatgtactggagtttctgcgatctctgcgctgctgttgcccctgtcttggttcgtaccgtgcacccacgaacgccttgtatgggcctaacggcctacggtggtggtggagcttggatcctgcaggtccgggcttgggctccaagtcctgagagccctgaatcatcactttccagagtctggacctatagtgcgggatcccaaggttacaaaagcgggatctgaggacgattttggtgtgcacaggaacactttttaccagctggttaagccagctgtcagaggctcctgtggaattttggcctctaagctgcaggaacttgaacaagaggttgggtaa

SEQ ID NO: 619088 - DNA, 629 bp, Homo sapiens
  misc_feature (1)..(1): n is a, c, g, or t
  misc_feature (24)..(24): n is a, c, g, or t
ncgggtctgaagcaaattggatanattacgcaaaatggcctatatggtttagaaaaagttaataataaaagggctggcctgaaaaattgggtcgaagaaagaagaagtaaaacttagggtttacctcacatcttatctagcaacttttctgggtcttgatttggctttaagggccataaatacccaaatatctttaaattcctacattccaagtatatatgatgtaagaatttccacccatttggtctgaatcttctatatttggcacttctcatcaggcacctagccaacggttaagggctgatcttctgacttggctttcctggttgaccagtgctggttctataacccaattaactatcagaattccaagcaatgaactaagcttgctggtttcatcctggcagaaatgaacataatcttgagctaaaattgtacagttgtagtccaacaataatggcagatacaaaggctatgttcccggtacaaagacaagcatttcacctgcataatctcatttagcccttaacaattctgtacgggagatattatctataaacccttttacagacgagtaaccaaacccagctagattacaaagtgagaaagcgatggaagccacatctaaa

SEQ ID NO: 619089 - DNA, 860 bp, Homo sapiens
gaaaggcgagagtgcgaagggcaggtgtcgggcgctgtttctcgttacatcatatagacaaaacagccctggtgcaaagatggtcaacgtacctaaaaccccgaagaaaccttctgtaagaagttgtggccagaatcagactcacacaagaagacacaagtctacagaagggcaacggatcctatcgatatgcccagggaaggcggccgctcaatgattcggacaccacgagatggcatactgggtggggcacgacaaacagacaaaattctacccgcggacccaaacgggcctttaaagaactcaacaatagagaaaccgcattgtggtgccctaacaggagccttgacaacaagtggatggttagaagccccttatacactttgccatagaattcccactaagcgaagacaactgcccgtgcgtccccaactcttaacggccacgcactggccacagcccagtttcttgttgtcaaacaggtgttgcgacagcggcatgacacttacgagcaacagacagtgaacaaatcggtgtcccccaactcgttttgcatattccacaacgtgttactattgtaaaaacaccatttatagggcggcaacaattacattatctcacagcattcatccacaactttacttctgtcgaacacagcgcactgttaacacacctacttgacgtttcttacgatcgcccccctaactacgcaaccaccaacatgtattttacccccctcggcatactgtgaacctatcaactaattcacaacaccttaccacacgtttgacattacatatccctattgtaagccccccatattactatcatcaatacagtatactctatcatacataact

SEQ ID NO: 619090 - DNA, 858 bp, Homo sapiens
  misc_feature (351)..(351): n is a, c, g, or t
atgaccagagtcatgcaatagttccacgagtcacaagtttgaaatttgaatactttacagatgagtgatgtgtggaccactgggttgctaaaaaagccagccactagaacacctattcccatgaatcgagctcaaattattatcactagttccagaaaggtgattctctatcacgtgtaacgcatagtatgtcgaaagccattgcacagagtcaatccttcaaacacggcctagggattacacagctattcggtgcagctctgcaagtacaatcaattagaacataacggagattttgtaggtaaaaacgtactttttgcctagttctcattaaagtctaatctagaagtnagagatgaataccatgtccgaattaccttagacattcatagtcgatgcgtagatttcgagtctacatgttctctcacatgaacaccaagtggttcacatcgagtcccattagagacagagtctcatcgtgttatcaagatcctaaagtattcttctaaagaacaattgcaaaccaatggtgttacattgcatagtaggtttctaaagagagtcaacgtaccttggcagcaaatgactatgcgataagacagactaggagcgaccaagctttcgcgttatgtatctcttgattattagtattctactcatgtgtgaacgacggtggttttcccaaggtgtaaggtgatggcgatactaacttgtttgagtatttgcatatctaaaagaattgtccgaaagaattggtattctagtgtcgtgcctagttgatcgtttggtcagactacagcaactttatgttcagaatgccattttgcttcagaagttgtgaaggcatggtcctattat

SEQ ID NO: 619091 - DNA, 115 bp, Homo sapiens
gttcgttcgaccaagatccccctcgcgttgtcttcggttttgaagcatcaggatcctttatcttcttaggctgcgagagttcccgaactcaatcttccctggtaaccgtgactcc

SEQ ID NO: 619092 - DNA, 130 bp, Homo sapiens
ccttgtttttaaaaaaaatgattttttttgccccttttgccctataaaatagggaaacttttgatatgggcggtttgatcccgattggttcctaaagggtaaatataataaagaccccttttttgcttta

SEQ ID NO: 619093 - DNA, 369 bp, Homo sapiens
cttcccgtttctctgagaactttcttcaaacccatggattaaaggatccaatagccatgtatctactacatgaggtattgcaagctcctgaaaacagttcttggctgtggaggtgaccatgtagcccaattcaggattactgagaggcagtctggagctgtggcagccattcttgccccccgtgaggggaagagcctgcttgagaatggagccaatatggaggaaggcagagagagagagaacgatggcggaagatgcagaccctgcctacgggatccagctacttgtctggccttctcagttccagaaaccaatgcatttcctgtgggatttctgtctcttataccctcaatgatcctctagagtcga

SEQ ID NO: 619094 - DNA, 347 bp, Homo sapiens
tcttgtgtatcccccgctgtacagttgcgggctattgcgtcctattcctcccacgcgctcaccccaccggtctgaccctgctgccacctctctccgaggagcctagaacctgggaggtgacagggccctgatgtcaaatggcatcaacaatcatgatgaaaatgccaggcatggtggagttatagggtttcaatatgccaaagtaaaaccgcacatgcttattcatgactactctctgcaggcttgggatcacagtgccactgactttgtaacacatgcaggtgtcagttctcgaatgtgcctgccagcaggccaacttgctggaaaccccaaaagccccaggataa

SEQ ID NO: 619095 - DNA, 468 bp, Homo sapiens
cttgaatccaggaggcagaggttgcagtgagccaagatcacagcacagcactctagcctgggcaacacagcgagactccgtctcagaaacaaacaaaaacccccaaaacaaacacattgtacagccgtacaaaaatattttctatcttcatatgcctattctataagcttaaaaaaatttgttttaaaaaaaaactttcccagcactttgggaggccaaggcaggtggatcacaaggacaggagttcgacaccagcctggccaacatggtgaaactcatctctactaaaaatacaaaaaattaaccggacgtggtggcaggcgctctaattccagctactcaggagactgaggttgcagtgagctgagatcgtgccattgcactccagcctgggcgacaagagcaagaccccgtctcaaaaaaaaaccaaaaactttaaaaacattttttttcttaaaagctaagaca

SEQ ID NO: 619096 - DNA, 693 bp, Homo sapiens
  misc_feature (49)..(49): n is a, c, g, or t
  misc_feature (93)..(93): n is a, c, g, or t
  misc_feature (254)..(254): n is a, c, g, or t
  misc_feature (268)..(268): n is a, c, g, or t
  misc_feature (305)..(305): n is a, c, g, or t
  misc_feature (340)..(340): n is a, c, g, or t
  misc_feature (346)..(346): n is a, c, g, or t
  misc_feature (409)..(409): n is a, c, g, or t
  misc_feature (443)..(443): n is a, c, g, or t
  misc_feature (477)..(477): n is a, c, g, or t
  misc_feature (487)..(487): n is a, c, g, or t
  misc_feature (503)..(503): n is a, c, g, or t
  misc_feature (506)..(506): n is a, c, g, or t
  misc_feature (529)..(529): n is a, c, g, or t
  misc_feature (539)..(539): n is a, c, g, or t
  misc_feature (559)..(559): n is a, c, g, or t
  misc_feature (606)..(606): n is a, c, g, or t
  misc_feature (684)..(684): n is a, c, g, or t
gttggggagggtggttggggcatggtgttgcccgtatgactttcctgtnccatcggaaaccagagtttccccaggggggcgctttctatgtgnggttgcatgatttagctaatttaacaagaagagagttattcctttgatttttatcaacatgggcttggctatgtgtctattagggtgaacactgatttttttttttctttttagaaacaaaaaccatcccctttttattccaaactacggcgttgcttttncaacaatcatcgcntaaactggacatacggggttaccacctcagggggatnacagaagagcgttgcacaatgtatcttcggggtangcgggngcgaacaatgtgggcgcggcaacttcactctacacactctgaccatcgcttcagtttgttctngggacaggtgcgggggctgtgtggggcctcggcncggttgttcttgggggcagcgccacagtgagganagcggcactncaatgggatgcgagtnacnctagcctacggccgggtgcagcncatggctctnaaagagcctggacgccacantcctcggagctgaacacgatctaaggaaatgttcatgccatcctaanagtgggtttttccccggtgagaactggccaacagttattgcctcgcctctttagtatgttgtttgaccagagaggganagggcgggg

SEQ ID NO: 619097 - DNA, 1099 bp, Homo sapiens
gatcattactctgctcatgctgtcccatgctcgcttaattggggcttattgggtatggtctgctgaactggctcgataatcgcaatacgcgcggtcaaatagtgcccataccagggagagatcaatacttatcgttcgctcccgtgatgggcatatatcgtgagtaccgcctgcgattaccgcacggtctcttccttgtccagctcagtattcagttggtcttactatggctcacttaaagtatctcatgtgtcgcctggcgtcgctaaggcgagggacgtgggacttgaggcgccacgtaaagtgaggtaacctctcagtgctaccgagcgacgaatgctagcacacgtgtagcaggtcactgttaggataaacacctcatacatcgatactacgcaactgctaaacaactgaatcgagtcctcggatacatatctattatctgacctaacagttgatcgaatcggatcgtcttcgcaagaaatacgacgatcaccttgtagaaatcctacactaggaaagaaacgcccaacaagaagcgtacaatgcgaatgatcctggtggtctattctttccggaatagacgagcagctttaattcctcacacccatgtggcgtaattcgattcggcacgcagactgaagtgctaacgcgagggctagaaccgactcgtgaaacgacgggtcccctgtagctttctcgtaatgtgctaatcacccctagttatgggctcccatatcctctgactacattcgcagctgagtagaggcctacggaaaacaggccctagggatcacctaatcccattcgtactactccactctacactctgtcgaaggacgtattcaagactgcgctgcagcctcaacaattctaacttatggactagctttatcaccgatatgcttccaataagctcagaggaatagcctctttgaacgggacctgccacgtgattgaactcctcgaaaggcccatgtgtcgaacgaccccacataagttgggttctaatagcaaccttggccgggagtacttcttcacaactacagcgggtcacgggaaaaataacggccccaacactccttctccaccccttgag

SEQ ID NO: 619098 - DNA, 104 bp, Homo sapiens
tctagaggatctcattttttttttttcccccaattactttttaattttggcaatttccatctcaaccccccttcttctcttctcttgattgtgtgggccccaac

SEQ ID NO: 619099 - DNA, 614 bp, Homo sapiens
gcttgccgtaggtctgggctttaatttaagtcgtcttttctctaatccagactcctgccacagtgggtcaccgacgtcctggccccgtcaggagtccgcacccacggtggagcgtggaggtgactttttgcggtcacagtaatgggatctcagcgccgacaacagctctgtgccggcgagcgacagggacccgtccgaaatccgagttataccaggttcgtgtgcaacgcggtatcatgtctaggagcccacgcgtaagagggatgtgaaggaccaaattgacgaaagtatccgagacagatataacttatgcatgatgagccatggtcgtcatcaggaaattcagctcgctcgttcatgtcacactcttagaggacatggtggttggcccgctccatgggagacgcggcgtccaatcgttgtgctgtcgtgtccagtggtcttcgacgagacggccgtcccatttccctgggacgtccacgattcctgcaggagttagaaacctggggaccgtcttgacctacaacgctcgtactaactagattacggcattttaggtattgtcgtcagggtccttacgcggtacttggacgtcttgaatttaatcttataac

SEQ ID NO: 619100 - DNA, 696 bp, Homo sapiens
  misc_feature (272)..(272): n is a, c, g, or t
  misc_feature (302)..(302): n is a, c, g, or t
  misc_feature (306)..(307): n is a, c, g, or t
  misc_feature (311)..(311): n is a, c, g, or t
  misc_feature (314)..(314): n is a, c, g, or t
  misc_feature (352)..(352): n is a, c, g, or t
  misc_feature (368)..(369): n is a, c, g, or t
  misc_feature (421)..(421): n is a, c, g, or t
  misc_feature (429)..(429): n is a, c, g, or t
  misc_feature (448)..(448): n is a, c, g, or t
  misc_feature (454)..(454): n is a, c, g, or t
  misc_feature (459)..(459): n is a, c, g, or t
  misc_feature (486)..(486): n is a, c, g, or t
  misc_feature (497)..(498): n is a, c, g, or t
  misc_feature (502)..(502): n is a, c, g, or t
  misc_feature (511)..(511): n is a, c, g, or t
  misc_feature (518)..(518): n is a, c, g, or t
  misc_feature (543)..(544): n is a, c, g, or t
  misc_feature (547)..(548): n is a, c, g, or t
  misc_feature (556)..(556): n is a, c, g, or t
  misc_feature (628)..(628): n is a, c, g, or t
ggcagaactgggaggaggagttggaggccggagggagcccgcgctcggggcggcggctggaggcagcgcaccgagttcccgcgaggatccatgacctgacggggccccgtgagcctgcgctgcctctcgggtgtcctgggtcggtgtgggatgcccagtgctcgcagtgcctggctgtggctgtggcctggagggctgcagtctccctcgcggtgagaggaagtgcggaggagcgggaacctgcggcggcgctctgcgcggcgcctgcgggngggaagggcagttcctgggcctgggccgcncctnnagcnggncggcggctcccagcgcagtctcagggcccgggttggcngcggcgactggagaanntcaagttgtgcggtcggtgatgcccgagttgagcggggggcctgggcctctngcccttanggaggcaattcccacgcanggccgncaaangcgctctcgcggccgagaggcttcgtnacggtttcgcnngcgngcggcggcngttgttnggctgagggggacccgggacacctnnatnncccccggncccgggctcctccgacgcgatggggaaggtgctatccaaaatcttcgggaacaggaaatgcggatcctcatnttgggcctggaccgcgggcgggcaagacaacaatcctgttcaagttgagctgggcagtcggtgaccac

SEQ ID NO: 619101 - DNA, 172 bp, Homo sapiens
  misc_feature (34)..(34): n is a, c, g, or t
acaggcagagcagaggaacgctaagctcttgatngtctcttctatccatatggacgtaatcccattcatgagcgactctacccctcatgacattacatcacgctctgaaaaggccccaccctcgtaattaccatctacacttgtggatagtgagcctttcaagcacaataac

SEQ ID NO: 619102 - DNA, 1305 bp, Homo sapiens
ggcagaactgggaggaggagttggaggccggagggagcccgcgctcggggcggcggctggaggcagcgcaccgagttcccgcgaggatccatgacctgacggggccccgtgagcctgcgctgcctctcgggtgtcctgggtcggtgtgggatgcccagtgctcgcagtgcctggctgtggctgtggcctggagggctgcagtctccctcgcggtgagaggaagtgcggaggagcgggaacctgcggcggcgctctgctgctgtgctgcccttgctgtgtgtgtgtgaatgtgtgcatgttcctgtgtgcctgtggcctgctgccatcaggcatgtggctgtgctgtggctccacaagctgccaagtcgtcatgtggcccctgtgtgttgtgctgtgacttgtgcagaaccttgggagaaacgtcaagagatttggttgcatggtacagtgtggattgcccctgaaagttgaggctgtgggtgtgggcccttggagtgcctccattggccacttattaggcgaggtgcaaagcgatacccaacaggcgagaggcccaggcaacaatatgggcttcccatccatacaggctgtgccctgaatggactgtggcttttcacgtatatcacgggtatatcaaggcagtggctagatggtagtgacaagagaacagatatgctttcgtagctttgaacgtagggtggaaccccactgggggggaacaaccgctattgaaaattgtgcacgccactggggcgcccctggggcattcccgttctcggagccaggccgaatcgcggggggaaaagtggttcgcttcattccccgagaaaagtcatattcagggggaaaccaacattgggagacattaggcggtggaattcgctttccaatttgttttggtgtgccccatatgggaagcaggcagaggccccggggccaagacgagaccaagagccaaagtcccctatagttaccacagcggtttaggaaagtgctttggggggccccaagagtcagcggataggaaccgcaccgcaaagatccccccaagcgtggaatggggagatttattcccaaagcacgggcttgtccgaagcacaccggcggcgtcgaaccttttaacccgaaacaagcaattggtcttccaaagggttctccaacgaccggtatatcttggggcacactgtctgatgtgtggaccagcgaccccaaggggaaacacaaacggaaatccacggggcgccggacgacttcatgtggactgtgacaattatagcgataacacacagttgcgtgaacgcacca

SEQ ID NO: 619103 - DNA, 766 bp, Homo sapiens
  misc_feature (762)..(762): n is a, c, g, or t
ccatggatttgactggtaagcattagcactgtgaattcgtaacaatctactaatgtgtacagattatgcaacgtactactttagaccagtaggacaaagatgaagtcgcaggtaatattgggaaatacctttcgacagattataagggaaacggtacttcataacttattagatgcttcgattgcagcacttggagaagttgatagctgtcagcgtgtacattacagcagacgatctaccatcaacaacctaactttacatcgtaggatactatatggagatgaacaagctatatgcattgatacgctacgataatgactattagatcacagagaaattatagaacggaaccgcagtgtgatatattcaacagaactataatgagctctgtgaaaggatcaatagaattgacaacccttagctgattaacgtattacgcgagagaccactgaaatgtctacatatacatgatagtagagatggtgcaattaatgccgaagagatacaatgagactcgataggtgcatactatgaacaattggacagcaacatattagctgatctagaaggaatgcatgaattctagaaactactacccatcagaattggatcacgatgagctagaaatctgtgctgaccatgaccagtccgacgattgtgcaataagtagaaccttctacaggactagccatgacagatgactcactggagaatctaccgacatgtaaggacctagtacattattttcctcaaggcgttcangtgg

SEQ ID NO: 619104 - DNA, 660 bp, Homo sapiens
  misc_feature (517)..(517): n is a, c, g, or t
tggacaagtcttacaggttagttcaggatctgcgccttatcaaccaaattgtcttgcctatctaccccgtggtgccaaacccatagactctcctatcctcagtacctccctccacaacccattctgttctagataaacctagctgaccccataaatcctaaattctttccccactcccctttccatttcttaaaaaacagccctaaaagctgctcccacactagctctccctaactcatcccagcctttttcattacacatagctgaagtgcagggctgtgcagtcaaaattcttacacaaggactgggaccgtgccctgtggcctttttatccaaacaacttgaccttactgttttagcctagccctcatgtctgtgtgcggcagctgccactgccttaatacttttagaggccctcaaaatcacaaactatgctcaactcactctctacagttctcataacttccaaaatctattttcttcctcatacctgatgcatatactttctgcccttctncactacctctcagcaagtcaaactcattgccttaactcaagccctcaccccttgcaaggggcctcgtgtcaattttatacctgctttaaaattgcttcattaccggccaccatactgttttgggctgaagaagttcctacttc

SEQ ID NO: 619105 - DNA, 107 bp, Homo sapiens
ggttgacttagaggatcccccggctagaattcgcttcactctcaatgtgactctccctcatcacctgttgcccttgtgttgcagacgtggttccaggcccgagagta

SEQ ID NO: 619106 - DNA, 1380 bp, Homo sapiens
  misc_feature (718)..(718): n is a, c, g, or t
  misc_feature (1246)..(1246): n is a, c, g, or t
ggaaaatagaaaaaaaaaaaaaaaaaccatttccaccttctctccctccttttcatccacccttcccccccatttttttaccagggctgaaactttggctgggtggggtggtcaagctggccgatactggccgccctaacgggctacttaaacgggggaaattattgcattcaaccaaaactcaggggaagaaactgtacattgcttgcaaaagagccaaattttccagccaagagtatcggaatggcgcatgagaccgggacacccccttcgggcacaggggtgggaggcagggggacgccggcctgcgagatggccacgccggggctctcccaagagacaccctgggccaattgcaaagggggtctccaatctcaaaggcaaggaaattacaactccaccatttatagacagaagcctcggaagtggcgcatatgagggggcatatgagcggtgcgcgcacaagaagcacgcgcgagacacggagagccacgaccggagaggacccgaccatcaagagagggaactccagcgccaagggcccgagagccaagaacaagacccgcctacaaatgcgcacacgaatgtgggcggactgatggacgaccccagcacgaattaggagttctccatatcctgtggcgcggaaccggacgaaaaatctgctccgaggaacaaaaatataaagacgcgctgcgcattctatacgccagaaggncgcgcactattgtggaactatcttatggagggcacgcccgacagaggcgtactactccccgagtggcaaaagggggggaccgagactcatcaccaaacctattccctctttccaaagagccacaacggtggggaccgctgttgtgatccgctcgcttacatcgcatgcaggatttaagcacgagaaggaaaaaccctttctgaggcggatctgttaaacaccgccccgattcccacgaagtgggttcttcaccgaacccaccttttgtgttgtagtgtccccacagaaccacccgagaggagtagtacttcgcatgttggagtgtccacaagcgacgcgaagcatgaggagtaaacacccggcggcttatcaaaaaacaacagcgaggagaactatcgaaacttccactggggagggctacccccccgacggaccatttggggggggccactgcgatgagagtcgaggcaccccccatgggggagaaacacgccttctactgaggtgtaggggagtatgatgcgaccnccgagaaagaggcggcagtctggattgagacgaccccacaagagagggagtaacgataggaaagaactgccgccccctcatcagtggagcgccccaagagcatcgacccttgatcggacgagggggacaaccag

SEQ ID NO: 619107 - DNA, 285 bp, Homo sapiens
ggtcactctttagatcccaatcgccacgacaagatcagctgcgcttgcgtcttggcatcacacaggacctgtgtgtgctggagtggtgggacttgaaggattgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactg

SEQ ID NO: 619108 - DNA, 291 bp, Homo sapiens
cgagtgccagagagaatgtgaaccagtgcatataggaatgctgatcgcagctcctgacaccatagtttgtctctttgtatcttcatgctatttctcattgctaagcaccctaatgttgaagaggcaataatcaaggaaatccagactgttattggtacgaatttttccaataaattatacatcttagaaagaatttcttctgaatgtccatttcttatgtcctaagaatctgatatctaacataaagagtttttatgattagctccatacaataaagcaagacattctgtc

SEQ ID NO: 619109 - DNA, 357 bp, Homo sapiens
aattcgcacgagaggctgtacgagaccacgagccaggtgggcacgcagagcacaccgcggatgtgcacgaaacacacgctacacgatgttcaaggacaagtatagacgaagagcgaccaggccctgaactgtggtgggacatggctcgactgtgcaagcgggaaacgtcaaactctaggaaagtgcagataacatactcttcattggtaaacaaagaacaggatcttttggggatcgtgctgcaagacactaatcttttagaacaagtgttaaatcaaggaacaggtatttcagcaagttttggagccaagacaacagcagtttccaggaacattaatgtgagggaacttaccaagc

SEQ ID NO: 619110 - DNA, 345 bp, Homo sapiens
tgttcgcgataagcccaaggcatccacagattcatgcaaaacctaacaaattactaacgatgtttttcacagtactagaacaaattatattagaatgtgtatggagacacaaaagaccctgaatagccaaagcaatcttgagaaagaaagacagagctggaggaattaggctacctgactacccaaagctatccacagggtcaatgcagtccctatcaaattaccaatggcatttttaacagaaaagagaacaaaatatttcacgatttgtatggaaacacaagaccccaaagagctaaagcgatcttgagaaagaaaaatggagatagcggagtcatgctcccc

SEQ ID NO: 619111 - DNA, 174 bp, Homo sapiens
cttgcgctggttcctttcttgccccgcactcgtatcttgccccgcctcgtttcttgccccgcactcgtttcttgcccgacgactcggtaccctgtgtagggacgcgcacgggagatctggatgcccaggaacgccgagcgaggcaggtgcacgtattcacgcgtcgtgggctag

SEQ ID NO: 619112 - DNA, 87 bp, Homo sapiens
acatctgtgtacttctgtgccagcagttatgaagggatttcttcacgagaccagtacttcgggccaggcacgcggctcactgttctc

SEQ ID NO: 619113 - DNA, 949 bp, Homo sapiens
  misc_feature (5)..(5): n is a, c, g, or t
  misc_feature (156)..(156): n is a, c, g, or t
  misc_feature (183)..(183): n is a, c, g, or t
  misc_feature (213)..(213): n is a, c, g, or t
  misc_feature (216)..(216): n is a, c, g, or t
  misc_feature (220)..(221): n is a, c, g, or t
  misc_feature (225)..(226): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (343)..(343): n is a, c, g, or t
  misc_feature (346)..(346): n is a, c, g, or t
  misc_feature (358)..(358): n is a, c, g, or t
  misc_feature (378)..(378): n is a, c, g, or t
  misc_feature (384)..(384): n is a, c, g, or t
  misc_feature (399)..(399): n is a, c, g, or t
  misc_feature (442)..(442): n is a, c, g, or t
  misc_feature (450)..(450): n is a, c, g, or t
  misc_feature (454)..(454): n is a, c, g, or t
  misc_feature (457)..(457): n is a, c, g, or t
  misc_feature (475)..(475): n is a, c, g, or t
  misc_feature (527)..(527): n is a, c, g, or t
  misc_feature (558)..(558): n is a, c, g, or t
  misc_feature (594)..(594): n is a, c, g, or t
  misc_feature (610)..(610): n is a, c, g, or t
  misc_feature (696)..(696): n is a, c, g, or t
  misc_feature (707)..(707): n is a, c, g, or t
  misc_feature (759)..(759): n is a, c, g, or t
  misc_feature (853)..(853): n is a, c, g, or t
  misc_feature (946)..(946): n is a, c, g, or t
tatanacaattttctacaaaaaatcaccctcctccgctcccgaattccccccatctcccccccattccgcatctcattcccaccccccccccaccacccccccacttccattccccattccttttgtttccaattccaatatggcaactctaaacnatcacctgatttataatcttctaaacnaagaacagaccccccacaataacattacanttnttgnngttnntnctnttngcatggcctgtcccatcagtatcttaatgaaggacttggcacatgaacttcctctttttgatttcatccaagacaaattgaagggagacatgatggatctccaacatgncanccttttccttanaacaccaaaaattgtctctngcaaanactataatgtaactncaaactccaagctggtcattatcacggctggggcacgtcaccnagaggganaaanccntcttaatttggtccaccntaacgtgaacatctttaaattcatcattcctaatgttgtaaaatacagcccnaactgcaagttgcttattgtttcaaatccantggatatcttgacctacgtggcttggaagataagtngttttcccaaaaaccntgttattggaagtggttgcaatctggattcagcccgattccgttacctgatgggggaaaggctgggagttcacccattaagctgtnatgggtgggtncttggggaacatggagattccagtgtgcctgtatggagtggaatgaatgttngctggtgtctctctgaagactctgcacccagatttagggactgataaagataaggaacagtggaaagaggttcacaagcaggtggttgagagtncttatgaggtgatcaaactcaaaggctacacatcctgggctattggactctctgtagcagatttggcagagagtataatgaagaatcttaggnggg

SEQ ID NO: 619114 - DNA, 129 bp, Homo sapiens
acagcagaacatttgtggtaattacaacatgtgtgacattgtgccaatagctgtacagaatcaactggggaagattggcacagtctcatgaatatatagcaacttggaagtatggaacatggacagagt

SEQ ID NO: 619115 - DNA, 1040 bp, Homo sapiens
caaccctcctactcctcatgtacccatgctaatcgcgatggcattccgtaactgcttaccgaacgaagaaatatctaggctatatacaactacgcgaaaggccccagacggttgtgggcccctacgggctactacaacgccttcgcatgacgccataaaactcttcacgcaaagagccgccgtaaaacccgccactagtctaccatgctacgcctctacatcaccgccccgacctgtagctgcgttcaccatgcgctcttctactatggaaccccctcgtaccgcgaatacccaaagccacgtggtcaatcaatcaaattaggagctgccatgatatagtactaagaccagctgcagagcactaagggcgtcgtggcaagaagggctctgctgaatcgaggggtgagctctgaacactcgaaaggtagcacctgaatcgtgacggactgacgtacgcggcttggcacaccactaactactagcatatgcccagttcatgccctgattcgcaatgcatttactagcgtgaataccagaccatgttactgaaattacagggggttccacatatttgatcgtcgtccaacgctttaatggactaagagcaagagagcaccttctgaagtaagtgcctgcctttcagtgaaggccggcgtgccataatgatggatgaaatcttccagactgggcggaaaaaccgggcgcgaccacgcgtacgaaccatggccgaaaggggtaggtccggaacaaggtctcgggcacgggacatcggagtacgccaggagcgcaccctcgatgcagacactcgcgtagccgagaaccgggaagcacttatcatggtaagagaaccgcgccacgtaacagagcttctggggccaatgaggacgcaccgcccggaggcaaaggagcatgtggggtgccaagagcacaagacaagggggcgagcccaggaatcgggcaatgacccgctccggcggaaacacgaaaactccagaaaagcagcggcgccccagagtaaagtgcaacagagaacagaccaa

SEQ ID NO: 619116 - DNA, 1038 bp, Homo sapiens
  misc_feature (771)..(771): n is a, c, g, or t
acgatgcttggtcgaggccggtgttaatcggacgaggaattttgctgggaggctatgctgaatctccttaggcactctctaatcagatgtcctgagtcgtcccaattcttagacgtggtatacctgtttttctccttctcttattccatttagtttttcaattcatacaaaaccatatccaggccatcaccaataattctacacaacaaatgtttcttctaacaaccccacaatatcaccccttaccacaaaatcttcgttcagcttaatctctcccactctaggttcccacgccacccctaatcccgctcgaagcagccctgagaaacatcgcccattctctctccacaccaacccccacaaattttcaccgccccaagacttcaacactatttgttttatttttcttattaatataagaaggcaggaatgtcaggcctctgagcccaagccaagccatcgcatcccctgtgacttgcacgtatacatccacgtggcctgaagtaactgaagatccacaaaagaagtaaacatagccttaactgatgacattccaccattgtgatttgttcccgccccaccctaactaatcaatgtactttgtaatctcccccacccttaagaaggttctttgtaattctccccacccttgagaatgtactttgtgagatccaccctggccacaaaaattgctcttaattcactgcttaacccaaaaaacctataaagaactaaataaataaatccacactcttggtgactctcctttgnactcaggcccaacctgacccaagttgaaaataaaacagcatgttgctccacaaaaaaaaaaaacaacaaaaacaacaaaaaaaaaaaaaaaaaaaaacggcgccttttttttcgggccgggaaaacagtaataaaagactcgcaactgtctccgcccccctttgaaaggaaaaaccgcgccctctaggggtctatctcacccctatctctctctccacatgaaacacacacaatacaaaaacacctacaacaaaaaaaaaaacaaaa

SEQ ID NO: 619117 - DNA, 1304 bp, Homo sapiens
tggggattcaatcatctttattaacctatcatcagggttacatttttattacattaattatcttggatattctcaaggggcctctacttttagttacattcagtgttaatagtacaaaagccaagtaagagtggctaaacctcaccctagacatttaaatatccctcgcggacagagggaagcttagaaagagtctcaagtctcaactaacttatatacattggtaagaagttaggtgtctccaagagttaactaagaaagcgtgcatacattttttaagccaggggaggaaaaacacttctcattgtggggctcttgtgggtgttccccaggacaaatttaatacctttctcaattattaaacacccaaaacaatgggatttctcatataaaagagagtggcctcgtggccttgataaaatttctcgtgaaactctcctctcaattacccaaattttaacaattagggtccgggggacgctctttttgggggaggggcccaatataggctatagcacgctataacatttttaatgttggggggttaaggaggagagcgcctctcctttatactcggattaacccgagggctcccaggggcggggggatatatacgccccgtgaacccaaaagagggcggaaggcaacggggttaaacgccgcatataaaagggtatttgagcgcccccacttggggaaggggaaggggggtccaaggggtcacattccaagggaagtggaaaagttaaaaaaccctgggggcctggggttggaatgaaggcccccaaggggttggggcttggggaacgcacaatttcccaggggttgtgacgaagcgccagggaacgccccacaaggtaaataaaataaaccaaagggcgtagaaaacaagtttgggcgcgccacgcggataaacgttgtggggcacgggcaaaattgtggctccgaccagtgggcacacagaactgggaggcgagctgtaatacaagggcacaattgtgtttataatagcttgtaccccagaaacaggaggacggaaccgtgagtccatagaggaaaattggggtatcgtggcacaaatccccgtgaaccggctgcgaagtgtggttgggggcccacaactgagcggaacaaaaccgtccgaaaaacggaataaccaaacgtggaaggagggcgaagggtaaacccaagcgacgtgccacaaaacgcgcaggcagagcagagggcgacatacaggtgaactaaccgtatatgttatatgtgtcacaccagcctacagatgaccgagacacaatatgtgatag

SEQ ID NO: 619118 - DNA, 258 bp, Homo sapiens
  misc_feature (33)..(33): n is a, c, g, or t
ccccccttttttttttttaaaaaaaatggggancaaaatgggggggttttggcccccaaagggggggggggggggcccctttggggttttttttcccccctttgggggggagggggggcccccccctccccccaaaagggggggcctttcccccccccccctccccccccccgggggggggggggggggttttttttggggggggggggggcccctttttggggggggggaaaaaaaaaccaatggggggccctttta

SEQ ID NO: 619119 - DNA, 193 bp, Homo sapiens
atactaaactatctttttagcaatgtgttccatcttcttaccacaaactatattgatattttcccatcttttagaatacaaatttgttacaacagggtttatgccagggtattcttagatctaggtgattcacagaatccccagtaaatcttttggacaaacttccatgaatcaagcaaaatctacattttgc

SEQ ID NO: 619120 - DNA, 360 bp, Homo sapiens
tagaggatcccgaaaatgacatagaggcaggtcagatcatcgctccagtgtggctgagtctggggcttttataggcacaggataagggagtgcatgctaattggtttgtgagtatgcaaacatggttaaaacaaaggcaccagtcgaaagtggacatggtgtaaaaacagggaagggtatatgtaaaataggtgaaaggtggggatcaatcaaaggaaagcacaccaaatgggaagacaggttctcagtctcatccatggatttgacttgtagcttggacttcaggctttaagctgtttttggcttgaaggtaaggtcgcaccagggacccacctatgtctgcctaggatttctctgtct

SEQ ID NO: 619121 - DNA, 186 bp, Homo sapiens
gggtttttttttttaaaaaacccccttttttccccccccgggtttttaatttttttttggggtaaaaccccggggggggggggggaaaattttttttgggttcccttttttttggggggcccctggtaaaaaccccaaagggcccccgggggggggggccgaaaaaaaaggtgggaggttttttta

SEQ ID NO: 619122 - DNA, 120 bp, Homo sapiens
ccccgcccttgtgtggctcgtcgggggcccgtcgggggctctttgcgaggctcatcgcgggctcctggggaaacttcgggggaaccagctactagaggttcgattagtctttcgggaccg

SEQ ID NO: 619123 - DNA, 202 bp, Homo sapiens
agcagctttacctacttgtttcttttgctctctcttcctggcacactcacttttttcagcagcactcaaccagctctctgccaaatggcgctgtggcctccaccttagccctctgcacttcctaatgctggcggctggctcaccaggcaattctcctggccccttaaaggccatgcggcactcatcctagcccaccccccat

SEQ ID NO: 619124 - DNA, 1096 bp, Homo sapiens
gactagttctagatcgcgagcggcacgccttttattatatttttgtaaatggggtttagattttgtattattttctcatagcatcaaacacttccacacacatcgtgcccaccatttgtgtccatgcgcttccataaagagggaggtggtcgaacattgagggcttactcagtgccgtctcttcagcacagcttcatacacataactcgatgcctcaacagggtggttgtgtatcactaatatttctatgtcatcacgggggtcacatctctcctcacactcaccttcacctgtcacttatacaaatattttgcagggttcacacatacaattatcctccaggtcatctccagagattcacacataagaatataaatatctagcttccaccagtagagaggaatacactactcgcacctatccgtgtagtaggtgttcacgagaaaacgtgtgacatgttaacgatgatattcatctcatcagatgtggtcatcaccacataattatttccacagaccaatagcaacacatctgttctacgcgctgtcatctcgtcttagacaatcgtgtggatcacgcgcagaccctagaacaaattctggtacgaaaagttgtggggaccttaaatcttctgttgtgagcgcacagaggagtgtgagaaaccacagctgttgagacaaacaacaatggtgcgtggaggcatatgatgtacaactttgtactaataaacaacccaatttttgaatatattataccgatgctcatagactcccctcggataacgcggtgggcagacacccaggtgtaccaccttcagttactgtcctattacacatccatactacgaggaaacaacataataaaacgatggccacaacaaagcaggggaaatataaggatgcagtgaagacgatgagacaaagcagcgacacagaacgaccaagccgcgtagagccggaacgaagaatagacgaacaaactgacagacaaacgacgtagatggcagtacagcacactgaggaacacagctcggcggaacacaacgcagatcaacaggggggcaccaggaaaccagtgagacagaccaaacgcacgc

SEQ ID NO: 619125 - DNA, 1269 bp, Homo sapiens
  misc_feature (699)..(699): n is a, c, g, or t
  misc_feature (701)..(701): n is a, c, g, or t
acttttagggggcccctgttgtggggaaccagcgtgttggacccgaagaagcgcggggtcgggttgcccgttccccggatttttctccggggaatgtttccttcgggcctccaagggcggtgtcgcgaagtgccccttctgcaattgtatgggtgtaagacctgccgctgcccctcttgcggccccctctttagaaccaggggggccccgcttttcttcagcgccgctgctcgttgaatgttggaccccgtccccggggccctttagcccccaattgtggaagttgttccaaggcgtgttcgccactgttcgccaatgtcaacgcccttgtctccgttctagtgaacttaagggcccctatccgtagtcccccgcagccacgcccccgttgtgcgcgcatgtaggtgccgccgcaagtggagttggggcccccccgaagatgttaaacaccgcgagggtaatggccaccagtgtaccccacaaggggccccaccgcaagcacgcaaccacgacgcgtgtccccacgaaaagggccctttgcgatatccggggattatatttcctcagtgtgtatgtacccctccacgaagatttttttgtttcttttcgccacggactttttgtgctggagcggctctttagacccacacttcccacgcctctatggcccccctatgtccccccccccatttatggagngnggccacactgggcccccccacacacacgggcactccacaccccgcgctataatttcccccctcagaagtgtccccacactcctctcaaaaacacacactccgcgctattaactgtcgcgcactccacggaaggtatatcacaatcaccctcgagggcttcacccacatatggttctatatatagagaaaccacacccgcagaagccccaaataaattcacagccacctggcgttatttacccaatgtttaactgggttctcctaattttaaccctcctaacacagcctcacgaggtaacttcgaggtctcccttcacccactttccgaccggcactttatcgggtcacaacacattttttgtaagccacacacggcttccaccggagcttcaccgtcacttattggctcaactttcctcacctattctgcttcatcccccacactaatatttcacctttacactcccaacactcacctttggcttcgaaacccccgccctgatactggcacttttgtagatgtggtttgactatttctgtatgtctccatctattgatgagggtttta

SEQ ID NO: 619126 - DNA, 262 bp, Homo sapiens
tgggttttgggggggggggtttataaccccccccccccagggcgggcccccccttttgggttttcccgggggggggggcccccccccgggggggccccccccttcccccctttgggccccccccgggggggggggggggttcccccccaaaattggggtttttttttttggggggggggttttttttccccccgggggcctttccgggggtttttttgggcccccgggctttttttggaaaaaatttttcccccccccccca

SEQ ID NO: 619127 - DNA, 532 bp, Homo sapiens
agtggctcatagataggtgaggagggaggggtggccgtggcgtcatcggcatcaggcgcgagactggagggtgtgtgatgtggagtggcacgggtaaggctgactacaggagaatcgtccccatcgcctgctgtgaagggagagtcttcaaccagacccaccttcatcacgccaatgaagggaataaacttctgataggagtcttcatcagggaacttgatgtgggcatgtcagcgtggtgtcgggcacgggatgctgaatgtgtcgtggctgccccgttgacgtactgcatcacccgccctgccacgtccagttgctctgacactggtggctccgagcgactgaacagatctctccaaccagaatccaggaaggaactactgtatttactgtcgactgaccccaagtatttggccacagggtgagaaccgagggggatgatgaggaagcgcatgtagccaagccagtcggaggtcttgttggccagggacttgacaaagaacctgaggatggagctcaggtagctctggcc

SEQ ID NO: 619128 - DNA, 218 bp, Homo sapiens
  misc_feature (8)..(8): n is a, c, g, or t
  misc_feature (55)..(55): n is a, c, g, or t
  misc_feature (57)..(57): n is a, c, g, or t
  misc_feature (102)..(102): n is a, c, g, or t
  misc_feature (104)..(104): n is a, c, g, or t
  misc_feature (194)..(194): n is a, c, g, or t
  misc_feature (202)..(202): n is a, c, g, or t
  misc_feature (205)..(205): n is a, c, g, or t
tagcagtnaatatctgtcaacttctcttctacacaacaagagcctgacgcatctngntctaggatcaaactggctacaagacaatggagtgaagcttctgtntnatgtctttcggcatccaagctgtaatcttcaggacttggaattgatgggctgtgttcttactaatgcatgttgtctgggtctggcttctnttattttngantaacccaaacctg

SEQ ID NO: 619129 - DNA, 353 bp, Homo sapiens
aacaggatatgaaaacaacgtagtgttgggatcgtttgggactgggatgggaacagttcaatttaattaggggtcagagagtctcgacagaggaggcattccagtctatcaggacttcagagacaggtgcatgcctggtgaaatgaaagccaagcaggagccttgggtcctgagcaatccccccaagtgtaacggtagaagccttgcgatccttttcttgtgtaaagtatatactttttgtcaacattgcggggaacatcaggcaccacagtgcatgaaaaatctttcacaagctagaaatttgaaagggcccttgggtataagaagagcaggctcacgaaagtcatacccag

SEQ ID NO: 619130 - DNA, 238 bp, Homo sapiens
tagaatcgaggaccgatctcagggatctcccacctcagccactcaaggctaataatggtataattatatatatatttttttggtagagaggtagagtaggggttttgccatgttgtccagactcgtctggaactcctgggctcaaggaatctaccagccttgacctcccaaagtgctgggattacaggcgtgagccagcgtgcccagcctcagattcttcttcttcttcttcttcttc

SEQ ID NO: 619131 - DNA, 529 bp, Homo sapiens
  misc_feature (503)..(503): n is a, c, g, or t
actcatggcggtaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaccccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagagatgccctgtttcttgaccatatcaaatgtcaaaacgtcnatgttctggccgggtgctggctcaca

SEQ ID NO: 619132 - DNA, 714 bp, Homo sapiens
  misc_feature (1)..(1): n is a, c, g, or t
  misc_feature (48)..(48): n is a, c, g, or t
  misc_feature (51)..(51): n is a, c, g, or t
  misc_feature (53)..(53): n is a, c, g, or t
  misc_feature (56)..(57): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (67)..(67): n is a, c, g, or t
  misc_feature (71)..(71): n is a, c, g, or t
  misc_feature (73)..(73): n is a, c, g, or t
  misc_feature (79)..(79): n is a, c, g, or t
  misc_feature (108)..(108): n is a, c, g, or t
  misc_feature (135)..(135): n is a, c, g, or t
  misc_feature (144)..(144): n is a, c, g, or t
  misc_feature (149)..(149): n is a, c, g, or t
  misc_feature (224)..(224): n is a, c, g, or t
  misc_feature (237)..(237): n is a, c, g, or t
  misc_feature (355)..(355): n is a, c, g, or t
  misc_feature (357)..(358): n is a, c, g, or t
  misc_feature (367)..(367): n is a, c, g, or t
  misc_feature (372)..(372): n is a, c, g, or t
  misc_feature (407)..(407): n is a, c, g, or t
  misc_feature (411)..(411): n is a, c, g, or t
  misc_feature (447)..(447): n is a, c, g, or t
  misc_feature (482)..(482): n is a, c, g, or t
  misc_feature (504)..(505): n is a, c, g, or t
  misc_feature (524)..(524): n is a, c, g, or t
  misc_feature (546)..(546): n is a, c, g, or t
ntatgaagaccaagtgataaatctggtttcattgttacactaggcttntcncnatnnananttngcngggntnaatatncctgaggaagattttagttacaatgtatnccaatcccatcgatctgatctgagcanagctgacanatgangctggtcaaaaataaagggagattactcaggatggagtcagtcttaaacaaacttgtttctaacggcccatggtnggcattacaacancaggtgaggaaagagtagcatcttcttctttccactgagaagtaatggtctttaactgagtgtagaattggatgccctgtttgccatagaaattggtgtctcccctgaaggaggttcnanngccggtgantgagnacattggcaaaggcactggaatggggacattcacncccncctgtccaacatccaccaagtgggcatatttccgancagtggctccattggtggtgaagatggcagttccntttccatatgggttgttttttnntatctggatggctttttcntttttttttttttttattttcncaagaactggaccaaaaatctcctctttgtaacaggacatatttggcgtgacattcgagatgatggttggtccaacaaagttgccattttcatagcctttcactttaatttttcgtccatcaagaaggatggaagctccctcctttgttccactatcaatcagattac

SEQ ID NO: 619133 - DNA, 2396 bp, Homo sapiens
  misc_feature (1039)..(1039): n is a, c, g, or t
gcgcctgtgtcgtctctgtcgccgtccccgtctcctgccaggctgctggagccctgcgagcctgctgtggtggtgccccatgtgctgcgcagaccatgtggcttgctcctgccaaatgctgcgcatgggcatgcctgggtgcgcatgtggcagatacgcgcgcgcgctacttgctgctgctagtggctgcgtgcagcttgctccatgcactcggctgcattgcgctgtcctgttctgctctcactcacatgccacgccacagagataccctatcaacgaaacctgatgcctgcaaatcagaccccacacaggataacgcctatagataccctattcatatccactatgattgcgcacacgcgcacgccactcccgccagtaagttcacagcacgatatccgttaagtgcgtaccgtactcagaatccgataaccgttttccatattctcgctacccgtgatccaaatgcgtaacaccgcgcaacaaagtccggcacgtcaactacacaattgtcataccgcggtgtctagcacggcaaatacggccccctgtgctaccgtgacttggccacgggtcgccacctgccccgtcaccggcagtagctgcacccactaatatacccacgcactatgcgcttacacaacacagcctggcgacaacatcgctactatattcacaacggtacgggctaccaacacataacatcacacacactggccatacgaacaccgacacattacaaaacccacaattaattacgacataatctgctaaaacacgtcacacacatgccgtctcaactgtccaataccacctcaggccacatactggctctactccaccagctatactatagcatacacaagctcacacgcacaaacagccctatcaacaacctcaccccgggatcagcgatcacacactcctccacattattacttactcaccccgacacatcgctctacatctcacttctaccaccactaatggtcgaccacacacacaacacattattcacctcccatacacatcacgatgnccttattcacaccacaccctaaaatccctcgatcctcgtaccccctcactattccctgagtaccgacgcaactcctcacaaaaccagtcacccgtgatatacatcactattcacactacaacatcctataatcacggacgacagtcaccacactcgatctataggtgcccgcaccactctaccacacatgtaacatactcctccgataacgtattaatccctcgcccatatgttgagcaggtgcaacatcagtccactattacatagagcagtcgcgagccgacccatgtactgcgtctccacgttagtacgatcatcaactctcgctcagtgcctcatcttccgtacaaacaaacattacgtgcccaacacctatttagtcgaccgtcacaaccagtcgcaaatacacacagcctatattactacacactagctggcatctcacccatcctcagcaaacacatatctagtcacacaactactctccctccgcctctcttcttgttcgcaacacgcacctcgtcgcactgacgttcttatccacaatcattcatatatccacgaaccatttctacgtaatcaaatcaccgactcactattgagttgctgctacacccaccaaactattccttcaacactactccatccctccctacacactcgtctcctcaccataatatcaccaacgtgtgtactaccccccggcctaaaccacaaccccccatcgtctaccctttacgtccccaacaacctatttaaatacccacaaaccctagatcggcaaaatcaaatagtccccaccagagctaccaccacactacaaccaacttatggtactaactctactccgcaacacacccactcattacgtacactatactgcccaacatcttctccacacaacacaatcatataagtacttcatatgcgacagtcacttagctcacccttatacttacccatcctcaccatactacaatatgagtactaaacaaaacaaactcaccgaccacgccacgcaccaaccactatatattgacgacctccctacatccacaaaccacaacaatcactctcaccacatactaaccccacaccactctctcacccacaacccacccccgaccacccaacgcatcaacctcaaccacacttacatccctaataccaccaacaaaccactaccctaccacaaactccttcaccacatctctaacaccaccaccaccccccgctaatacatcaactctcaccacaccatcctgctcacaacaccacaccacctactcacccacactcatctccctgctcctatcacccatctctcctcatccctaaccaaccaccactacccacc

SEQ ID NO: 619134 - DNA, 144 bp, Homo sapiens
gcaatagatatagtacgcaggaaagatgaaaattataccagcatatatagcaaggctaccctatactctgcatatgattaactagaatactttgcagagggcaagctagacccgaaccagacggctactagacagtaaagggca

SEQ ID NO: 619135 - DNA, 397 bp, Homo sapiens
aggaggaggattaaaacgaggtgagcatgaagggacgcccgccccccacgcccctttttggagatgatgatgatgacgatgacattgactgggtgggatgaagacccaggaaactggggcaaaggtttttttgcaacccttccctaagcatgattttgcccagccaaccctgggtttaggcgagccccagggtgaggtcaactgtgccccggcaacaaaacctggggtgaggtctccctggtaaaactaagggagattaccccctttaaatcccagggcagtcaacagcctggcctatagtcctgggacatggatttttttttttgccttaaatttgaaacaaaagggcaatgactttgaaaataaaactaaaataaatgtttataatgaaacttga

SEQ ID NO: 619136 - DNA, 939 bp, Homo sapiens
cttcaaggcgttacggagaacgccattaggattctttaatggtcctcctaggtgtactaccaaggattatagagattgtgatacctaaatgtccttctgtacgattccattgccttgttaataagtggagttggtggaatggacgcgtgatgctcctccgtttctgagatatatccatttcagtgttcgtgaaagactaggacgtattttcgcaatttgtacttagtgagtacttacatttgtagtgacgctcctacatcttccgataaataaacgagttaggaaaactgttcattcatagaacaccggtataggtctccgacgggtctcgttgtaggcgacctcgggccctatgagtcattagcgcgtttggccttagaaaagtactcgaagatttagaccgttgtcgtccacatcatgatatacggatatgatatatgcccgattggtaccgcattctcggcttttgttagaaccaatttcgtcgccatatgggggggggtcagagcagctttcttgttgagtagttaaatatgaccttcatgcttgccttcgccaggctctaaccaagaggccctctcccacatgtatacagaaattagtgtgctgcatggccctgtgtgaaccacgttgaatccccccacgaagtagatggttggcgcgcgatatcgaagtgcgaatttagtgaacggagtctcccagtgtagggggcatacgtgtggaccgatgtctggagcaacgaatatattctgcgtgtgcgggttttgtttgaaagactgaactgtaatggcatggtcacttggcttttaaagtttacttccacagccttgaggaagtgacagtgggggaacatgaagctcgttgtgactatcaacaccggaacgtaattagtcgcgtttttgttccaataaagtttccaggaccaggcgtgaaatcagg

SEQ ID NO: 619137 - DNA, 132 bp, Homo sapiens
tctgtgtctctgtaggttcagtccccattggtggccgcattgcatttgcatggtacagggcagggcatccgtgtgcactcgtctcgttcatgttccaggcatgcgtcatggcatcggcagggcgcatgcagg

SEQ ID NO: 619138 - DNA, 222 bp, Homo sapiens
agttcatcacatgagtatgattgattaagtcaattgacttcatgattaagctcaatatctagccctcgtgcccgtccccataagttgggtggttgaaagtcccagctcttccgtcatgtacttggtcctactgtgaccagcctctgtgctgaagcttcctagggtcccaccatgagttatttcattagcatactagagacgttcacttaatgccgctagcgc

SEQ ID NO: 619139 - DNA, 1314 bp, Homo sapiens
  misc_feature (32)..(33): n is a, c, g, or t
  misc_feature (677)..(677): n is a, c, g, or t
tttaaagatggcacagaatatatataatatgnnccattagtgaattttgggttataaagacccaaaatgcgctataatgtattatgtactgtaattttaatcccttgaactatatggtacggcatgattttacagtggacatcttgatatggtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaaaggctgtagtatatttggactagaaagtaactgaatctcaaaccaggtagtgtggagataccccctccatgaattacattcttcattccagggtaggtaatacacagaaacatgttactttacctgttgccaaggcctttgaaaaatctacttttacaaaattggaaaacgtcacttgtagtcaaagccattgccagtcattgattttaatgttgtaagattgcttataggacatttaatttaggaagaaatgatcatacgtctatgagagggtactaggaaaagcttanaaatttcaagggctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatattta

SEQ ID NO: 619140 - DNA, 860 bp, Homo sapiens
  misc_feature (860)..(860): n is a, c, g, or t
tagctcctccaaatatgccccgtcttactaccatgtgatgccaaagcaaaattccactctgtgtgggtgataaaagatcagacccagagcagaatgaaagagctaaagacaccgagtactccttgtggcttgcagcaactccgtgctcagttgaagagcgaaaattcgcaacaagagtcaacactggtcacttaggcaccataaaaaagcgacaggacagatttcacaggcaccggctgatagccagaatgccatagatcacaaaattgcagcagtgatacagaggaacactcaagacacaaccgtgcaccgactcactaactggaccgacccggacaaccacccgcgacagacgctctcccgcccggaacggacaaccgtgaaccaacaccacgtcacacacactgcctcctgaaaacgcacacaccggcacactcgacgcaaaactacctctcaccactacctcggtaacctactaccgaccgacactgagccctctgaacaggaactcctacgcgacaggaccctaccaggcacgtggttaccccggacactctgacgcaggaaccaaccgatgtgctctgtcaaaaatcggacggatgccttcttaagccttctcgacgcataaattacactatctcctgactgacaccactgccggcggacaccgcacacgtggtggtggcttcgtgcgaacactgaactcgaagccaaagaacgttccccagcggtaagaaacaagccagccagctcaactcactgttggaacccagggccttcggccactcccttatctcaagcctaacaaccctccacttggttggcggcccactgcaccgcggactccaccacacccctgn

SEQ ID NO: 619141 - DNA, 5026 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619142 - DNA, 2906 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaaaaaggggggggccgcctttatttaatatagaaataaaaatagaaaagaaaaaaaaaataaaaataaaaaagagaataagaagataaaaaaaaagataaggaaaataaaagataaagaaagagcacaagaaagaagaacgatagaggagacgagacagaaccaacaaagaaagaggagcagaaataaaaggacagcggacagagaggtacaaaaaaaaagaagacagagaagaagagacaaggaggagggggggaagcaaggaaggaaggaagcagagaagaagaaaaaaagcgagaggaaaaaaaaagcaagagaaaagagagacagaggaagaagcaagacgaaggccaagacagacc

SEQ ID NO: 619143 - DNA, 5078 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaactttctggagcaatgcattctcaagtgtttcctcacgctcattttgcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619144 - DNA, 228 bp, Homo sapiens
tactcatagaggatcccagtgctacctccacaaacaggttcggtccaggctacttcaataaagcgaatgttgcataaagcagggtgacaaactttttagtttccctggtgcatataaaaagttggtgtttggcattattactggtagtctataaaagtgtgtagtaccatttatgccttaaaaaatgtatattcctttaggtttaaaaataattttgtttgctaaaaa

SEQ ID NO: 619145 - DNA, 202 bp, Homo sapiens
ctcggcctatctatatgtccaggcttctttccccatagtgtctggggacaagaggtgtgggttacatgagtaggttctttagtggctattggtaagatttgggtgcacccatcacccaagcagtatacacggcatcctacttgtagtcttttatccctcactccctccccaccatttcttcccctgggcgtcagtatagata

SEQ ID NO: 619146 - DNA, 298 bp, Homo sapiens
gcggatcccgtgattgtgtggtgttatgaagaagatgatgaatgatgttgataatcgcatctagatatttgaattgaacgatgatgatgatgaacgattaacgatatcgtcgaatgatttgaatttagaagaaaatatagagatatttaaatttagaagatattaaaaagagaattgaaagcgagtcagtaaccataactctcttatttttctctctcatattgccacgtgtacattcgtgatacattcgtttgtccactttcgttacccataacaccacacaaatccgggtaccgag

SEQ ID NO: 619147 - DNA, 4909 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagcaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619148 - DNA, 105 bp, Homo sapiens
tgttgttttttgaaaagcttttgatattatggaaaatgcttatagtgtttagcgaaagcagcaggcacacgaatatgcaaaacacacatatacacagtatttgga

SEQ ID NO: 619149 - DNA, 4810 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagcaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagcctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619150 - DNA, 81 bp, Homo sapiens
gagtcgccatgttagtttcacatactgcaaggaaggagaatcgagtgtacaacggagataccgccagatattactagagac

SEQ ID NO: 619151 - DNA, 146 bp, Homo sapiens
ctaagtccgcgtacgcagctatataatcaatctggttactcttatagctcaaagcaatttggcctgatctatctatctgatggacatgcatcagagatgattatactaggaacaagagtgtcactgatgctcatgtgtaaatgcat

SEQ ID NO: 619152 - DNA, 4515 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619153 - DNA, 117 bp, Homo sapiens
tacccctgtaatttaatgccaggctgaaatgtactccggagagaagcaaacgttcatcaacagtcatcataatgcgaggtacagtccctttacctacagcgctctagtgacttgtgg

SEQ ID NO: 619154 - DNA, 4910 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619155 - DNA, 337 bp, Homo sapiens
atgtattatcacgaattgagcggaaggcctgtggaatgtatcatataggaattgagtggacaggcctgtggaatgtgagaggacctcgacacctggccgcgcgatcatcggaacctgactcttgcactggctgcatgtggcttcccggtatttacacgccttctccacgtggtctcgcaggtctttcctcaagaccttttcttagcagaccggacgcacacatggaagttcttcaaaatggcaatcatttattaaatgcaccagcatctgtcccagcgttaactgctctgcccaacctctgctttcattccgacactagatcttaagagccagaatt

SEQ ID NO: 619156 - DNA, 996 bp, Homo sapiens
  misc_feature (728)..(728): n is a, c, g, or t
cctgttgactcacgcctgtgtcttacgataatgcggaggtcaagttgggtgaatagatacaggagtctgagagcttgactggagacgctgtgagacgccgtgtggtagctaattatacaaaaaatatgatacggctgtgacgcaggtgcctggtgctatgtcgcgcaggctagctctggaggagggccttcaagcgccaagggaaaatatcggactcggatttgcatgggaagagacgcgaacgacctgcgggttgagcgcggaccattgccacttcattcgccaatttccacgcctaggggtgaaaagtagggggcaattctgttcctcacacctgactgcgattggatatcccaacactgtgaatggatggccatggggggtttccatgaatatagctaagtccctacgcaccttcgagtagctccggatgcaggggtcggcttccttgttgacccgtcccaagttgtacgtctttgacaacacgacgtccattaggcctacagcatgtgtaagagaccccttggttctcaaaatttactaattaaggaaacaattaaggggcggaccctggtttgtgctgagagggtaagataaatcgcaggtgtagctgagagagccctggcatgggggcacgtggaccttgggccttgagacatcaaggcaatgtgcgttggctagggccgttgagcgtgagatcagcacccattgaagtttcgtaagtactnggctgagccaggaggtggaatagtactctgcttctagatatgagcccctttttgttgtttttgccctcttgtgtgtgtcgcccttgtggccccggagaaagcgttgggtcagcacccggttggcgtgggcaggttcctcttggcgggggcagacaacatgttcgtcatggtggttggccaaaagaaacaccggggcatacaaaagggatgtttgtcgcacataagagaccgcggagggatcaagcactttgaagaggccgggccttga

SEQ ID NO: 619157 - DNA, 4459 bp, Homo sapiens
ctgtggattaaatcctgccctttttgatgacacatactaagaaatttagataaatttctctgttttcacaaaagatcgagtgaaaaatgagaaaggttaactccgcataatgtaactcttcgtatgtataagtgtgttttaagtttgcagatagttttgtataaagattttgcagatccgactggaatatctttatacttaatatgtggtttgtagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619158 - DNA, 1413 bp, Homo sapiens
  misc_feature (531)..(531): n is a, c, g, or t
  misc_feature (588)..(588): n is a, c, g, or t
cgggcgatgatcgaacagcgcctgggaacagcgctccccgtaactatggtcccgagcccgaggatcctccatcgagttagatgtctgcgtcgagagggtccgaggtagcgagaagcttatctgagagcagcgtacgtgccgcacgtccagtcctctccgagcgaggcacttgcgcattccacggcgacctccctaggctggcaaccaccgtgagcaagggacgcttcggcctctcctagcacacgctaaaacacatatcgattcggtctcgtcttgtgagactaacgaggaatctgtacctcgataatgatacttctgcttggttcgcatataaggctaactcagtgtctttactgcttggactctggaccatgggcaacactcatgacgcatcggacctgcaagtaagttagagatggaccggtcatcatggcagacatccagtagcagagaagagactaccgaagtgccactgactgagaagactatggtccgcgttcttgaatacccgaatctagggatgccgatacnttgcgagtcaatgcgagtgcatttgccacgagttagtcacgtggggagcgccacctngggcccgtacccgcgcgcaggcgctcgcggttcgacccttacttgacctagttattagtcgtaccctgctaggctattaacaagcacctttaaaaggaaggtcttcccttgccctcataatccaagagaaaggtgaccttccccgcgattgtcctgaggcacacgtacgcacaaggcctaggtttcatgggcaaaaagatatctcctcccacaaattttctgtcaccattggccgtatgcagtgatgtgacatgtggaacgcgccagctatgtgcatgttgacaacatggcccaggccacacaggtaacgtattgccatccgtgtcgccacatgttacatcctataaaagtatagttccccgggcggaacattagaaagaagcattatacccccccttgtagcgttgtatgggatgcgctcacacccaagtaactaacttgctaacggaagaaggaaaatccagcgatttggcaagtcgttcaattcgttagaaacaattacacattggaacggtttctaaaaaaggccatgggcacgcgggtccagccttattcgaactagggaagacaaaaacgggcccttaccttttgtgggggcaaaggtaaccgaaaaggtggtagcattgatcacgtctagattggttgcatgagacccccttgaatcttttacccggcttatggctcttttggatcaattcaatttcggatacaacgagaaccaattttgcagccatgaaacagggtctcatgggacacagtatgggtccgggaaagcctaaaaacgggacggttccccaccttagggcaaacgcattcccagcgcct

SEQ ID NO: 619159 - DNA, 4394 bp, Homo sapiens
tgcctgtagtttcctttgttaatagagtcacttttatagtactgtgcttgaggtcatatacagagtattgtatccaaatttatcattgcacaaagtgttttggaaattcttggttactccttagtaaattacctgtaattgggttaaatgctggtagggtttaaaatctgattgctaagtgaattctctataaagtgagttttgatacatagaaacttttcatataattcttaaactcatgtgtcatgtattttcatttatagttttcatattcattaacatatgtggttccttaccatttacagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 619160 - DNA, 297 bp, Homo sapiens
ggtcgatctctagcaggatcccccgtttatgcaccgggttagggtgaagatgtttactgccctagggtcaaccctagttgaataagcaaaacagttatagcttataagtcaacaagaggagataagatagaatcacaaaacatactctaccctaaagaaggtggaaaaaggaacaagataagtagtgaaactaatagaacaatggcaaggccatatactgtaatcatatcagcaatcacattagatgcatatcatctaaatctcccacttaaaaggctaagattgtcagactaaaag

SEQ ID NO: 619161 - DNA, 1027 bp, Homo sapiens
gtcatgtgattgaatgcctagtcaggatctgacatatagctccactatcaatagtgtagtatttatttcagatcccttatcaggggtgagtcatgtgatgaatgggctaatcagaaaagtgaaggagcgaagaatgcataagcttgcgcaacatgatgacatatagaacaagatcgtgtatctattttttatcaggtgttgtaatattcgtgcatggtcgttatgtgttgttgtagcttattaactggtagaggatagaagatgaggaaagaatactcagtctttcctcgagcagtcgtattacagaggtgacacagttgcggagtaataatctgactggcctagtcgatggaaaagacaacctgtttcttatcagccccatcctgctaatcctccgctgcaaacgtgaactacactgttgtattctagtaattcactgtgaatctgataaccaacagcgcggtcgagtgtctagtatctactaggtcgcaggtgttctgtcatgagccattatatgtagacatttaaataaatcatacggtaatacttgtctgactgtgaccatgaggctccataagcgatacatatatttgggatgacatttgctatactgacgttgtgacagtggtctgagtcatctctaagtcttccgtgggcatggacagtcgtaaataatatcagtgatttggaacaacttacaattcttgccgtgtcacagtgaacacctgggtggttggtgttccgttaaattgtgtgagaaaatgtgcattaggggaggtccagattttaagggagtagctgcgatgtcccaggtggataaggcttctttgtggagaagaagaaaaagaagacaaacacaaaagggggggtagagatatcgggggcaatatcaggcacacacttgagaaaggggccaaagggggtatataggaagaggagggagaaagtgagagaagacgagtttgggaccactgtgttgttgtgacagccaggaggggaaaaatggtaaggggggcggtatacacgt

SEQ ID NO: 619162 - DNA, 696 bp, Homo sapiens
atgttcattgtggaatacaccccgaaaagcgatttcaatagcgagggtggtctccagatctccaagcaaacaggccccagttggttgttaaaacttgatagactcagaatactttggaagaagaaaaccaaaagcggctcttactcaccggtaattttccatccaaaagtgccagtagttaccacaattgccaataaataggcaaaacactagttaatagggcgtgcctcatgttttgcatcggttagtagattttccaccaggcgcagtgcttgatcaaaagtcaagctgtccttccacacaaactttgtgaccaccatctgtaggcgaaggtggctttcttaacttcaggcacaccaatctcttcgggctctggactggcagccttcaagggccctatagacctcagctaagatgcgttaaagggaaacagagaaacagatgtacagagccgaagccaagtctacgcaatcccttgaggaagtaatattaagttagctggagcaattcacatgcaagagataactctgacaatgcccagaatttcctagctggtcctcattagtgaacaaaagccatttgaatataaacatccggccacgtgtggtggctcacgcctggaataccagccatctgggacgccaagacgggtggatctcattaggccaggagttcgagtccagcctgcccaacgtg

SEQ ID NO: 619163 - DNA, 360 bp, Homo sapiens
gggcccccccctttttttttaaccccttgggcccttttttttaaaggggaggggttttgggcaaccggtttttccccccccctggggggggttttaaaaagccccctttcccctcccccgggggttttttgggaccccccctttcccccccggggggttgggggtttccattttttaaaggtttggggggccccccaaaaaagggaaaagggcccccaagttctcctttccctttttggttaaaattttttaacccccccccccccccccatttatttttttttaagaaccccaatgaattaatttttttttggggggccttttaaaaaattcaaattaaattttttttggggcgcagga

SEQ ID NO: 619164 - DNA, 170 bp, Homo sapiens
ttttgggggggggggggggggggcccttaacccccccccttttgggaaaatcccccggggggggtttttttggccccttttttttttttaaaaaagggccccccgggaggcttgaaaaaaccccttttttttttggttttttcccaaaaaaggggggttttttttgggga

SEQ ID NO: 619165 - DNA, 193 bp, Homo sapiens
  misc_feature (160)..(160): n is a, c, g, or t
tctgacactctgttgtataacctcagaaagctactagatgtgaagtactaatgactagcatgatcctgccaagtgaaagaggcaggcatgagcaatggacagttaacgaggggtgggagccttgatcatcgatgagggagtcttgtactagacatctatnggaaaagactgtccacagctgtgaatgtcatca

SEQ ID NO: 619166 - DNA, 914 bp, Homo sapiens
  misc_feature (34)..(34): n is a, c, g, or t
  misc_feature (74)..(74): n is a, c, g, or t
  misc_feature (82)..(82): n is a, c, g, or t
  misc_feature (86)..(86): n is a, c, g, or t
  misc_feature (92)..(94): n is a, c, g, or t
  misc_feature (103)..(103): n is a, c, g, or t
  misc_feature (126)..(126): n is a, c, g, or t
  misc_feature (151)..(151): n is a, c, g, or t
  misc_feature (153)..(153): n is a, c, g, or t
  misc_feature (171)..(171): n is a, c, g, or t
  misc_feature (254)..(254): n is a, c, g, or t
  misc_feature (262)..(262): n is a, c, g, or t
  misc_feature (299)..(299): n is a, c, g, or t
  misc_feature (359)..(359): n is a, c, g, or t
  misc_feature (489)..(489): n is a, c, g, or t
  misc_feature (504)..(504): n is a, c, g, or t
  misc_feature (547)..(547): n is a, c, g, or t
  misc_feature (553)..(553): n is a, c, g, or t
  misc_feature (603)..(603): n is a, c, g, or t
  misc_feature (622)..(622): n is a, c, g, or t
  misc_feature (641)..(641): n is a, c, g, or t
  misc_feature (645)..(645): n is a, c, g, or t
  misc_feature (666)..(666): n is a, c, g, or t
  misc_feature (682)..(682): n is a, c, g, or t
  misc_feature (705)..(705): n is a, c, g, or t
  misc_feature (708)..(708): n is a, c, g, or t
  misc_feature (749)..(749): n is a, c, g, or t
  misc_feature (754)..(754): n is a, c, g, or t
  misc_feature (778)..(778): n is a, c, g, or t
  misc_feature (841)..(841): n is a, c, g, or t
  misc_feature (908)..(908): n is a, c, g, or t
aacaagcttggatgagcagggggaactaggggtnggcagaaaggattatgggtggaaaacattggctcttcctnggggggtnatgngggggnnngggaagagngtggctcagcctgcgggtaaatnggctagaaaagccaaggccaaaggntngtggggagaggacaagtnagcatgtccagcctggggtctgggtgtggggttatcccttctccctgtccctccccatctcgtccataagcctaggtcttggngccttgtntggggggctgcggtaatgtgaggaacggggatctgtntagcttttggccactccctgggacctcacgcccctttggacagagggagattgggcagcngggccttgctgctttgtaatctgctgtcccgacttggtttgtcttgtccaagggtgacgaaagagccagggaccagggtctcatgggatgaggtacagggtgggagaggggggaggggctgggggctgangggagccagaaagcngtggctgtttggggctggcaggatgtggaagaccgcctctccngccctnacatggggactgggcccagaccctgcttggtcacacccagcccagaagangggtcctccagttccagtnactttttcggtggagcgtnagtngggcttttgctccaaggagtnccttcccatttcaaanaggagcaaatggtgcatccagcnctnaaagaccttccagtttatggtctccatggtgttcttaaggngtttnaggttctccgggaagctccccttnagtggcgggtacaccttcagggggtcagcattttggagcaggtgcataaaatggtcctctgtnatgttgccatatttggtggcattttgcatgggcccctggggcagggctcccatgggcagcccttgcntcacca

SEQ ID NO: 619167 - DNA, 171 bp, Homo sapiens
gtcgccctgctaggagaggcgctttcacaggctgggaggttgggttacattttgcaggtgtaccaaagggttcaagcttttccacccacttctctatccactgagacttcacctaactaatactggtaactcacttatttctattcacagccggtacttaactaagtaacc

SEQ ID NO: 619168 - DNA, 492 bp, Homo sapiens
tatacgtatcaagggtataacgagatcgagagcgatcctgtgattcttattaccggctctcatctcacgacgtgaaacacggggtgtgtgaaagtcgacattacatacatgaggctatcagcagtgattgtacaggatgtgtcattttctaggaatacagagaaggggagagctgcaggtgaagcgattctgagggctgaaaatccctttcccagtacgaagacagcatccttcaatcccgccagctcatgtgcatctgagggtggggttctgtcttcatgctagaaaccaaactgctctcacagcttcctgctaaatcaccacggctaacggataagcagagacggactatccagtctgactactgagcactcaagtcgtcagtccagttgctacccgggaacggggggcagacagtgtgcgtgcccttctaccggggctggacagagtgtggtttaccgggggaacttggcaagccggggccgaacgctt

SEQ ID NO: 619169 - DNA, 233 bp, Homo sapiens
catttactcctaagtcttattacaagctaagccagacttaagtgttacatgtggaaagtgagagcacacagaggagcggacatgcagcaaggcgacgcgaggccaatgcagcgaggggtgggtgacccagggagtggctcagttcacgaaaagcgagcgggtgaactccacgtagtcgaacgcggtggggagctcgcggcccttgccgtccaccgtagggcttcatgtgggag

SEQ ID NO: 619170 - DNA, 997 bp, Homo sapiens
gctgaggaatgatgtggaacataatgtcgctcgtatggtcatcggaggcccttataatctggccctgataacgtccgatctcacctcaatgtgccatcgttcccccaaaaggtgccttcttcttcagcggtcctcctgcggggctccctatgcttgggcaactgtgcttaccaccccagatagctggatttactaaatagtgcctgatgtttaccatctcattgagagagtcttaatgtagccggcccaggtccagggttctgtgccccatgttgatgatgctggtatctccattcctgggatattcctatggcatttaccaatgtctactgtcacttcctggtgacttgtccatctttcctaccagacagcttcccaaggcatgtcttactgaccatcggattccccagcatagagcatagttaaatgcctagtaaataatgaatggaaatccaatatgaacagaaatgggatttttcaccatgaaaattgtaaaagattcgtttgggattacacatgccaggtaagtggaaggaaagaaacattgtgaggagtaatctagttttaaaacccagcttaactcagcttggttattagaaatagtgtaagtttgagaacaggagaagggaagggatctatctagctttctgcatatttcttgatagcctcctaacctaacaacaaaatgccaaaaaaaagcaaacctggcagccattgaagagcattcataaaggtttttgttttgtttttaggagacagtctgctctgtcgaccaggctggagtgcagtggcacaaccttggactcactgcggcctcctcctcaccgggtttcaagcagattctcactgcttgcagcctcccgagtagctgggattaacaggtgtgcacactctatgcctggatgatctctagtgtgtctttttttaagtttattaaaaaacccgagcgagggtggcccaacgcaaattgttttcggaacacaagctcctagcttcc

SEQ ID NO: 619171 - DNA, 232 bp, Homo sapiens
tgcagtcggtagccagcgaagaagcacaggatctcccagcccagatgtttcccacttaactagcattgcccttttacatcttttttttattccccaatagtcttcaggacattcagtacactgtgcttttcagagcgttgatgattccacgtccctgctcctgccttcacctcgtctttctttgtcaaattgcctatctttgagccattgtatgtctctgataacatctctg

SEQ ID NO: 619172 - DNA, 217 bp, Homo sapiens
gtgtccatgtcacgctagctgtcaatgtcatctgcgagttggccaggtgcatccgcaagaagtacctttcccttgtccgactcttcttcaagctcatgaactcctccaccaacaagtgggtcctcatcaagattatcagactggcaagtgtcccttccggtctgtgctcttctgtcacctggagaggcacacttggtggcccagcggtcgacggacg

SEQ ID NO: 619173 - DNA, 201 bp, Homo sapiens
caacaatcctgtaagggaggttttacaaactcttctttgtatatatatatatggttttttgagatggagttttgctcttgttgcccaggctggagtacagcggtgagatctcggctaactgcaacctctgcctcccgggaccaagcgattctcctgcttcagcctcccaagtgggggagattctgggtgtgcaccaccaca

SEQ ID NO: 619174 - DNA, 492 bp, Homo sapiens
  misc_feature (41)..(41): n is a, c, g, or t
  misc_feature (63)..(63): n is a, c, g, or t
  misc_feature (154)..(154): n is a, c, g, or t
  misc_feature (186)..(186): n is a, c, g, or t
  misc_feature (316)..(316): n is a, c, g, or t
  misc_feature (355)..(355): n is a, c, g, or t
  misc_feature (357)..(357): n is a, c, g, or t
  misc_feature (407)..(407): n is a, c, g, or t
  misc_feature (413)..(415): n is a, c, g, or t
  misc_feature (417)..(417): n is a, c, g, or t
  misc_feature (432)..(432): n is a, c, g, or t
  misc_feature (466)..(466): n is a, c, g, or t
tctctttctttttccatttcacacataaactgccctccgtnaaattagggatccgtccagctnggacttcatttcatcctcgatttctgggggtggaggcaacattaggcctttctcttccttctcttcctcctcctcctcctcctcatccttnccatcttgttccattggaccagggactactgntgtccagaagacggggtccccatttcccaacacctgatctttcggatcttagaatcccccgtcgccactggctcctcctccttctcctccatggctcttcctcctcctcctcaccctcagcaggatgaangccaaggaccccccagccagaagcagcagcaccagcagngncccccccacggccccccacaccagcgggcccacatctcggggcgaggccngggggnnncncggacaaagaggacnggcgcagcgcggcccaggcccacggcaggggggncggggcagacgaagggggagggaaca

SEQ ID NO: 619175 - DNA, 297 bp, Homo sapiens
tcttgggtggagccagtgcacgtctgtgggagcgtttgggtggtgagtgcacgtgctgtgggggctgtcttgtggtggaggtgactgcacgtgctgtggaggcgtcttgggtggagtcagtgagtgcactgtgctgtgggggcgtcttgggtggagtcggtgattgcacgtgctgtggggggccgtcttgggtggagtcgagtgcacgtgctgtggggggcgtcttgggtggactgtgagtgcacgtgctgtggggggcgtcttgggtggagttgagtgcacgtgctgtgggtctca

SEQ ID NO: 619176 - DNA, 436 bp, Homo sapiens
actctgtgccactgcaatgacagactgagaatactgtggtaggagtctctatagcgcatgatgccacgggcgagcgtgacccagatggagacccgacagctgttgttcatcattctggatattctggagaccgacagaggaagtctagggcctagagcctttgtcaaggtccagtgctggtccaggacaagagcgtcatcctgtagggactcgctgagctggacttgcacaccatacatggtgttctgggccacctggctatcgagacacgcacgctgtatacactgtttggcggcaacgactgcctccgagaagcccttggagagacctagaggcgaacggctggctggtgcgctgaccaagctctccgtactgaacctatgcatgttgcggctgaaccggctcggcctacagatggatacgctgtgtctacccg

SEQ ID NO: 619177 - DNA, 387 bp, Homo sapiens
tacataatctgaccagctcaacaatggttccaggatctcaatgcaatgagtcctcattcgtatctcgcgaacgctcaggtacagtcgcagcaatgtcacgcttcaagatctcgatgatgtctgtcagagcagtcagactacattgatccacaggagtgagagttcgagactcatctttctaacagcgagaacatgtagatgcaacggggttcagatatacatccttatcttcacatcagcgcattactcgagaatggcagttgtcctcaatatagcttgtctgctgtacatagtcagagagtttgctgcccaagcctgggttttccataaacgcagtggaccagccggctcccctggagcgaggtctctggcttagtaacacttctg

SEQ ID NO: 619178 - DNA, 680 bp, Homo sapiens
tgggtcataacgtgtagtgctatgagtacctatgaagagttgttcaacgttggttcccccggagtcatgagagccacgaccttttgtctgcccaattatgagaggaataggggaagctttcacgccctgcaggcttttttagcacggcggaccccaattgtcttgcccagaaacttgtgtttgccgcctttgtgctcgcacgatttcttgttaccccatcccctctttactccttgcccgtgtgaccctgcttttttctctgtagatgttcaccagttaaggcctattttcctcgggccactttccccacccgatcgaggaccacccccatctgtttggggaggttacctggccccacaagtgtatccgatcacgttagccctgtctgtgagaggaagggacacccactattctacactgccctctgacctgccccttgatccccatatctattaccgtgtccattagggataataggtaagggctctgtttctgtcaagcccatgttcaccaaggaccacctgtttaaaaaaaaaaaaagtctggcatcagagggagcatgtggagagcaacttgggaagaacaagttcattttgtattgaatgatttttaatgaatgcaatattaatccttgcagatgagccataatcattaaatcgattaaatgataagacccttta

SEQ ID NO: 619179 - DNA, 557 bp, Homo sapiens
  misc_feature (94)..(94): n is a, c, g, or t
tcccagcagaagcccatgaagagtctgtttggagaggacgagaaagagttggtgaggagactgagatcatccccacgctggagcctttgccacntcacgaggttcctggacatcagtcagtttttatgaatgaaccaagactgtctgacttcaagcaagttcttttgcgggaggggattcaagcggaatttgtagggggcgtacttgtctgcaacaatcaagtagcagttcgcagaacagaaactggacgcatcggattagaaggctgcctttgtcaagacttttataggatacgagaccttttatatgaacagtatgccattgtgtaaaggacatgatgtcaagatgtgtctgcttgacctttctcaggaagaaaggattctcatctgaggctaaacttttgctgtcttgttttgtaacatacaaaaagaatctgccagaaaacgtgagcatgtactagattttgaaaaatatgaatcaagggcctggggtgtagctcagtggtagagctcttgcctagcatgtgcaaggccctaggtttgattctctgtcctgaa

SEQ ID NO: 619180 - DNA, 146 bp, Homo sapiens
gtgtagctattactgcaggccaccgtactcatgcacctaatgggaagcgccaccctagtgcaatatcaaccattaagcttcactctacacttatcatcttcacaattctattactactgactatcattgaaatggtcgccaatccg

SEQ ID NO: 619181 - DNA, 160 bp, Homo sapiens
gatgaaagtcctgcatcccctcaaagattagcttattcgcaggtagaaagggctagagaggctatgtcccaaattcttactcaatgctgaattagactgggctcttgcttgtgcaagtcttgtattgacagagattagtccagttacagaaccaagaggg

SEQ ID NO: 619182 - DNA, 363 bp, Homo sapiens
  misc_feature (356)..(356): n is a, c, g, or t
gtgtcgccaatggttatccagagagccttccgcaggcacctggtgcaacgcttcttgaagcatgcctccttccatcttccgtcagcaggcgggcagcggcctctccgaagaggatgcccctgagcgagagggcctcatcgcctacgtgatgagtgagacctttcttccgaccccttggcccacccctccagctcctccatctcctccacttccttcccaccctcctatgacagtgtcacctttttaatttccagaactgcacaatgaccagcaggaggggagaagagagtaggaaaaaggagggaaggccagacatcaagtgccagatgttgtctgaagagatcgagcccttctcnccgagct

SEQ ID NO: 619183 - DNA, 150 bp, Homo sapiens
cgctgttaggctgggagacgcggacagtgtcgtggatgagggacagaagggcgcgcaaagccattccttgttcgcgttccatcgcccggtcttcaagcgtctcggccaggtagaacatggaacgcctggttcgcggcctcgccaacgtgg

SEQ ID NO: 619184 - DNA, 146 bp, Homo sapiens
gtccaaatgtaaactaatcgtcccagcaattctattactcacaatgacatgacttaccaaaaaacacataatttgaatcaacacaaccacccacagcctaattattagcatcatccctcatactattttataaccaggtgcaacaa

SEQ ID NO: 619185 - DNA, 791 bp, Homo sapiens
cacaggtttatagaaattaccagtcaactttctcttgtaaatcatctacttctatttccttcttccttcaatatagaggtaaaccttgtgaaacttgtttcaaatttaatgaatgactttatatatagttttggttttttaactatatgaatatatcacctataacaaatgcaaatatttgtttcacacatccatcctacccctgaaacctccccccttcacacacacactttatacacttcagtggtttcctttaagacaaagttttatcattaagaggctgcatggttttgctccagttatctttcatgtctcatcttaaatttgctttctccccttccctatgcactagccaagctaacttttcttcagtttctcaatttgctctttttcactacttgttgttttaagaatatgttctcttgcatggattattcttgtatctaacatacactaatccttcagatctgtgctccaatatcccttctacagagaagatgccccaatcaatcaaggctaaatcaagcgtcactgtttactcatatatcttttgtcacaaaacaatttagaactattattttacctatatttgcatacttgttatctgtttaattattttttctactcctgttagtccacatacaccttgatggcaggagtagcgggagaccatgtactccttaacttaagggatgagaaagaagtcaaaaagcacaagagaaggacaatgaattcaaaagagaggaaagaaaatctgcaaaggtgtaaaagaatactatgttattctatgt

SEQ ID NO: 619186 - DNA, 288 bp, Homo sapiens
agccaggcatggatgggctttggtcctcgaggttggacccagcttcttgccaccttccctccgggcagtcagctctccatccatcccctctttaatctatgaatctatagctcggtgtgtgtacaaacacccctatcgttgtctcaaatactcagcattacattggtgaggcaaatcagagcttctcaatcagattacatctcatttcataacgggaacatcccgagcactagtctgtcttgtactgaggtagtctgaccaggtgtacagcgctttactccaccttgg

SEQ ID NO: 619187 - DNA, 207 bp, Homo sapiens
gagtccttgtgcacaaactgtacacctgattctgacaaatgtgtattagtccgttttcatgctgctaataaagacatacctgagactgggtaacttataaagaaaagaggtttaattaattcacagttcagcatggctggggaggcctaaggaatcttagagtcatgatggacttactgttcaccttgtcattaaaacacagaaaga

SEQ ID NO: 619188 - DNA, 791 bp, Homo sapiens
gaaacatggtggtgtcgggtatgaggctgggactaagccaagggatgcaggtgtggtgccggtgggaactgaggaagcgcccaagctttttgttctgaactcccacttgcgttgtggatgtcctgaggatgggatgactgtatctggattacccggagctctggcatataccacgtgctccctaaattatgagcgaatgtggacctaaagtgctacaaggtttcaagatggcagcgatctatgcatggtcagcccagtccgttctctagaagatgcaaaattcagaagaccaagtggtcatgagagaatcatagaagcacaaattttgtgacctatctttagaagacagacaatgcacccgcacaatataactatcagatggcgacattgtggcaaccaagcagctggttctctcgtggaagtattcgtcaaaacttcctgtacagaccgctgcttcaacgggtcaacacatgatgctcttgcacacgaccactagtgacactcaattgtggctaacagctttccacttgttcgtcctaccaggttggttcacgtgacaaaggccttttcttgttgaacttctgagtgctctcgggtattccacgaatgaatataacgcaacggacagaccgtgtggtctctcatgacaggctcaaacctggatgtggcatagcttggtgggagttggcctatccccagttccttcgggcgctcctcactaccaaattgggccgcctgggcacccaaagtatccatccgggtcccactgggcacaaaacggaaggggtaac

SEQ ID NO: 619189 - DNA, 776 bp, Homo sapiens
gcccatctgacggcgttctgtttgcagatacctgtcagcttctagatgctccccaggttcatcctgtgtcgtctcccccacctaccagacatctgcttgtgagccctgggcttaggattcgccatggcaagctgaagagtacatcatccgcatccccccagtaccactatatccatgtgctgggaccagaacagtcaacgtgtcccgtgtgcggcaggtcgggccaagagacctacatccgagcaggacaatgagaggtgtactgtattgcccgccatgcgcactggtgagccgattcgccccacgtctagctactgtcgcagtggtcaaccctgtgtctcgggatgcccatggcctctggtgctgtatgatgtcacagggtcaagttcgtgcttacgaccatcgctgtaacctcgtagatccggtctggcccaggtaccccttccccctgtaatcccagggggagtggtgctggaaaacggacatcaacatcccctggcaggtggttctgtccaaccatctgcctccatctaaaggcgctgtcttgattttcgcgggctaatagactgcgcgacaaggtgtttggcccggcagcatgcagtcgggtttctcgtagggacctcggccgtacatcccccgggaggcgatcctcgggggtcgtggtgcgatcatacggggtcacccatcttcaggcccgaagcccggtctgtcggctctagggacccgcagcagtgtggtgacccgggacttttgcgcagcgtgtgccttgggcgatg

SEQ ID NO: 619190 - DNA, 306 bp, Homo sapiens
  misc_feature (23)..(23): n is a, c, g, or t
  misc_feature (75)..(75): n is a, c, g, or t
  misc_feature (77)..(77): n is a, c, g, or t
  misc_feature (121)..(121): n is a, c, g, or t
  misc_feature (125)..(125): n is a, c, g, or t
  misc_feature (139)..(139): n is a, c, g, or t
  misc_feature (180)..(180): n is a, c, g, or t
  misc_feature (212)..(212): n is a, c, g, or t
  misc_feature (243)..(243): n is a, c, g, or t
  misc_feature (291)..(291): n is a, c, g, or t
ccgcgtggggcgcaccgtccganccgcccctcccggtgtgcagcgccccgcaccgccccgcctcgcctgggagangncgccgggacgcgccgggctggagtgggcggttattggctttganctangccgtttccgggangcggactcagaccccatttcctttttccacatccaggtcangtggcgtttgctgtggcggctaggcccgcgtncgctggaaaccttccgcgcttggcccccgcnagcctccttccctggcccggcgcttgcggttcttcccggcggcacatnggttgcccccggggc

SEQ ID NO: 619191 - DNA, 207 bp, Homo sapiens
  misc_feature (106)..(106): n is a, c, g, or t
gaagctggaagcgcagacttgtgatattccagttccccctgcagtggtttggagtccctgccattctgaaaggctggttagaatctcaactgacatcatagcattngggcacacctccacgcagaccgcccgaacttcaaactcctggacacggactggacacgacacgccgggacgacactacttgtgggactgacgaccacccac

SEQ ID NO: 619192 - DNA, 219 bp, Homo sapiens
acgtaacgccttcgtggtacaaggctggctgcaggaacttcacttcgccccggacaccttgctttcaatcaacccgtctacaggtaccttgtccgccaaggtcgagggcaaaactaaaaccttccatctctcggattcatcaggctggggacaaatttcaggaccattgctggacgccgcgaaagttatcgcccctggaaataacggtgatttacgtgt

SEQ ID NO: 619193 - DNA, 894 bp, Homo sapiens
gggaggctggatgccgagcggaggaggcaggaaccggagcgcgagcagtagcgtagggtgggcacactatgggtggggatcaccaacgattcgaggcggtgaatcgcaagatccaggttctgcagacggtcgaggcgagatgatgcgaagagtgagctgaggcgtgtagcgccttcctagccgtaataatgcttagatggcgagcacagaggctgggccctggaacaccaaggcatgaggcgtgaggtggcgctccattttaaccagtaggagtccagactggtgcgaagaacgagcgtggagactgatgctcatggagctgacttggaacgaactgccgcgtgtcaaacaggtctggtagaggtaacgtcgtgagaaacatgcatgacgtagaatgagcacgttggacgaagaggggtaatgacgggattgatggatgaattggggggacataatagtgagactcgaatgatctaggatggaaggtcacatcggagaaatccatacgtcatagagatagcgtgagaagcaacgaattaggatgaaagagggcaggacttagggaatgtattggaagaagggtgggtcggtcaaaagtcgggatcgaaatccagtgttcgacacgggcacgacctcaagcgagcatgaacagccaacgacgggaagcgagacgcgtcgacgccttgggcgcacatcagtgccaccggccatggacacggtaaggaacggacctggtcacgtgtaaacctgcggacattcacggaaccttggcactcgggaacccccgaaaccgcgtggcaccaacgggtcaccgggaaagcatgggaggcacaggaaggcacagagcggataacggcctcgcaaagtcaaggcaaagcagctcaatacgttctg

SEQ ID NO: 619194 - DNA, 173 bp, Homo sapiens
gtgagcctcagctgctaagtgatgtcagctgtcctccttttcttgaaagtcgagcgagtctcagtctgacatccacactcgaaacctttccccgtcagcaaagcatcacaatcagaacgtctgtctgctctgcgatctctggatggagttgatactcacaacgaaggagaggg

SEQ ID NO: 619195 - DNA, 701 bp, Homo sapiens
taccgcggttgtccacacggtgtgttggaatcgttgcatgtcccgtcggctcgtgcggtgtttcccgccctcggttgttcccgcgcgttgtttgaatctgggcgcttttttcgtgtacgcgccagatgaaattcgcgggaagacgctcacttgcgacgtgggtatgtttcaataacaggccgccccggtcgtggcaccagtggtggtgccaccaatgtgtgtcgtcgcccaaactctccgagagaagactgccgtttgcgctaagacgcctcaaggagaagagggcttggaggcaaaagggcgcccgaagggttagtttgacgaacccgcgccatgcgggaaataagttcgccgcttcttactagagatggggtggttctcatcggtgcagatgctaacaagaagcttcttcctctgttgctctccactagtttcgcgcaaagcataaagttcactgcagagttcgatggagaaatagatcacttctgtccccagaaatgtttactcgcccgtgagtttgcgttgccatccttgtggatagcagccccacaaatagagatatggcggaaactatcttagtggagaacgcagtactattatgctgcgcgtcattactaatatggagatgcttgcccccactaaaaagatgataggtaaacaaaaaggagatggagagtaacagcccaacaatagcaagagaa

SEQ ID NO: 619196 - DNA, 493 bp, Homo sapiens
  misc_feature (458)..(458): n is a, c, g, or t
tcaagtgatcctcctcccacctcgccctcacaaagtgcggggattacaaggtgtgagccacggcagcagtcctagtagtctttcaatactaaaaggacacatagaccagcatagggggggaggcaggaagtatggcagggtgagtagaagcacagcacagcctcgggagccacagggtcggggttcgaatccggtcggctatggtatgagtcacagtcggggcaggaaatagatgactcaggggtcatggaagacttggaggaagtacctagttatagaagtattaagaaaagcaacaaggaatgatgaggcaaccggggtgcccaaaaagtgaacgtggttatcactaggaccaaaggcacgaggagagggaggtgtaacggagacccagggagagcagtaccggtgggaaaggggctacggaacaggagcggtggctatgggtagagaaatgcagncactattggattacgctgttgcactgagcaggtag

SEQ ID NO: 619197 - DNA, 1020 bp, Homo sapiens
  misc_feature (291)..(291): n is a, c, g, or t
  misc_feature (346)..(346): n is a, c, g, or t
  misc_feature (357)..(357): n is a, c, g, or t
  misc_feature (364)..(364): n is a, c, g, or t
  misc_feature (372)..(373): n is a, c, g, or t
  misc_feature (385)..(385): n is a, c, g, or t
  misc_feature (400)..(400): n is a, c, g, or t
  misc_feature (408)..(408): n is a, c, g, or t
  misc_feature (419)..(419): n is a, c, g, or t
  misc_feature (431)..(431): n is a, c, g, or t
  misc_feature (444)..(444): n is a, c, g, or t
  misc_feature (465)..(465): n is a, c, g, or t
  misc_feature (475)..(475): n is a, c, g, or t
  misc_feature (492)..(492): n is a, c, g, or t
  misc_feature (507)..(507): n is a, c, g, or t
  misc_feature (512)..(512): n is a, c, g, or t
  misc_feature (732)..(732): n is a, c, g, or t
ggcttgagcccttatttcagaatctcaagatctctaggatttctgggcctctcccattactgaaaaggaaccctggttttatatccacacttttttttcctcagagttagattcaattttaattatcacatgaaaaagctgatgtgagcgagaaatttttatacatatgtgtgtgtgtgtgtgtatatatatatatatatatatatcatctaataaagagggagtgccagtgatgctgaagaaaaagaatacaggaagcagaggagatataacaatccaaaagaagagtanctatgatttcagaaatagtcaagataagtggactaaagcagcttgggtcaaatanagttcatctanagaaaantgtgcagnnggaggtacattntatgtgtcttataanggtgaatntgaataatacntgatcatatttncatctccatactntgaaactagttactctgaaanggatcttgcntgattagtaagcaaacntgtgtgaggctaaanagcanatatctagaactttaggaagcttactcatgaaatgtaatttcccttagtagactggcatattttactactaaaaggcgtgtgatacagactaacagctaaatagcagcaaacacatttcttatcatctcgtggaagccagatatcccagccccgttttccttcttcccattgtctgctgaaactaacttaatactttttcttctttccagctttctattntgtctcctgacatttctcttctgaaaaaaataaccaatataaatttagatatcacaaccatttctatttcccctcttgcttctcacataaaaaatctcgagactttttcacttcatgaaatagttttgataatttaatgcgaaaaaacttgggcaaaggtaatgtgtatattttcagaaatttttcacttgatggaatagttgctttccttcaatcttcttcaaagtgtttgaagtctttatgctgtgcattgggtctgaacggaggtctaacaattgctattaggta

SEQ ID NO: 619198 - DNA, 359 bp, Homo sapiens
gtcgtacacgactctgctcaagtctcccaatcaggcattgccacgtcgtgtaccaattcttcacaaaatcatgtgtactcaaagtagcaccgttagtaagcactttcttttagtttgggagacggagtctccctctgtcgcccaggctggagtgtagtggcccgatctcagctcactgcagtctctgactcccaggcatccagtgatcctttcaccttggactcctgagtagctgggactacaggtgtctgacaccatacctggctcattctctgtattttttagtagaggcagtgttgcccaggcctgttctcgatctcctgaattcaagcagtctgtccgtcttggcctcccaaagg

SEQ ID NO: 619199 - DNA, 337 bp, Homo sapiens
cacacttgcatatgagtgagggtttcaaaagatacataaagccttaacttagaattgcattatgttttagaatcatcattgccttaataatcaagcatggaattaagtcatattaaaggagaaatgcatgtttatggattttttgtaagtataaatgcagtgatgtttggtttaaaaaatttgtttctgtgacaatgtctgtaaatataaccaatagagtcatttacagaagaaaaatgagcatgtaataatacaagaactgtttccccctcaaaacctgaacttgaattacctgtaaaaactgaaatttattggttaaagagaagccagtgttgta

SEQ ID NO: 619200 - DNA, 327 bp, Homo sapiens
gcttgatcatttctgcttgggtgtatttgggtcttctgatttgatctttataaatctaggcaccaggctatcaaacttgttgaatcttctgaagaatcaacttcaggttatgctgatcttttgtatggattttaatgcctcagttttgttcagttctgctctaattggtgtaatttctttttttctgctggcttagggatatgttttctcttgtgtttctggttcctctaggtgcaataattagagtcttaatttgagatctttctaacttcttgaggtaggtgtacagcactataaactttcctcttcatccttctttagattgtg

SEQ ID NO: 619201 - DNA, 1592 bp, Homo sapiens
  misc_feature (325)..(325): n is a, c, g, or t
  misc_feature (780)..(780): n is a, c, g, or t
cgatggtggttcgggcgaggcgcgtcggggtgatgagtgttgtttgtggtggcggattgttgccgctacgaagatacttgtcgggtgtgacggccgccctcctcgttttcgggcgtcagactacggctgtggtgggttggttgacctcgcccgctggtgttgggacatacgatggtgatagagtcgccgtctgtgataggtgctctcttcttcccccgtgccacatgaggagggcggggaggagagggggacgcccctgttttggagaggctggcgcccgatgtgtgtgcaacgatcctggctgcccataacacgtttatgtatnttgtctgtgggggaacaacacccctcatatttcgtatagtagagggggccgctggtaggcgaccccccgtgtcggccacagtggtgtgccgagagatcggtatgacatgtatataattggggtgggcgcgccccctagttgtgggtgaaagcaaacctcttatggggggcttctccctttttgtgtctgggtggtgttcgttgtgcccacccagacgagtgttgtccaccgacgaaaaggttgtcaaaatgaggggggcgcctcttgtgaaaggaggggtgttgtcgtacacgaacaagatgatttgctggggtcaagagtggtcaccgccaagacgaaagattttgggggcacccccatgcgctaatatagtgttataaggggccctcgtcagtaaaaatgtaagacccctgtgggtgtgaatttgcctcatcccccacgcttgtataagaagngcgccacccttatatgttttgggggcgccacgcccgtctgttgttgtgtttccatctgtggtatagagaaaatggagccctttgggagattgtaagaacatatattttgggttaagcccccctctgttaaaggtgtcgcggccacactagaagtgttttagcccctcacggaggaaatattttcccaccacagggggctttgtccaccccagcaacacccccacatagattgtgcgcccagctagacgttgtgatactcaaactctttttgggaaaagagcctcgacacttctctttctataccacacactctgtgtagacacactctctataataatagttgtaaaatttttctcttgagaagagagggtgtttctcgtggtaaacgctgtatattgtgatagtgtctccgcccctgttataataatagagtttctcttgtagtgtcttcttataccacgcgttgaaaagttatttcgccacaacaccctctctcggagaaagttaataaattaccactccactaatcacatcttatttgtttataaactctataaaagccctcatcggaaattttccttagagaaaggaaatatggaggacacttctcacgagccacagttggttttgtgtgtaataatgttttccaccacggaaaccaccctgttataatgaatattcacatgcctcacgcacctcgtcacctttttaaaacccgtcacaggagtccccctgtataaattggaaatgggccgttttggattttcaccttttaaaatggttaaatattaacttccgtccatctcccggga

SEQ ID NO: 619202 - DNA, 314 bp, Homo sapiens
cataatcagtatattattcactcctatgtgagtaattgaggagtatgctaagattttgcgtagctgggttcggtttaatccacctcaactgcctgctatgatggatcagattgcgagagtgaggcgacggcttacgtttagtgcagggcgcgcatttggtatctgcattgagcatgggggctagtttttgtcatgtgagcaagcaagcagccggcatgtcagaggggtgccttgggtaacctctgggactcagcagtgaacgggggctattcctagtctcattgctcatagccatctcatgattcattcactgc

SEQ ID NO: 619203 - DNA, 454 bp, Homo sapiens
aagagggaggcccgaaaacccaatttttatcccctgcccccttcccgggggaattatccaaaaaaacgggtcgccctcccctggttggtaaaaggttttttttcccaacaatttcccgtggggtggggagacaatgggggcccggggaaaaattcaaaaaccccccctcccgggttggattccggggggttttttttttttttaaaaaagttccccgtggcaaaaaaaaggggggcccgggggaagtttttttttttttccgttagggaagggggtttggccacccccaaaaagaaaaagaccttttcctttttcccgggtaaataagtgggggggcgggcaacccccccctccccgggttttttggtttggaaagggagttttgggggggccccctttttaattttttccgggcccccgggatggaaataaagcccccccccctcccttggga

SEQ ID NO: 619204 - DNA, 221 bp, Homo sapiens
tctagagatccccagcgggaaacaattcactatacaggatgacagaaattgtattgtatgcatgttgtgttaatatgtaaagttttgtttcatgagacagtcacgctctgatcacccacgctacagtgcaatagagcaatctcggctcactgcaaccccctcctcccgagtatacaagcattgttcctgcctcatcctcctcagtatctgggattacagat

SEQ ID NO: 619205 - DNA, 358 bp, Homo sapiens
  misc_feature (298)..(298): n is a, c, g, or t
  misc_feature (302)..(302): n is a, c, g, or t
cccatttgaaaattgtcatctggcttcgttgtaaaagatgttcaaccagaagagtgaagagaaagaaccaggcagcacattgccaaccctggccagagagatgtctgtttttcaactacaaaagtctatgcaaagttcctcagtgggggtgatattaatgttttggacaaagcaattaattctttatggaagagggagttgggagggagacatccatgagctgtgtgtcttcaagattagtgtctgggtccagaacactgagatggctggcacagatacagacaatatgtaatatggnaggnagaccttacgtatcttccagtgacagactatgtcaactaaaagatatatagctata

SEQ ID NO: 619206 - DNA, 103 bp, Homo sapiens
ccactcgtaatgggagaaggtgcagcagtggtgccaaacgggaccatgcctcctggaggagcagagcaagcagcagtcaacgagcactgggcgcattcgccag

SEQ ID NO: 619207 - DNA, 451 bp, Homo sapiens
aaagtcgtgtggagtaatgatctccccataggaggttttggtgtgtcctagctatatcaaaaagtatatagtccctcattgaattgccgctcagccatgtcctctccagcaatgcctatagtcagtagagcaatctggtgtacacagccatccctgtgttagaggatcaaaaacgtgtatgtcattgtagtctacaagcctgaaccatcctcaagccagagtaatagcacaaggtcctatttgtttttctatcaagcattaaacttttcttatatgcactcttgctcagttgcacctcccctgtgtgtggcataaaactatgcttgtcagcctttttatatcagctttttggaagcatacatgttttcaatgttctgtgggaaagcctctgtattttttcccctctttggccatctttttctgaaaataaagtgatgaatcctctaaaaaa

SEQ ID NO: 619208 - DNA, 653 bp, Homo sapiens
  misc_feature (5)..(5): n is a, c, g, or t
  misc_feature (23)..(23): n is a, c, g, or t
  misc_feature (61)..(61): n is a, c, g, or t
  misc_feature (83)..(83): n is a, c, g, or t
  misc_feature (97)..(97): n is a, c, g, or t
  misc_feature (110)..(110): n is a, c, g, or t
  misc_feature (124)..(124): n is a, c, g, or t
aaaanagcatgaacccaaggtgncccccggggaagtccccctaataaaactggtttgtacnagtcatggtgttggggtgatcnagaatggaagcccntttcaaatagacncttagtattttggncttaattcgcaatgcattgattcagccccagaattatttgccagaaatagactttcttcccctggtgttgggagccaggagggttggaaaagctcaggaacccctgagctggttcatctgtttgcatattgggtaggttaatttccctggagcctgagagtctttggccagatttcagctgcgtctgcctggctcttttgctgcagctgtgagattggggtctggttccagcagtctgtcactggtcagcctgagtatcacaccctgagctctggggctgggagtttcttcccacaccctctcccttgtgccttaagttgcgatggctctgagtatacaattaatcggaggtgaggggtgggtgtcacagctaatcccaaattcaaaaattagtccaaggtgctgcaaaatataaatttgatgtcagtagaaagtcgtatcctaaaatgtaaaaactgtaagtgtacagtagttaatgagctcagaacatctgataactgcaatttaaaatgggcaaaaagttaaaaaa

SEQ ID NO: 619209 - DNA, 854 bp, Homo sapiens
  misc_feature (216)..(216): n is a, c, g, or t
  misc_feature (569)..(569): n is a, c, g, or t
  misc_feature (714)..(714): n is a, c, g, or t
  misc_feature (723)..(723): n is a, c, g, or t
cacagagagattcatattaatgagtacgccacactggatgggggcgagcggtgggaggacaaaaaaaaaaccccatcccaactataccctcaccaaaaaccagaaaaaaaatcagaaaaaatggattatgaaagtatggggtgacaaatccagtgaaagccctaaataaatgtaaaatgcctaatgcagtggttcccaaacctgtctgcacattgntaacccctggggacctccaaaaatatcgatgtctattcccaattccatgtatttccatctacactggagagacccaacgtcaggatattgaaaagcttccccggatgatgtttttttgttgttgttgttgttgttttaatagatggagtctcgctctgtctccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactactttgatctcttggncatatgacagactaatcattagtgtcgcatttattcttccagtggtcagatggggtgctcacatgctgcaggttccttacatgtgcttgtttccttccctaaactgaaggtgcctttgaaggcagtctttttctacatccatcangttctctgnggaagagcacttcttagctattccatcaacactcttgccagtctaatctcaccatcagtttcccgtggcctgccctttgtctgaaactttgaaggtcttatcgaatgttacttagcctccaacagtattcg

SEQ ID NO: 619210 - DNA, 200 bp, Homo sapiens
gaggtaggacagaaaggccaccacagctcagaaagtgcgacgaatgacagaggctaaatgagaatgaacgaaaagaaaagagtgacctattaatgaatttcgagcttaattgcatgtgcacgagctagagctccgaactaacgtagctgctactaaggtcaaggttaaggtcaagggcctgagacttagttaggagagag

SEQ ID NO: 619211 - DNA, 151 bp, Homo sapiens
agacgtcattcttgcatagagaacttttctaaagtgagactgacacgggtggctgtgcccttgctatcaaggggggcccggctggggacgtcagcctttccatgagcaagtgggcttttccacatactcatgcaatttcccccagcagctg

SEQ ID NO: 619212 - DNA, 1806 bp, Homo sapiens
  misc_feature (981)..(981): n is a, c, g, or t
  misc_feature (1625)..(1625): n is a, c, g, or t
gtcgggcggggtcgtttcttttatgttgtgtggggggggtgctcccctccgtctcgtctcctcctcgggtcagcgagtagatagtattttgtgtggcgccgtgccctgtcatttgcttgtgtttggttgggcgtgtgcgcgcgccccgccccctactcctggttgtggtggtccccccgcctccttcctttttgtgtgtacgcccccccccatcgtctggctgtgtgtgtcatctatcattgtataggataatatgttgttttggtccgtcgctgcctctcatcttacagatgttgcaggagtgtgggtgggcgcgcttccccatactcgtgtttcttggtgtagatggttgccttgtctcttgcgtaggggtcttgttgttgttttttcggtgttgggcgactcggaatcccccaccccgcagagatgtttgtgtgggcgggccgcccccgccacgccgaatttagtgactccgcacgcctgggtgtgggtggggtcgagccctctgttcgttgttgttgtttttttggttggcccgcccccacacaccggtggtgcgccccctctcccttttatacaagtgaagtaggggggtgttctccaacgccagttgttttgtgtccgctcaccattttcgctcctcgttggttgttaatagagtgtacctctcccccccccgctcccttgtttgccggtgaaatggtgtttgtttccccctcccttccccggggatggtatagcatccctctcgtttttgggtcggtggtgaggtcgtccccacccctgggtgccaacgtcgctccaaccattttcctccggctttgtctcgttaaaggacgtgttgttaatgaccagcctgttgtgcctcgctccccttgtgttgattcccggcccgggtgggcgtcccccccccacccaaggtgtgtcgctacccaccatacatgcttccctcctaccggccgggaagtggtcagttaaccntccttgccttctttggaccggagaaacacaccccttcgtcggggggcggctttgtctaaagaagaataattctgcgggttgtgaaaatgaacccccggcggcggtttaaacacccatctgtgatatggcgttgtgctgttggagccacaccattcggtaagtaacagggggagaagccatccttcgttggtgcaaccaacattcaatattcggcggtgggagtagcacccacaccttcttgggcgccctcgttttcgaaaatatgcgcctccgccccaccagaatcatcttctaatcatatatagagcccaccgcccaccagtctcgtatagtagactccgcgccaccagctgttttcttgcgctatatctctcgcgcagcatattttgagatgagacatcatccgctggtctccaacaggcgcccctcagaataagaataaggcgcgataggagccacgaggcccgcgcacataggccgggcgctctcctcgatatgctctggccacacggagatgtgaagttgcttaaggcacaaggcttagctttcacaaggccccacggacccagccagagtcttccccatgtttcctgagacccgaagatgcccagagacaccacctggtggcacagtcttgtgtctcnagaaagaggataccagagattggggggccagccccccagatcccctttcttgttccccagactccagattttccccaaagaccctgacatgctgaattcttctctattgtaaggtttcccagttagatttgccttccgatgattaaatctaagtccatttgaaacaaaaagaaaaaaaaaa

SEQ ID NO: 619213 - DNA, 511 bp, Homo sapiens
  misc_feature (226)..(226): n is a, c, g, or t
  misc_feature (371)..(371): n is a, c, g, or t
  misc_feature (380)..(380): n is a, c, g, or t
tacaagagaagagacgagatggcgccattgcgctccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactactttgatctcttggncatatgacagactaatcattagtgtcgcatttattcttccagtggtcagatggggtgctcacatgctgcaggttccttacatgtgcttgtttccttccctaaactgaaggtgcctttgaaggcagtctttttctacatccatcangttctctgnggaagagcacttcttagctattccatcaacactcttgccagtctaatctcaccatcagtttcccgtggcctgccctttgtctgaaactttgaaggtcttatcgaatgttacttagcctccaacagtattcg

SEQ ID NO: 619214 - DNA, 1109 bp, Homo sapiens
tcccttctcattttataaacctcaaagtggatgatggtggggctgtatgtgtgggcactggtgcctatgcagtcacattcacaatacagcccacatcatcccttgcatgataaacccaagtggatcattcagatagataacccccataaatgtgcacgtaccagagtctacatcaatatacgaaacagggagacagtagccgccaaggagatgaccaagatgcagggagaaccaacacagaccccacccgtaccaccagtcgacactactgccaccccacagcgcagaacacaacacaacacaccatacaaccaagaggcactgggacaacaatcagatcccatcagagacggcactaccgatcgaaaccgcaacggaccacgaacggaccggtccacgactgcgacgcctcacacgagccgaccgagacggtaccgcggcaagaagacccacccacgagcagcccacaaactagccacaaaataactacagtacagacgctatcgcagaccctgcaccacaacaagctagcaaaagaaccacgacacgcaacatagagcccaccaccacggcaccctactctaacacgctcaacgcgcctacgccagcgcacagatacacgacgaacaggagccaaaaatcgacaaggactgagacagcagccaccatcctaaagcgcacacaatgcgacaatacacaccaccaccacctcgcatatagctgcccaaaaccgaccctgcgcaagcccacccatgcaccccaccgcacccaacctgacccacacccgcactccgctccaccacagcgcgcccgaacagactgcgagccacgccaggcccagcacagcgacacgacgacgatgcgacagccggtccgacgcaggccgccctatgctggcacgagcgcagtagaagagactacagcacaaacgacgcgcgacacgcagccacccccgcgcggaggacacggcaccgacgcagcgaccgcgcgcacaccgcggagacatacagcaatgacagccgatgacgaagcagcgtgtcccgtccccgccaatccccaccagcgcgacagcgacgcacacgccagcaacagacacgccagacccaacc

SEQ ID NO: 619215 - DNA, 483 bp, Homo sapiens
tacaagagaagagacgagatggcgccattgcgctccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactatcacaccctgagctctggggctgggagtttcttcccacaccctctcccttgtgccttaagttgcgatggctctgagtatacaattaatcggaggtgaggggtgggtgtcacagctaatcccaaattcaaaaattagtccaaggtgctgcaaaatataaatttgatgtcagtagaaagtcgtatcctaaaatgtaaaaactgtaagtgtacagtagttaatgagctcagaacatctgataactgcaatttaaaatgggcaaaaagttaaaaaa

SEQ ID NO: 619216 - DNA, 295 bp, Homo sapiens
cagtgaagcatataggatcctgcatgttaatgggtttaatggagagggcggcgaatgaggacccgcaggctgcaaggagcaacagcgatggtgagtaaggcaccaacagtgcaggacatcaaaaacaacctgaaagaggcgattgaaaccattgtgggcgccatgagcatactggtgcccgccgatggagctggccaatcgcgtagaaacagttcagagtggactacattctgagtgcgatgaacgtgcctgaatttgacttccctcccgaattctatgagcatgccaagggtct

SEQ ID NO: 619217 - DNA, 293 bp, Homo sapiens
ttgtttcgctgatggcgtccacgcttgtttgcgcagacacggagtgccacggcgctaatctcgagctcactgtaacctccgcctcccgagttcaagcgattctccagcgctcagcctcccgaatagcggggactacaggcgcccgccatcatgcctagctaatttttgcatttttagtagagatggggtttcaccgagttagccaggatggtctcaatctcctaacctcatgatctgcccgcctggggctcccaaggtgctgggattcaaggcatgagcaccgtggccggccg

SEQ ID NO: 619218 - DNA, 249 bp, Homo sapiens
  misc_feature (126)..(126): n is a, c, g, or t
  misc_feature (136)..(136): n is a, c, g, or t
  misc_feature (143)..(143): n is a, c, g, or t
  misc_feature (160)..(160): n is a, c, g, or t
gtcacatgacatctgcccagtttccacaacgatgtggctcctgccacacccacagggcagcctcctccaaaggcctcctggaggggcctacccagaagcctccttgacaccacgtctgcaaccctngctctatgcntgacccnttgtcactgaaaccctngatctacgacttactatgaactaaactgacaattaacatggccaacggggccgctaaaaagccaaacttttaaacaaaaagaaaagaaa

SEQ ID NO: 619219 - DNA, 275 bp, Homo sapiens
gcctccagaggataaaactatgatcactgagcccgtaatatggtcatggcctattcctagagttataagaagttgccaggaagccgtaaataagtgaggcagcagtgccaggaggttaaatgaggcactaaaaatgattaaggatactagtataagagatcagggtcgtcctttagggttgtgtatggctatcatttgttttgaggttagtttgattagccattgttgggtcgggattacgtcggatgttgatgagatagttttaaatggcgaat

SEQ ID NO: 619220 - DNA, 276 bp, Homo sapiens
  misc_feature (212)..(212): n is a, c, g, or t
actgcaacctccgccttctaggttcaagcgattctccgtgcctcagcctcccgagtagttgggattatgggcacgatagctgggactacaggcacctgccaccacacccggctaatttttggtgattctaatggaaggtggctttagggtgataactgatggccttttaatcatttaggtttttaatttcttaaattatttcattggagcantttgctttaatttgtttatttttggaatacttgtgaacttagtttacggggtgtgatggatcat

SEQ ID NO: 619221 - DNA, 198 bp, Homo sapiens
tctcaaggacccccagcatcgcaatcacaggggcgctggttacagtgcaggtcctgaggcccccaggaaatctgcattttaaacaggctttccagctgcttctcacacacattaaacgttagaggacaacacggcccgagctcagtggctcacacctataatcccagcactgtgggaggccaaggaaggcagatcact

SEQ ID NO: 619222 - DNA, 302 bp, Homo sapiens
tatagacaacatcgcatctcaaatataacatgtacataaaatagaacatacactgatatctgatcatccctcacaaatatacacacctaatcctcccattcctatctcccaccctcatctcagtgacacgtctacccatccagtagcttcagccagaaacctgggagacatactagacactttcctcttcctcaacccccacactcaatctataataaaatgaattctttctttaacatacttctcaaatccatccacttctctccatctcttctgccactaagtcccacctgcagagatac

SEQ ID NO: 619223 - DNA, 167 bp, Homo sapiens
attaccgtttattccactgtaccatggacagaattccgacctactcttttgagatttggctccggtaagtcctgaggaagggcataaagtgaatgtcctatttgggacttactggagcaaatctcaaaaacattcggatttctctcctcggtacaatgaatttacct

SEQ ID NO: 619224 - DNA, 1255 bp, Homo sapiens
  misc_feature (26)..(26): n is a, c, g, or t
  misc_feature (144)..(144): n is a, c, g, or t
  misc_feature (270)..(271): n is a, c, g, or t
  misc_feature (273)..(273): n is a, c, g, or t
  misc_feature (276)..(276): n is a, c, g, or t
  misc_feature (279)..(282): n is a, c, g, or t
  misc_feature (285)..(285): n is a, c, g, or t
  misc_feature (291)..(293): n is a, c, g, or t
  misc_feature (567)..(567): n is a, c, g, or t
  misc_feature (588)..(588): n is a, c, g, or t
  misc_feature (597)..(597): n is a, c, g, or t
  misc_feature (620)..(621): n is a, c, g, or t
  misc_feature (642)..(642): n is a, c, g, or t
  misc_feature (650)..(650): n is a, c, g, or t
  misc_feature (654)..(654): n is a, c, g, or t
  misc_feature (661)..(661): n is a, c, g, or t
  misc_feature (663)..(663): n is a, c, g, or t
  misc_feature (676)..(676): n is a, c, g, or t
  misc_feature (679)..(679): n is a, c, g, or t
  misc_feature (691)..(691): n is a, c, g, or t
  misc_feature (693)..(693): n is a, c, g, or t
  misc_feature (703)..(703): n is a, c, g, or t
  misc_feature (727)..(727): n is a, c, g, or t
  misc_feature (736)..(736): n is a, c, g, or t
  misc_feature (746)..(746): n is a, c, g, or t
  misc_feature (755)..(755): n is a, c, g, or t
  misc_feature (773)..(773): n is a, c, g, or t
  misc_feature (783)..(784): n is a, c, g, or t
  misc_feature (789)..(789): n is a, c, g, or t
  misc_feature (796)..(796): n is a, c, g, or t
  misc_feature (804)..(804): n is a, c, g, or t
  misc_feature (811)..(811): n is a, c, g, or t
  misc_feature (837)..(837): n is a, c, g, or t
  misc_feature (848)..(848): n is a, c, g, or t
  misc_feature (855)..(856): n is a, c, g, or t
  misc_feature (879)..(879): n is a, c, g, or t
  misc_feature (903)..(903): n is a, c, g, or t
  misc_feature (924)..(924): n is a, c, g, or t
  misc_feature (929)..(930): n is a, c, g, or t
  misc_feature (935)..(937): n is a, c, g, or t
  misc_feature (950)..(950): n is a, c, g, or t
  misc_feature (956)..(956): n is a, c, g, or t
  misc_feature (1010)..(1010): n is a, c, g, or t
  misc_feature (1037)..(1037): n is a, c, g, or t
  misc_feature (1039)..(1039): n is a, c, g, or t
  misc_feature (1041)..(1041): n is a, c, g, or t
  misc_feature (1046)..(1046): n is a, c, g, or t
  misc_feature (1054)..(1054): n is a, c, g, or t
  misc_feature (1107)..(1107): n is a, c, g, or t
  misc_feature (1129)..(1129): n is a, c, g, or t
  misc_feature (1135)..(1135): n is a, c, g, or t
  misc_feature (1137)..(1137): n is a, c, g, or t
  misc_feature (1152)..(1152): n is a, c, g, or t
  misc_feature (1155)..(1155): n is a, c, g, or t
  misc_feature (1173)..(1173): n is a, c, g, or t
  misc_feature (1180)..(1180): n is a, c, g, or t
  misc_feature (1188)..(1188): n is a, c, g, or t
  misc_feature (1250)..(1250): n is a, c, g, or t
gttctgtggttgagctgcctggccanggcggactgggaaataaggtcttgtggatgagctcgaggcttaaaagtgacagtggggctttgtaaagaagaagatggacaatgagcgaccgtgtaggtcccccttcctataatgagnaccttttcacagacctgtactgagctccgtgagagtaaataactcggaggagatgggccctgcaagcctcttgcttagccgtctgtgcagaaaatagcattttcgaaatgccctgagttgacctanngnctnatnnnnctnctgctnnnggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaanaacctgcttggctcaaagggncagcacctnctctctaaagcccaagaggagtnngaggaaaactaggtgtctgtnttcactcnaggntgaagtnanaggtctgagcaanaanggtgtataaaananggaatctgtnttggaggacatcagaaggtgaatnttccaagtncttggacaanctagctgtngaaaagctttctgggttnggggggtatnncagangtacctnaaagtgtnagcaganacagattaagacactgggagccaatnaaacagcagtngagggtnngctgtgtatcacatttctgtatnttatcacccccttcctgcaacatnatttatctggaatctacctgnccttnngtttnnnagatacaagggcntggttntgttacccaggctggtttcaaggcataactttaagagatcctctcaccacaaanttccaaagtgctgggattgcaggtgtnantnatggnacccagantttgctgcctttcttacatgatccaggcccagaacccaaactcaggcactgtntagatgaacactttcgtaaacnactgancnagcttgttgccaatngtngattgaacttcccataantccactncgtgtctnttcctctgtttacagccaccttctgttcccgttatgagcctttaggtctccatttgcatatngcaaa

SEQ ID NO: 619225 - DNA, 329 bp, Homo sapiens
tttcaatggacctgactgcaatgttatcataactctgtaagacccccacaaatgcaggagcctgctcagcaagtaaagtggcactacatgagtgcaaccacaacactccaatccttttggcagtcaaggaaacccacaaaggagcaacatttgaatgtagcccttgaaagtaatgtgtcatgtgttcagctttctgaatcatttgtaatctcacaatgctgcactttttatcacagaagccgctcaacagtgggctgatagtcaaggtattgattaaccctccacactcattaccatcaacaggcatctgatattgaccaaaaatcact

SEQ ID NO: 619226 - DNA, 216 bp, Homo sapiens
ccgctgtccaagagaccctcacgcttcgtaaaacactgtctcctactgtctttctccccacatgccacctacagcgttcaaataaaggtttgtatactccgtaatgatccgctaacgttcttcatcatggtcaaagtcttctgcttgagccacacagccggcaaccccgtcaggcattgacgtttgccgcacatggttggtactacgtaggagtct

SEQ ID NO: 619227 - DNA, 212 bp, Homo sapiens
ctaagagggaggaaaatgaaaggctatgtactaattcacatatattgacaaaagaaaaaagggtgagtccataaacgctctgacccttgttgtagatgtgaagcgttccacttccagaacttgtgcttttattggacagccggagagatacgtctgtatattaggctccttaaatccttgagtgttataaatagcagagaaagggatataca

SEQ ID NO: 619228 - DNA, 771 bp, Homo sapiens
  misc_feature (707)..(707): n is a, c, g, or t
  misc_feature (713)..(713): n is a, c, g, or t
ggacggggttgcatcacttcctctcaagcttgggttggttggtggggttacacgcgggttcaacatgcgtatcgaaaagtgttatttctgttcggggcccatctatcctggacacggcatgatgttcgtccgcaacgattgcaaggtgttcagatttggcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccattttcttttatgtacattttgaaaatgccctttggatacttggaactgctaaattatttaatttttacataaggtccttaaattgaaaagcgattaaaagacatctttcctgcattgccatctacataatatcganttacgntgtaaatgcattccgggtaattctactgaagattctcagaatcaagaattcactgaaa

SEQ ID NO: 619229 - DNA, 802 bp, Homo sapiens
ggacggggttgcatcacttcctctcaagcttgggttggttggtggggttacacgcgggttcaacatgcgtatcgaaaagtgttatttctgttcggggcccatctatcctggacacggcatgatgttcgtccgcaacgattgcaaggtgttcagatttggcaaatctaaatgtcataaaaactttaaaaagaagcgcaatcctctgtccctgttagggtggaaccgacagcattccgggaaacgcagctggtaatagagcttacacgtggatgattctatttgaattcgagcaacgtagaaatgaagcctatcatacataccatgcagagagcatatggagataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccattttcttttatgtacattttgaaaatgccctttggatacttggaactgctaaattatttaatttttacataaggtccttaaattgaaaagcgattaaaagacatctttcctgcattgccatctacataatatcagatatcgacggatgttagatggcctctcagtgttaaatcttgatgatagatgtacttaagtaatccatgagaatcctatg

SEQ ID NO: 619230 - DNA, 164 bp, Homo sapiens
cccacaggtaaaacccgccaaaccaaccactacctaataacaactgagagagacacccctctatctacaaaatagtggaaaagttataggaagacgacaaacctacctagcctgtaatagcttgtgtgcaagatatgatcttaggtcgactttaaagttgaccc

SEQ ID NO: 619231 - DNA, 166 bp, Homo sapiens
attacttctttcttctatattagtctggctagtggtctattttgttgatcttttcaaaaaaaccccaggttttcccttgggatttcatttgaattctttgaagggttgatgtgtctctatctcgatcagtctgtctatcttattattcttgtcttctgctagcttt

SEQ ID NO: 619232 - DNA, 804 bp, Homo sapiens
  misc_feature (740)..(740): n is a, c, g, or t
  misc_feature (746)..(746): n is a, c, g, or t
ggacggggttgcatcacttcctctcaagcttgggttggttggtggggttacacgcgggttcaacatgcgtatcgaaaagtgttatttctgttcggggcccatctatcctggacacggcatgatgttcgtccgcaacgattgcaaggtgttcagatttggcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaactacaagacttactttggattgcccgaacttcgcaccacgcaacggacgtttcgacacgacaattcagaaccaggaacgcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccattttcttttatgtacattttgaaaatgccctttggatacttggaactgctaaattatttaatttttacataaggtccttaaattgaaaagcgattaaaagacatctttcctgcattgccatctacataatatcganttacgntgtaaatgcattccgggtaattctactgaagattctcagaatcaagaattcactgaaa

SEQ ID NO: 619233 - DNA, 822 bp, Homo sapiens
  misc_feature (758)..(758): n is a, c, g, or t
  misc_feature (764)..(764): n is a, c, g, or t
ggacggggttgcatcacttcctctcaagcttgggttggttggtggggttacacgcgggttcaacatgcgtatcgaaaagtgttatttctgttcggggcccatctatcctggacacggcatgatgttcgtccgcaacgattgcaaggtgttcagatttggcaaatctaaatgtcataaaaactttaaaaagaagcgcaatccccttcggccaaaaaggttttacgggtgggacccaaaagcaattccgggaacagcagctgggtaaacgagcttacaggtggattaaattccaatttttggaaaaactttttgtggggaaaaaaaaaagccgttaggaaaaattgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccattttcttttatgtacattttgaaaatgccctttggatacttggaactgctaaattatttaatttttacataaggtccttaaattgaaaagcgattaaaagacatctttcctgcattgccatctacataatatcganttacgntgtaaatgcattccgggtaattctactgaagattctcagaatcaagaattcactgaaa

SEQ ID NO: 619234 - DNA, 241 bp, Homo sapiens
gtggtatctagacggatcccgaagagaccaggtgattgtctgtcagaccttgtcggcttctatcaaaacagcaccctgttgtcaccaggcctagagagtggctgtaggtggccgctgaaaagtgacttaagttgaagagcacatttctttcatctctcttgtccatacctgatagacacattcctctctgccaccttccttcaagaaggacctgccctctgcagactgggctaagcgtgag

SEQ ID NO: 619235 - DNA, 381 bp, Homo sapiens
  misc_feature (376)..(376): n is a, c, g, or t
aaaacccccccagaacaacgttaaaaccccccaggtcagaatttttaaaaccgcccaggacggaccaggcaaaaaccagaggggagagctcagtaggccgcctgagactgctgctggcggaagccaccgcgttgcatgtagccctcgtttttgcggtacccgtccttctggtctcggaggtagcccccgtaggggccttgcttgtggccaaacacccgttcgttgttctccaccaggctgcccagcttttcggccagctgcagagccaggttctgctgagcagtgggctcagtgcggcgcatcaccactgtctgtgttggctggtccagggaggccatcagctcctcattaatgatcattttgctgatgatggagngcaca

SEQ ID NO: 619236 - DNA, 1008 bp, Homo sapiens
acaagaacaatgaagcctgttggtaactgatctacaaatgtaatatcacgttatcatatgtaaatcatgatggcctgtaacagttgaagcatctaaaaatatatatttatttcaagtattttcacatatattgtacttgacattatctcatgttggcacttctaagttgtactttttggtatgttacctgtacttaggcttcaaattgaagcctgtagttatgtgtaaaatcagatgcttgcacggaggacggtaacacagcaaaggcttaacttctttcttctctaatgtcacctgatataaagtactttatgttcgaagtgaattattcttgatgtaggcttcagtatactgtgtttacacaggtctcacagtcagtaaatagccagtgttcacatatttcaaccaggattccggctcgaatcacgctcgaagcatcttatctcaaccagtgcagtcatccatactagcatcacataaactatgtacactaggacacgactatatcataatactctaaggccttagatcatagtacaaaagctgccctatggctacaaattcgtggtacacttagcgaagcagacgtattgggcatccagtaatcacaaggtacccgtggcgacaaaatccctggacgtaagaaacggaaaactacacacctaaccgacacccacccaaacaggaatagggactaccccggacagcactccacacgggccagccagaaaccacacacgcggcaacacaagcacacactttcaagcccccgaacgccacaacaacatgaggaaagaacacccacacacggcgaaacaccatagtgagcatccgaaagcggcgggccacgcaacgagtcagggcaagccgcacacccagaccgggaccggaaagccacccgcgcgaacgaggccacaaaacacagaaacccagggaaaaaaagcgaaggggagaaaatacagggtctacaaagaacccagaggaagccagaggagcgaaaccaaacgg

SEQ ID NO: 619237 - DNA, 381 bp, Homo sapiens
atgatattactgaacagaagagttttaagactgaaaaaagattacatgtttaagagtttggcatatgataggtgcttgataaatgtcagttctcaaaattatttttctggccaggctcagtggcttatacctgtaatcccagcattttgggagccgaggccggcagatcacttgagccaggaccaacctggccaacatagtgaaaccccatctctactaaaaatacaaaaaactagctgggtaggtggcacatgcctataattccagctactcgggaagctgaggcataagaattgcttgaacccaggagggcagaggctacagtgagccgagattgcgccactgcactccagcctgggtgacagatcaagactccttctc

SEQ ID NO: 619238 - DNA, 154 bp, Homo sapiens
ggcccggattgtgagctccccgtgtctggggcaggaagtgtctcagaggctccaatttatatccatctgggggtcacggcaagagccagaacctgctgtttcaggtgggtgatgtaaatatagtgtgtacataataaagcacatctattttaac

SEQ ID NO: 619239 - DNA, 265 bp, Homo sapiens
gcgacgtctcagttgccgaaaaagttcctcagtttagaagctgttcataaagaatgtgaatgtactaaacactatttcacacacacggaggcatctctagttctgagacagaagtaacacttacaacaatggaatgtgaagatggccgaataggaacagctctggtctacagctcccagtcacagaggcagacactgaaagtctcagatggaaatgccgaactcacccgtcttctgcgtcgctccaggtaccgaggctcgacttc

SEQ ID NO: 619240 - DNA, 201 bp, Homo sapiens
ggagctcggtcccggttagagcggtctcagagcacagcaacacattatcgagccacgtcagtacataagagtaaagtaagctgattagtgatatggggatgggaaggggaaactcatatcaccactctttcctccatcatgtcgtatttttttttttttttggttttttggtttttcgaagaaaaccgctttaacggggga

SEQ ID NO: 619241 - DNA, 234 bp, Homo sapiens
catgctgcatgttactcatcagtatccccagcgaaatttgccctgggggaatttcgttctggatatcgattaggatagagtgcttgcttggccatgttggtttccttgtgagggttcgatgcagttcagtatcctgagcagacgcggcgcctggggattggccgcaccgacaataacagagggaaaactgacaatggcgatcgtcgagctcggcgtgctgatctacagcggtgc

SEQ ID NO: 619242 - DNA, 132 bp, Homo sapiens
tttttttttgacagtccacatttttagggccccaagacatgcatttaggaaaggtacgtgttcatcaggacagctagcaccatggcacaagatcggaatggaataaggcagggaaagcagacacgtcctagt

SEQ ID NO: 619243 - DNA, 492 bp, Homo sapiens
  misc_feature (6)..(6): n is a, c, g, or t
  misc_feature (87)..(87): n is a, c, g, or t
  misc_feature (91)..(91): n is a, c, g, or t
  misc_feature (95)..(95): n is a, c, g, or t
  misc_feature (105)..(106): n is a, c, g, or t
  misc_feature (112)..(112): n is a, c, g, or t
  misc_feature (115)..(115): n is a, c, g, or t
  misc_feature (124)..(124): n is a, c, g, or t
  misc_feature (132)..(132): n is a, c, g, or t
  misc_feature (306)..(306): n is a, c, g, or t
  misc_feature (386)..(386): n is a, c, g, or t
  misc_feature (487)..(487): n is a, c, g, or t
ggcctnctgcgagggttacgttaggtcaacaagtagcgtatgatgcaattttacatttattaaactacagttcggagccccaatttncacnttcnaaatacgctnngcgttntcntatggagtnacactggncttctaacatttgatatatctgggtgaaagacatgaactttacaaggctttaaacacaaatcctgtagtatgaaaactgtgttcttgtatgtcaacgatttaatggggaaccaattaatgggcttccatctccactaagtgatccattttgttgcatattttattttaaacgcntaaggggtaggacaaactggtaggtttaaatctggatacattatctaaatctcccattatccccaatgaattatagatgnaagctgattttgtctggtcccaaatagctattactaatagtttttgttgccaaaagaattaaagagaataagattgtttaaattatttttccacactggantgttg

SEQ ID NO: 619244 - DNA, 361 bp, Homo sapiens
cagcggaacaagcaagccaagaaataaaaagacaaaaatccagagttgaggctgggctttgaggtttcttttccctgaggagggtctacagcttctgcaagatgtagttaagaggttgagtggagctcatgagacacatgttggtgctcggggcctatattagttgcctgtagctgctgtaacaaatgaacacaaatgtggttgcttaaaacaacagtcatttgttgtctcgcagtcctggaagtcgaaagttggaaacaggtctcactgagctacagtcaaggagttggcagggctgtgttccttttggaggctctaggagagaatgcatctctttgcttgttccgctggtaccgagctc

SEQ ID NO: 619245 - DNA, 112 bp, Homo sapiens
tcccttttaagtaagggggtctttttatggataacttcccaacagcatcggtaaccatcgggtacaaaaatatcccattaaactctttcccgagggggctccgttggctcca

SEQ ID NO: 619246 - DNA, 110 bp, Homo sapiens
  misc_feature (75)..(75): n is a, c, g, or t
  misc_feature (107)..(107): n is a, c, g, or t
tttggagacctccaggattatttctctgtcagccagatgcccaagttcaagtcattagtgatatgtggcagggcngacagagaaataatgacttgaacttgggcatntgg

SEQ ID NO: 619247 - DNA, 150 bp, Homo sapiens
ggtgcgacttccaacatcagaaaccattcgatattagatcgtcgtgctagtaaaaacctaatctcggccgggagcagtggctcatgccatgtagatcccagcactatgtgggacggccgaagtgacaggtggatcacgtaggctcagaga

SEQ ID NO: 619248 - DNA, 154 bp, Homo sapiens
gggtataaagaacgagcaataatggagaatgctgtgtgatgaggaagacagatatatgaagtaatgcagctgcaaatcaaagaatgccaaaggttgccaaccactggcaagctaggcaagaggcaagcgaaggactccccttacaggtatcaca

SEQ ID NO: 619249 - DNA, 258 bp, Homo sapiens
ggaggatcagctggagccggacactgccctgcgaacgctgctctttaaagtacacatggcagagagggcctctcccagattacactcagtgtttgctagtgctgccaccttcaatctcccagtgacccagtgcccttacacccaacagatgcggccctttcaccacaaatgagcctgcttggatgggcaacggggacatttgcacatggtatgcgctgcagcagcgctgacttcctatcctctatagcatggcgtgcc

SEQ ID NO: 619250 - DNA, 1314 bp, Homo sapiens
  misc_feature (931)..(931): n is a, c, g, or t
aagtggttcctccctcctcgtagaatgtggggacacccccagtgttccaaccctggtggtggaaaaatggtgttaagaaagacgccccccggaggaatgttgctccagcccccacacgaaatttttcctggacaacacacaccggagagtttttttcggcgtccacctgaagagccttcttttgggttaaaaaaaatgtgccacaaaccgttggtgggtggccccctcacacacgtgtttttctcttcgcgggaaatatagaacaccccctcgggggtttctcccctcgcttgggaagagggttgtcccaacaagaagattctcctgttgagcagcgaaaaagagtagcctcttctgaagagaagagcccctttcttttctcctgaatattatgatagagagggagagagagaggagaacacaccaggggagggctctaccctcaatatagagagagatatgagatatgcccgcgaacatagagaagtttctttctccctctcgcgagagctctctcgtagagagagaggacgaaaaaaatatgttggtgagaaactctgacccaccccaacaaaggccccgcttttatatgtataaaggcacacctctcgtgagattgagagagaaagagattttgtcccacacaaataaatatcctacagagaaaggtgttttctgtatagaccacacaagcgtcacacaagcgcccacacaaaaaaggtgtgttacacacacacagtttcacagagatatatattccacaaagcgtgagactggagaggtgagaaacaaagagatatatttcgccacacaacaacccgtgagaagagacacacacacagagaaatcacacacacgtgtgagaagagaagaatgtgtatagagatgacacacagagagacacaccccttctcacacaaaagggagaaanaagagaagccgcgagaaggacacacacacaagtgtgagaagagaggagacacacagcgagacacacatgttcacacaatataaaggctctcccacgcgggcgctctatacactctcacacaaagagaccgcgagagggcgagagtcacgtatcgagcacgccacgcgccgcagaaaaaaggttgtgtgttgcgcctaactatatgagaaacacacaccacaacgtgagaaaaatataggagacacacaggagaccacaaaaatgaaagagaccacaatgagactcaagagagggaccacagaaacacaccaacgccaaaaaattccagaccaaagccagtaaagtttaaaaggtttttattaaattataccaaaaccggccag

SEQ ID NO: 619251 - DNA, 436 bp, Homo sapiens
gtgtaaggaactccatctgcatcattaactcgtatcatgaccagaagccatgggcacaggtgctcaggcacgttccaggcaggcttccgcttgtagctacaggatactcttccctcaggcgagcagataaggactgcaggacggtatggaagagacaggaacatgctcccctgggcacatctgaagagtcccggacaggcaaacaagccacatgggacaagggtcacagcagcagcctaggggccagtcgctcgacctaaacttgttctttcagctacagacgaaagcttaatcacgtgcaatctatgccttgggactctttgcagcactctgcggggcatgtgtcacagaactctggctgtaaacagatacacaaacatcttcagactggatacatttttccaatacttgttgcgggtcggttttaaagcatgta

SEQ ID NO: 619252 - DNA, 129 bp, Homo sapiens
gagctcggcccggcttttggggttgcgaaggtcaatttcttcatgtgccacattgaggtccccacacagcacaaggagccgaggagcaggagaaacaaatcgttaaaacctagcgaattccccaacgag

SEQ ID NO: 619253 - DNA, 722 bp, Homo sapiens
  misc_feature (181)..(181): n is a, c, g, or t
ttctacaaataacaattgtcctcatggttccccgcgcacaatatatattccacccactcgaaaatcttttagtatccaacatctttccgccccctccccctaatatgggacaaattatttctttttcgctctctcaatattatggaaaaaaatgtatttttcaccaccgcgccccccacanaatttaacacacatgtgcctggtgtattattttggtaaaagcaacaacaacagtgtctccgcacatcataacatgtgattaaatggggcggtgcaaaacaagtataaaaatagatgtttgttctgcccccacgcggctgatgattttctcggaaattaagacaagttgcaccaattaacgtggcggcactcccccgctaaaaaatttgttattgccttttcctctccctctattctcggatgatatacatcatagggggtgatatagcgcgagacgtctctttcttcgcaaaggaaacacctctctcccacactttggtgtgagaccaagaatactgcggaactgtaatatttctgtgaaaagaggctcccacagcgtggtgttaactctagaaagatagatcttatatgggacgacgcacacgtctgtagagatgtgaggataactcgaggcacttcttgtatgtcacgtggcacatattttttaaccatgagacttatgctggggaagctgtgaatataaaaaatgcctctttaacccc

SEQ ID NO: 619254 - DNA, 879 bp, Homo sapiens
agatcacttgaggtcaggagttcaagaccagcttggccaatatggtgaaaccccgtctttactaaaactacaaaaattagctgggcgtggtggcacgtgcctgtagtctcagctacttgggaggctgaggcaggagaatcgcttggacccaggaggcagaggttgcagtgagctgagatagtgcgactgcactgcagcctgggcaacagagactctgcctcaaaacaaaaaagctctataaatttcaggtgtgttattaataatgaaatattaaattatttcttagggccaggcaccatggctcatgcttgtaatccccacactttgggaggccaaggcaggaggatcgcttgagctcaggagtcaagaccagcctgggcaacatagtaagacctcatctctaaaaaaaataaataaactatttcttagaaatgtagttcctgtttagacctttgaacaatgaccatgtctagtggtctctccatagcacatgatgtctacaaactgttcttattttcattactaacagctacaaaataactataaagtagatcataaatatgcctatgttaatatgtctctagtgcttctacttctcatgtggaatctaactcactatgtgcaagagcttcttgggctggcatttattctgcccttttagggcattgcaacggccttcaggcttgtgacttggcctgttacttaactctcgcgctcagtggccctgtacaccgcttggcacactgctgtttccgcggctggggccccctgtatcccccttgggcgttgccgggcccgcccgcgtctgccccggggccgggggcccctaaccaaggggggggcgcccccccccggggggggccggcgttcgtctctccg

SEQ ID NO: 619255 - DNA, 781 bp, Homo sapiens
  misc_feature (103)..(103): n is a, c, g, or t
  misc_feature (139)..(140): n is a, c, g, or t
  misc_feature (182)..(182): n is a, c, g, or t
  misc_feature (192)..(192): n is a, c, g, or t
  misc_feature (201)..(201): n is a, c, g, or t
  misc_feature (203)..(203): n is a, c, g, or t
  misc_feature (206)..(206): n is a, c, g, or t
  misc_feature (209)..(209): n is a, c, g, or t
  misc_feature (215)..(215): n is a, c, g, or t
  misc_feature (296)..(296): n is a, c, g, or t
  misc_feature (301)..(301): n is a, c, g, or t
  misc_feature (309)..(309): n is a, c, g, or t
  misc_feature (324)..(324): n is a, c, g, or t
  misc_feature (381)..(381): n is a, c, g, or t
  misc_feature (616)..(616): n is a, c, g, or t
  misc_feature (634)..(634): n is a, c, g, or t
  misc_feature (648)..(648): n is a, c, g, or t
  misc_feature (684)..(685): n is a, c, g, or t
  misc_feature (691)..(691): n is a, c, g, or t
  misc_feature (693)..(693): n is a, c, g, or t
  misc_feature (700)..(701): n is a, c, g, or t
  misc_feature (760)..(760): n is a, c, g, or t
gccaccgttccgccgggccatggggccgcgcgtgtgcagccgcgctgtgctgctcctgtggcgctgctgctggcgcgtgcgtgcggtgccgaagaggctcgcnctgcccccgcgattcacgttgtcgccgccgccggcnntgacgaacgggagccagccgggcgcgccacacaacagcacgnacacggtccnccgggggcntnggntcngcgctnacgcgtccttctacgtgatcctgggcttctgcggcctgaccgcgtctacttcctgatccgggcgtttaggttgaagaagcntcagnggaggcgntacggcctcctcgcnaacactgaggaccccacggagatggcctcgctggacaggacgaggagacggtctttnagtcccggaatctgagatgatgctgagccagggaggcggcccttccagcagccatgagggaaggacaggagatggggcccacccagtgcccagcaaccccctgctccaccactcattcccctgctgggcccggggctggtgtcacccagtgccaacccgagagctccttttggaacctgcacagcccgccgacctgttgccacctgcacccaccgctggaccatgcagcctcgcntcctggatgctgtcccancctggccgagggtnccaggtgaagactggagggaccccaacagccaccgnncaggangntgaggcnnccttgcctgactgtgacttgtgctcttctctctctgcccccgtggggacatggcagccnagagccaagggggggtgggag

SEQ ID NO: 619256 - DNA, 103 bp, Homo sapiens
catacactgcaactagtctgtctccatatcacgcaacagaaagcgaacccaaaggtggatagtctgagaagctctcaaaacacatggggcttgccaggaaaca

SEQ ID NO: 619257 - DNA, 996 bp, Homo sapiens
tgggccctccctttctctggggaaatagggggggggcgaaaaaattcgtgggcatttgggggaagagtttcctctctctggggagctaaggggggctcttcaaaacccaaatgggctatgaactccgcgccctaaaggttgtaagatgggcttggctccccgggggattttcccccgtggttaagcacgtggtttttcctaactccagatattctgccggggtaaaagaaggggggttgggctttaattccacctcgcggggaagagggggacacaagtcttttcggccgcaacttctttcaaaaattgggggtggtctagacaagctgtgggggagggggccacgagaggggcgtggaggtctccaaaaataaaaaaaacaccctcttgtgtgcatcgagaggagttttggggcacacaagcagaggggggttctgtgaaggagagctgttttcaacagaggaagaacggcgacattgtgtcatgaaggtggagctggtcggtcatcttgaggagggaccgagaagaatgatggtacatataggtggcgcccaagaatattgggggaggggggaggaagaggtgctattgtccccccgtggttacaagagagtggagggagaacaacgggggcacatcaccacaatatagtgtggtggcccggacaacgaacggggtgctcttaaaggaaaggcgggaaacaagcaaggagcggcgaaaaaaacaccatgaggagcgcataattaaccagccgcagaatgtgggatcaggggaaacacccacgatagaggaaaccgcgcgatttaggagacaccgcgcagtcgcggggcgacccaaggtgtccaataacaccccctcgggggtgaaagccgcgaagccccagcgacctgtgctccggggagaaaagctactcccacttgcgggaggtggacacaatatggtggcacgggatacatgtggccacaacacgagggggtgaaccccatagaggtgggg

SEQ ID NO: 619258 - DNA, 190 bp, Homo sapiens
gtgtctgactgctctctctccccgacgtctggtgagccacgtgacaataaaggcaaaagggtggggtctaacagctggttgtggagctgagccctggaaagccctcttttgaaagtaccttctaatcaaagccacagacccagctcccaaacagaatagtgactcacagaccaagactttgaagcttttg

SEQ ID NO: 619259 - DNA, 750 bp, Homo sapiens
  misc_feature (660)..(660): n is a, c, g, or t
ccgcccttttttttttttgtttacaaacccggttctggggtgggtgtgggtataatactaagtggagatgatatcatttacgggggaaggcgcttggtgaagtaggccttatttctctggtcctttcgtacagggaggaattggaagtagatagaaaccgaccgggattactccggtctgaactcagatcacgtaggactttaatcgttgaacaaacgaacctttaatagcggctgcaccatggggatgtcctgatccaacatcgaggtcgtaaaccctatggttgatatggactctagaataggatggcgctgttatccctagggtaactggtcccgtgggtcaagttatgggatcaatggagtatagtagttcgcttggactgggtgaagtcttagcatgtactggctcggaggtggggttctggctccgaggtcgccccaaccgaaatttttaatggcaggttgggaagttaaggacctggggggttggtcaaggtacggttggcattaataaattaaagctccatagggtctactcgtctggctggtgtcatgcccgcctcttcacggggcaggtcaatttcaccgggttcaaacagtaagagacagttgaaccctcgtggagccattcatacgggtcccaattaggacagtgttntgccccttggccggtaggtccgcggcgtacattgtctgggcgcggcctaatctgggaccaggagtttggaccggcgcaatggggctcaca

SEQ ID NO: 619260 - DNA, 764 bp, Homo sapiens
ggaattgaaagaaataatttttggaaaaagaaaaactccaagggtagctgttggcactttcagagcatcccatattttcaggatgttttgtatgagataaagtaaatcagttttgtttgacagggtgtagtgtgcccagccaggtcattattttaaattgacaaaatgatttaaatgatagaagacattgtatattcctgaaacaataaatacctattaagtacattttgatacagtggagaagtacagatttttgttatatagtttaaattatttattgggataatgtatataacgggttaattcaacactttagtgtttaaatactcatcattcttataataggtgcacaggttcataaagatagttctctcattatgattaagaaatacaactaagtggtgaagtggcattaaagttagaagcttcaaattcttcatcgagggtttgagggtggctttttaacaaagaaacttgggtaacagtaggatgatagaccagttaggtttcatgaacgttcagagcttcatatcttggcttttcacaacctagtagatacagagtaaataactggaagaatactagagtagaaagaaacccttttcctgaataaggtgtcgaggatcacaagggggtcaggcttaatcaagaattttagagactaggccaggccggaattccgcacttggggagccaggaggtggatacctgaaggtcggagatcaaaccacctggcggactgggaacttatttgcggaatatta

SEQ ID NO: 619261 - DNA, 307 bp, Homo sapiens
ggacaatacttaagagacccctgaccctaaggaaatagactgcagcaccaatgggccaactttggggcgatcatcttgcccagaaacatcatgttgaaactcttggtcagaggttggatgaaagctgacagggtccatccaggagcaagtttgagccttgccagttccattttgggtgctgagttgagtcgcgactatagcaaacctgtgatctctggctgctgctcaaagaaacaagaggaggatgatatgtaaactctgatcatatctatctgagcttttgatcagctagcaccacatatcagct

SEQ ID NO: 619262 - DNA, 153 bp, Homo sapiens
cccacccttctgcgtgtgcccaagcttactgccgtaggggcggacacaggtctcgttcccacacccttactgtccggggggcttggggacgtgtggtacgaccccacgacacactcttctggggaccgtcacgtcactcgttacctacctact

SEQ ID NO: 619263 - DNA, 158 bp, Homo sapiens
gtcccgacctgggtgcgcggcgcgctggagccctgggcgtgaacggcgtgatcctggactacaacctgctggccaaccgctacatgacgcggcagtggcggcaacacggccagctacaccctgtacggcaccgccggcgtgaacctggggtaccgagc

SEQ ID NO: 619264 - DNA, 342 bp, Homo sapiens
aaagtaaaaagaaataggtgaaaataattttaatatgctttaacacaatatatctcaaatataatttcaacatgcaatcaatattttaaacatttagtgagatattttacattttttcacactaagccttggaatctagtgtgtattttgcacttacagcatttctcaattcagccactaaattttcatcaaaaatgctcaataagtatttagatttcaaaaagtttacagttgaaaaggtagagtcacatacccaagttgctccaattatacctacaaatttttaaataactaagtttagtatcaatttttaaatttacattaattaaatggaaaaaaaaa

SEQ ID NO: 619265 - DNA, 210 bp, Homo sapiens
atcacttgagatcgaaggaacgaaaatgagcctccgagttttccggacagacttatcacagccataagatcccggactcataccagctcagccggatgactactacatcctggcagacccatggcgacaggaaatgggagaaaggtgtgcaggtgcctgccggggcaaatgcgcatcccagagcccgtgttgaggatcctcccaccagtg

SEQ ID NO: 619266 - DNA, 582 bp, Homo sapiens
  misc_feature (487)..(487): n is a, c, g, or t
  misc_feature (489)..(489): n is a, c, g, or t
  misc_feature (542)..(542): n is a, c, g, or t
gttttaaatcaccccctccccaataaagctaaaactcacctagattgtaaaaaactccaattgacacaaaatagactacgaaagtggctttaacatatctaaacacacaatagctaaaacccaaactgggattaaataccccactatgcttaaccctaaacctcaacaattaaatcaacaaaactgctcaccaaaacactacgagccacaacttaaaactcaaaggacctggcggtacttcatatccctctacaggagcctgttctgtaatcaataaaccccaatcaaccttaccacctcttgctcatcctatataccaccatcttcagcaaaccctgatgaaggctacaaagtaagcccaagtacccacataaagacgttaggtcaaggtgtaacccatgaggtggcaagaaatgggctacattttctaccccaaaaaactacgatagcccttattaaacttaagggtcgaaggtggatttaacantnaactgaaagtaaagtgcttaattgaacagggacctgaaccgcgtacacaccancccttaccctgctcaaatatacttcaaaagacatttaact

SEQ ID NO: 619267 - DNA, 295 bp, Homo sapiens
ttcgtgaaacccgacttcagtaaaatatggggagaagggaggccttagcgcaagcaaaattgtcaaatagcccgcgcaaatccgattcgactacttcgacacggaggttcgttttggcgagagaccatccttgagtatgtcccaaaacctaattttttgactttcgtcccctggggcgaaatttttggcaaaccgaaattttctatcgcacgtagaaaaaacaagagcgctggatccgtccagcgctcttcctttttcccttttgggaaattttttaattcttcgcgttctggca

SEQ ID NO: 619268 - DNA, 168 bp, Homo sapiens
ccagcccccttggcctgccatgtgtttctgccgcaaaccccctttagatggggagggaagaagaaccttcagtggaggggacatgacccccccctatgggcataaacgaaagcgccccattttcttcgtatccctcaacccggaaatcattacggggttttcttttta

SEQ ID NO: 619269 - DNA, 1190 bp, Homo sapiens
  misc_feature (260)..(260): n is a, c, g, or t
  misc_feature (319)..(319): n is a, c, g, or t
  misc_feature (387)..(387): n is a, c, g, or t
  misc_feature (556)..(556): n is a, c, g, or t
  misc_feature (639)..(639): n is a, c, g, or t
  misc_feature (663)..(663): n is a, c, g, or t
  misc_feature (682)..(682): n is a, c, g, or t
  misc_feature (710)..(711): n is a, c, g, or t
  misc_feature (713)..(714): n is a, c, g, or t
gaagttgatcgaggctatatgtctccatacttattaatacatcaaaaggtcagaaatgtgaattccaggatgcctatgttctgttgagtgaaagagaaaatttctagtatccagatccatgtgtacctgctcttgcaaattgccaatgctcaccagttaagccttgtggtcataatcggctgaagatgttgagtggagcaagctcgtaagtacactctgtcttgaagtaggctacaaggtttggtcttcaaggttgtggncagtccaaggctccaggggtttggtgacaatacgaaagaaccaagcttaaagatatggnctattgctactggtggtgcacgtgtttggagaagagggattgaccctgaaatctttgaagacgttcangcctcatggacttagcgaaaagttggagaggtcattgtgcaccaaacgacgggatgccatgctcttaaaaggaaaacggtgacaaggctcaaatttgaaaaacgtattcaacgaaatcatttgagcagttacgatgtcacaactagtgaatagtgaaaaggaaaaactngaatgaacggcttgcaaaactttcagatggagtggctgtgctgaaggttggtgggacaagtgatgttgaagtgaatgaaaagnaagacagagttacagatgcccttnatgctacaagagctgctgntgaagaagtttttgggttgtaagggggnngnnccccccccccctgaaaaaaatcccccccactttttgcttccttgtggcccctgtctccccttggctcttgcggggtttaaggcgcccttctcgttctcttgcccttgtctgttgtttttgttgctcgtctttcttgggtctttttttttttgggcgcttttcttctcccctcccttttttggtggtttggttcgctccctcagcggtttgcccctttattcggtgttctttcgttttttggcttcttggggggcgtctctttttcttctttcacgttctggccttttgtcttttctttttgctcttttttgtgttcttgtcttctgtttttcctttttgttgcttttcttctcctcttctttctttgcccgccctttgttttctttttctccttgtgtcttctttcttgcttgctttttctcttttcttcttcctgcttctgttgcgcctctaattttaaagaataaaaaaaaaat

SEQ ID NO: 619270 - DNA, 105 bp, Homo sapiens
tctgactcagtatcaccacttgctccaactgtggataaggcatagcacggctggctgtttgtttccttaccagctacatgggtcaattttgcttgtagctgttgg

SEQ ID NO: 619271 - DNA, 527 bp, Homo sapiens
ctgtgaagaggagtctgatcttgtcccccaggctggagtgcactggcacgatctcagctcactgcaaactttgcctccgggattcaagcgattctgagtagctgggattacaggtgtccaccaccatgcccggctaattttttggtacttttagcagagatggggtttcaccatgttggccaagctgatcttgaactcctgacctcaggtgatccacccatctcggcctcccaaagtgctgggattacaggcttgagccaccacacctggcccattattacattttctaacagattttggctgtccttgtttacttgtttccctcaactttttttcccaaacagacagggtccctcactttattgcccaggctggagtgtggtggcacgaccatagctcaccgcagccttgaactcttgggctcagcctcctgagtagctacaactacgggtgcatggcaccatgctcagctaatttttattggctgtagggatggggtcttatgttgcctgagccgtactccaacc

SEQ ID NO: 619272 - DNA, 461 bp, Homo sapiens
  misc_feature (41)..(41): n is a, c, g, or t
tctcggttaaatgtctcccagagaaaactcaacactgcccnacctggccataggcccttgaccccctttcttggagcatttacaaaaaaagagcttacaattgtgagtccttcctctgtccccttgacacgtatgtgttctctcctacaattcaggagtatctttcttaaggacctgaaagccattcctttgaaatttaatcatctggaaggttgctatctcccattcttggtgggagggtagaatcctgacttcagtgataatcgccagctagctgacgcagctgatctaatcacttttatactgacagactttgaaatgttttgcatgtattccggctctttccccctcccttattctctctttaagctgctcaattatctctgcattgaaatggaacgctgctctttcccctactgttagtaattactgaataaaattggttttcaccactttaaaaa

SEQ ID NO: 619273 - DNA, 280 bp, Homo sapiens
cttccctagatccttttctccatgatacttactgagtagctacactgtagaggcagtgttctaggccatctctcatactacatagtttattagatatatctcattttttgacctctccaagctggaacataagctaaattatttcaagattttggttcgttttgactcttctccctatgccttatcttcatagccctgtatattcgtatgagttttaattaaatatttactctaaggaataaattcattctctccgtctgtgactcttgccttttcctgg

SEQ ID NO: 619274 - DNA, 424 bp, Homo sapiens
  misc_feature (11)..(11): n is a, c, g, or t
  misc_feature (13)..(13): n is a, c, g, or t
  misc_feature (216)..(216): n is a, c, g, or t
  misc_feature (268)..(268): n is a, c, g, or t
  misc_feature (305)..(305): n is a, c, g, or t
  misc_feature (321)..(321): n is a, c, g, or t
  misc_feature (328)..(328): n is a, c, g, or t
  misc_feature (384)..(384): n is a, c, g, or t
  misc_feature (393)..(393): n is a, c, g, or t
agacacatctntncttcattcatatatgttaatagatgaagcatttttcctgctgcatattcctgaatagagttgctgaaagagtctacttctttactcatgggaagttgaaggccattctgtgtataaaggctgaggcaacggggaaagacctgacagctagttacataccctctgacatattactcccatgatggccttccattgacacatgtnctgatagaattctaaacctctggaatttccctgctttcaacttctatggccnttgactgtacatggtaacctgatgccatatgctatgngccttattagaactanatcattncatcatggaggatactgtgaggcaccatatccttttcttcttgcatgcattttctnaaacccctnttatgaaagttggatttggcgtaacttgctt

SEQ ID NO: 619275 - DNA, 544 bp, Homo sapiens
ccctccctttttgtataatttaataaagaaatggtcgcgcaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggccttttatatttttctgggggggccgttcgcccccgttttttttaaagggggtcgctactcaatatgtgggatgtttattatatgaacaaggggcacgggaagggggtgtttaaaaaaagtgggaaacgagggagaaaaacaaccgtcacacttgcatgcagtttttcttgtgaaggaaagcaacaaccactctattagcgaggggggggacgacattaagaggtgggaacaaactccctcgtcataaagaattgtttctgacggtcataggaatttaataaataattatttggctgtgtagttaatgatggtgtataaaagcgagtatttgtgatgggagaaatatagatatgtgctttcggggtgatgtatataataattattttgaacaggcaggattttaattgg

SEQ ID NO: 619276 - DNA, 241 bp, Homo sapiens
tacgtgtttctactcagggtaataaatagtgttttcctctgacatgtttccaagttatttgtaaaaggcaactgcagtggtctcaatacgttttctttttttttggagatagggttcttacttggtcacccagactgcaatgcagtgacgtgatcccaaatcactgcagctttgaacttctgggctcagatgattcttctccctcagcctcccgagtagctgggactacaggcacacacta

SEQ ID NO: 619277 - DNA, 1003 bp, Homo sapiens
taaatattatactagcatataccatctcacttctaggaatactagtatatcgcgcacacctcatatcctccctactatgcctagaaggaataatactatcgtctgttcattatagctactctcataaccctcagagcaccactccctcttagaccaatgatggtgcctattgccatacgtagatctctgccgcctgcgaatacatgctggtgggcctagccctacatagtctcaatctccaacacatatggcctagactacgtacataacctaaacctactccaatgctaaaactaagtcgtcccaacaaattatattacgtaccactgacatgacgtttccaaaaaacacataatttgaatcaactacaaccacaccacagtctaattattagcatcatccctctactatttttcaacccaaatcaacaacaacctatttagctgttccccaatcttttccgtccgagcccccttaacaacctccctctcctaatactaatctacctgattcctaaccctcacaaatcatggcgatgccagatgccacttatccagatgaaacattatcatgaataaaactctagctctcctatactattctcccgtacaaatctccttgttataacattcacgagccacagaagtaatcgttatttatatagcctcttacgaaatccatcacttatcccgaccatggtatagtcaaccgaatgaggcgaacagtccagaagcgtgatacgcatgacatgcttcctatgctacacctagtaggctccttcctatcgttgcctatttcatcacatcacctaggttatagcatctatactactctcagggcagagttcaactctgagcacactagatgaagctcaatagtgtagaagtacctgaagctcatgtgactaaagcggacccacgggcaaatgggggctgaagggtggaacccaaatacgggagatacccttgactagtaagcggaacatttggccggcacgctccta

SEQ ID NO: 619278 - DNA, 324 bp, Homo sapiens
ttatctaacatcactgacctctatcattaacattctcttaataagaatatatttgcttccatcccacaggttaggttccgagagcatgtcctaactttttcccttttttaaatacttcccttcttgtttgtacttgaatagtgaactaacaccaccctcagggtaattactgacatgattcataactaagcaacataacaaattccaactgtaatataacagtgaacactgcccatacttaacaatgctggagtcccatgatgccttttccccctgaactttttccattttgagaaggtgatgggggaggaggggtgcctcaag

SEQ ID NO: 619279 - DNA, 770 bp, Homo sapiens
tggatggtatttccaactatatatcctatagaaaattgctatcttcatagggcacttcaacacattgtggcctccatagtcaaatgaatatggaacagcagtagagggagagacccatttctttatgagctgcatcattcttaatctaattcaatcttcattggatctttgacgaaactttcttcacatagtgagactcattaattctcgtttattatttaaactatcatttaaaggaggcacactttacttgtgatatgagcgaaacttagctatgctagggactaatatttatccatcatatttattacctgaatatccgttcaaaacaattagaccggatgctttatagacctttatttcagcgctggacttggatattacccggtgtctgtttaaacattcctcaatttttgcaaaagataagctgccgattgttttaaaaattttagattggcgttttgccaaagttaataattggccaaaaaaatctccttttaccatcccgcgtgaaattgaaacttccaatagttatttttggaaacactccaaaacgggttgactaaggaccttattatgttgcgtgagaacgatattccccttggcgggggctttagcgaatggtaacaaatgggtgtgcgcaaattttttaaaaggtcaggggcgtctttttcctggtattcctctgtagcacgcccaaagaacaccttggagaacccttttcccctttaattatatcctagagcacaattaggtagggcttgcgcatt

SEQ ID NO: 619280 - DNA, 128 bp, Homo sapiens
aaaccatctccggcattacaaaagatgaagactgtaatcctcaacccgttcctcagagcaacttggtggcaagggagtgtctgtctgctgtcagaagcggtggtggagatggcggctcctgtgctgag

SEQ ID NO: 619281 - DNA, 177 bp, Homo sapiens
  misc_feature (18)..(18): n is a, c, g, or t
  misc_feature (53)..(53): n is a, c, g, or t
cctgtatataaaaaaatnaaaattacaaaaattacctgcatgcacctgatggncccggctacttgggaggctgaaataggagaatgtcttgaacgtgggaggtcaaggttgcagtgagccatgattgcatcactgtgccactgcactatggcctgggtgatagaaagacccagtctc

SEQ ID NO: 619282 - DNA, 521 bp, Homo sapiens
cacgaggtcaaagtcagtctctgttcaagggccctctcatctctgggctcctggcacccagcactgaatgtcactgatgcctggtattaattcttcaggatgactcttagcagaactcacacaaggtcctggagacccagagatgcctttctgaggtttattgcttcacctctctctgcctgcatcagatagaccctggtataaagaggagaaaagagtgattatgtttcaaaattatctacagaacttatttaaattctggatcagttgactttttttttttcctcatatataaaaaccttccaacttgtttctgtaggtaggtgacacttcgtttgatctgccggaagcaaatgtcctcattcagatctcatcccatggtggctccaggcgtcaggaagcccaaaggctagggcgggtgcttcgagctaaaaaaggtaaagtggcctttcatcttctgttgcaggaggtcactcctcttaaaccactttagttaggaagacgataggggtgagagctgc

SEQ ID NO: 619283 - DNA, 245 bp, Homo sapiens
  misc_feature (49)..(49): n is a, c, g, or t
ggcacgaggtagttccagctactcgggaggctgaggcaggaaaattgtntgagcccaggaggcggaggttgcagtgagcggagatcatggcacttcactccagtttgggcaccagaacgagaccctctcaaaaaaaaaaaggaccagggcaagaaagccacctctaactgctcctttccacatatactggaggtcctttctattgaattaggcaaggaaagggaaaaacgggtatacaggttgag

SEQ ID NO: 619284 - DNA, 383 bp, Homo sapiens
cgtggaggtgtggttcagaatgatcacgtgcatacatttatgtgcactttatttctattgttattacgttataatatgtaatgaaataattataggactcaccataacaaagaatcagtggaagccctgagcttgttttcctgcaactaggcagtcccatctggggatgacgggaaacagtgacgtatcatcagaaattagatttttataaggaacatgcaacctagatccctcgcatgggtagttcacaatagggttctcgctcctattgagaatctaatgctactgatgatcgacaggaggcagagctcaggcggaaatgcaagcaatgggtagcagctgcaaatacagatgaagctttgctggctagcctgccacaacct

SEQ ID NO: 619285 - DNA, 372 bp, Homo sapiens
gacatatctccagagtggatgacaaatcccatgcagtctggtctgcatgtcaaagtgtccgttaaaagacatagacactcacttcatatatggtggaccaccataagtcctgatacaaccacggatgaacagtcaggagcaaggatagattactttcattgttccggtcttctccttgggggtcacccgcactcgatctccagtgagctgcacattgggtggtgtccactgggcgctcaggcttgtgggtgtgacctgagtgaacttcaggtcagttggtgcaggcatcgtggttcctgcagtctgcaccagaggctgactctctccgcttggattctgagcatagacactacccacatactccactgtggg

SEQ ID NO: 619286 - DNA, 695 bp, Homo sapiens
ttcatccctcctccctaactttccccccacgactattttatccgctcaacataatgtcactccccgcaccacaagggttcttctcacactcaacagagagcccattgtcagacatcatgtgtgtgtccccaactggcgcacacccacatctgccgacgagacatatacctttttgtggcacacacaccccacacccctccgccactttatgttttgtatccctgactggcaaacacaccccggccagaggtcctatctttgagcagtcgtttcgacccccgcgctacatagttttctacctaccccccacacaccacagaactagataatcagttctgattacataataatcatcatcattggtctccccccccccacacatacctctatacttgtgatcgctcccaccacacaggccagattcagtaaagcgcctcaccccactgtataaaaatatactttctctggcagaagcgggctgtagctgccttccccacgcctcctgcgtacgccggcgggtcttccccgcccctcacgaagatgggaaataggtgcgcacgacggttatcgccgagcgagagccggtccacgcacaccaacggagcaacaacagaggcgaacaagaacaatacacgaggaaatacaaccaaacacaaaagacaaaaaaaaaaccggaaaataaaatagaacgagac

SEQ ID NO: 619287 - DNA, 284 bp, Homo sapiens
accccactgatattcgtgtcaccattcatccatgaagtatgaatgggcgatgctctgtgttcatgtgaactcctcaatgctggctggccaaccatgtgcctgagccacttctgcatgacgcgtgcgttgaacttcatgcaggtctgtttcaggcaggcgcttacactcttcccagaggcccatcatggtctcattgcacactcctgtgagctccttcagctttgtctctgattccctggtctcattttgaccgaaatatcgtggggcatcctctaagagtcgac

SEQ ID NO: 619288 - DNA, 555 bp, Homo sapiens
  misc_feature (6)..(6): n is a, c, g, or t
  misc_feature (130)..(130): n is a, c, g, or t
  misc_feature (133)..(133): n is a, c, g, or t
  misc_feature (165)..(165): n is a, c, g, or t
  misc_feature (223)..(223): n is a, c, g, or t
  misc_feature (385)..(385): n is a, c, g, or t
  misc_feature (446)..(446): n is a, c, g, or t
  misc_feature (452)..(452): n is a, c, g, or t
  misc_feature (535)..(535): n is a, c, g, or t
tgtggnttttcaaaacgttcacacattttaatgtttcgtcgatgtttttaaatagtacttacagggagggtggtacagagcaaaggcccgcaggccctcgtagcaccgcagttcaggtaggatgctgggnggnggggggtggtggagggggttctatttacagtntttgggctttgacttcacttactgtgggttttgttttcttttttaaaccttttccttnaagtttgggagcctgtggagggcctgtgaccttaaaggcaaggtttccttgtttgcaccaggaagataaatgttaaaccacgaccccaggggctgcactaggcgttgggcccagaagcccccggccatccagccccgactcttttatgccttttcccctgangaggggacccagggtaccctcaaggggacatagaagggaggctgcatcctagtacagtttnaaagtnaggggggcgctgcaggagcctggacaggaccacctagcccagccagggacaggagggtgagaacacctggaacaaaggcacanaggctggagaaaaggcggca

SEQ ID NO: 619289 - DNA, 898 bp, Homo sapiens
aatcaacctgtggtggccccttaaaatagtggggccaccctgttattggatgggggcgccccaacgaggggggttcatcagcgggttgcttcctagcagctgttgttaacccaccgggggtaatttggacactgtctccccgtttagaaagaagcccggggctatttatcaccacgcccaaatattgctggtgtgtgagaccccctctatgggggagcgtcttaaaagtctttgatatgtaaaagcgcgccaccctcgtggtgttcgctgtaaccgaaaccccccacaggggggttctctaatgattggagccacaaaagcggctgggccattgttaagaaaattttttcggggtttgggggccgacaaccctctgggggagacaacgaacccctcaactctttccgagccacgtaacactcgactataggaagctttcacccacgcttctcaaggcggatctatcctataagactttcccactgtgattcgcacccagtaaaactgtgagcccccaccgggggaacaacgtctatacgcccatgggagttacacgcggcaatctctattttttatgagtgcccataagtcgacacacaataaggggttacgagcctccgactgtgtgggaaatcacggagcatcccgaatgcgtgcaccccgcctatattaaaagggtttggttttgtttcaaccgagattataaaggtccctaccgtgaattctgaggttcacgaccggggtaaaccacgggcggtttttatttacttcaaattcctccctgtacgaaaggacaagagaaataaggcctattttacaaagggcctttccccggaaatgatattatctccacttagtattaaaccccccccccccccaggaacaggggtttttttta

SEQ ID NO: 619290 - DNA, 519 bp, Homo sapiens
  misc_feature (62)..(62): n is a, c, g, or t
  misc_feature (69)..(69): n is a, c, g, or t
  misc_feature (117)..(117): n is a, c, g, or t
aaaaaataaatgaaattatgtctacagcttaagctgattggacttgtttaatgccaaatgtnctaatgngttcttagatgcctaaattgcagttcctgtagtatataatcctgctcngtatatttagttacgtatatgctttctgaggagaccttaatcatttggttaatcatttggcttgctgtttacccctctgtagtttttaattaaaactttaagatagtctacttaaacatgatcacatctaagctttatctttgtgtaatctaaggtatatcgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatta

SEQ ID NO: 619291 - DNA, 287 bp, Homo sapiens
atcccctaggtggaaagcacgtattccttgtttggcaccgtgtactggtaggagtaccgctgcttgcactcttgtcctcataaacctgtgggcacaatcttcaggatgtagtcgtgggaggcaggtggttggaggtgagtctgtctgctcccccgagacgcattgaaagctccgtggatgttctggacctgtagcgtgtccccaaaggagagcttgtggattgaatgcgtcatgtctgggttctgtggctgggctggtggactgtgtgtggacacgtggaagtttgc

SEQ ID NO: 619292 - DNA, 220 bp, Homo sapiens
gcgattatggcagcatggtagctcaccctgtaataaagcatagggcagtgagcgggcagatagcttgaggttgggagtacgagaccagcttggccaacatggtgaaaccccgtactctgctgaaaatgcaaagattagccgggcatggtggcaacatgcctgtaatccccgctaccaaagtggcttaggcaggagaatcgctggaacccgggatgtgcat

SEQ ID NO: 619293 - DNA, 121 bp, Homo sapiens
ggttgttgtggaggccaaaatggcggctcaggcggcggcagcggcccaggcgtttggcggcccaggctgcacaaaccgctgcggccgacttgttgtacctggcgcttctggtcttcgctga

SEQ ID NO: 619294 - DNA, 194 bp, Homo sapiens
caatgtaaaaaaccctttttgacccattggcttaattttttcctagaaatgtatatatacatataaattcctttgttattaattaagcaaatggttcaaaaaggaatttatatgtatatatccatttctagtaaaaaatttttggaacccttgactacccaatattaattaaaatggctaatagttggaatcta

SEQ ID NO: 619295 - DNA, 611 bp, Homo sapiens
aatactatttgcctcgtctccgagagttgcatcatgatggccagtgtcccccggaaatgagtacagtggtgtcacactctgcacagaccccctggtaaagtcaacagcacacatgcactctaaatactggagccaggtgtggtgcacgcagttgaggtcccagctacttgagagacggaggcaggaggatcacttcagcccagcaggtcgagactgcagtgagctgtgatcacgccactgtgctgccgcttgggtgacaaagggagaccccatctttgttttgttttgttttgttttgttttttttgagatggagtctcactccagcctgagcaatagagtgagactctgtctcaacaacaacaacaacaaaaatattctttccttctttaggacagatttatagtagttttactgtatcatttctaaggttcttaaactgtgctaataaaattgttctccaaagattgtctccttcacctgtgtttagtaaggctggcttttgtcagaagccatttgctttgatgtttcctggtgcgtggcttggatcactgccctgtgtgtccctgggtgtgacccgtgtctggatcgttcagctatctgagccctaat

SEQ ID NO: 619296 - DNA, 582 bp, Homo sapiens
acgggagacttgagccagcttctgactgcattcagccctctctagtgactgcagcagcctctccccagcacatgagtcccccctcctttgtgtgtcccagcacccttgtgctgagtgctggggagatggccacccagctggacactgggagacttgatgcccagccttctgactgcattcatgccctctctagtgacatgcagcatgcctctccccatgcactgatgtcaccccctccttttgtgtgtcccagcacccttgtgcctgagtaaacttggaaagtgggctcccttccacagagaagggacatactcatcattccacccctattatatccatgctgtcctgacaccccaagaccaccacaaactcccaacccattgaccccctatgactccacatggagtagggtgaacagggcgctcagcaatgcgcgccacatggtcatgatgttgtagatgctgaagcatgtcaactgttgttctgatctactgtgcacatttacgttcacccactacctgcacaatccccttccaccaattcttgcccccttttactcatcaccctgatttagtaaactca

SEQ ID NO: 619297 - DNA, 699 bp, Homo sapiens
actctgaagaacgggttacggtagcatgttactcccccatctttgcggggctggagttcaaggttggacctggtgcttcaaattttgaatgagtgccacagaaaggcagcccagccctggtggaggcactgttacaccaggccgccatgcccgtccatctatacacatctaggatgacctcctccggccaagtatggggacaaatagtaatctattgttgcctgccccagtgctcctgaagacaggggaacagaaatcctggtgtcagccatggaacctccaagcccttaggggagggcctgcggtatgacttacatgttactccttgggtatttaatgtgtatgtagcctctacgattgaccgtcataggggaacagccagggaagggaccctccttggggggatatatgtactgtctgtgtggcctgttgtgagctctcctgtgactttggcacaagtacaagacccaaaagaaccacggggagccgagaaggtgtggtttcatcacccagggcagaagcccttggtggctgcatcgttatccagagatgaaaagttagcctgtatgttgcctgagggacgtgacttgcactgttagttcctgtgcctgttttgtcttccagtggtgattgggggctcaacagctcgtacatgggccccccttagccgaggggccatggtccctgtgggtctggcgc

SEQ ID NO: 619298 - DNA, 998 bp, Homo sapiens
  misc_feature (22)..(22): n is a, c, g, or t
  misc_feature (25)..(25): n is a, c, g, or t
  misc_feature (731)..(731): n is a, c, g, or t
  misc_feature (915)..(915): n is a, c, g, or t
  misc_feature (935)..(935): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagttcttacaccccacagagagacagatacctgatattctaacaggaaatagcatcagctagagtggagaagaaagangagagaagcatgaagagcattcagcagagaactgccagacacgtcgtatgaagcagcaattaagttcatggcctacaaagggtagaagaacgcaatacttgtctaggacgaggagacataatcactatcgcatagattcaccttgatagtcgatgatattcagagctgtaaagtgaagagaatngcaggaatcagtagggtganttccccgttttaataaggagaggccttaaaacggcatacccgggtgacccacttttttgggct

SEQ ID NO: 619299 - DNA, 1468 bp, Homo sapiens
gtctcaaaaaaaaaaaagtcacagtggggaagctactgtcccatgaggttggcgtggggactcaggttagtttgggtgggggagtgggcaatgggcctctgccatttgcatcatgtgacttccataatctgggcttcaaggtaactgagcccttagtaggacattacccagccagggcaagacgaggtgtggaggtgcaaagcagtccctaataaaaaatgtgtgtccagaacttgcacaagttgccaggtagcagtggcctcacatctagtaaccccagcactttgggaaggccaaagtgggcgcatcacttgaggccaggagttggagaccagcctagtcaacatggctgaaaccccatctctactaaaacatacaaaaactacgtatggacatgttggtgcacgcctgtagtcccagatacttgggaggctgaggcacaagaaatggctggaacccggaaggtgagagcatacacagatgacctgaggtgagagccacttgaacactagcctgggtgacaacgtgagacctgttcccacaaaaaacaacaacacaaccgaaacgcccaggccagaagaccaccccaggaaacacaacgagcaagaacaactcctcacgcaagagaatacacaaacaaaaaaaactcgtgtgacacagccagagaagactgacaccaaagagcggacgagcgcacagagaacagaacaggacggtacacaagaatcgcaaaaagaggagcgacccacaacacgcgggacgggtgacaccaggctggactgctaacgagacaaaaaccggggagcgaaaacaaagacaaagaagaacacatagcatccccatcgctggaaaaagagaagaaaagaatacacagaagaaaaaaaccaaaaagaacagacacagaagaaaagaaaagagaaaaaagaaagaaaagagaaaaaaaaagaacaacagaacataacgacaacaaaaagagaagaaaaaaagagacagagcatgaaagaaaacaaaacggcagacgaaccaaccggaacgacaacagagagaaacgcagacagaaaaggaaaaaccaggaagaaaagacaagaagaacgaccacgagagagaaaggggagagcaagaagagagagaaaagagaaaagagagaaaagagagagagagcagagagcagaaggagaggaggagaaagaagcgaaagacaaggcaacacaaacagaaacagaacagcaaacgcgaaggaaggagagaaaagaaaaaggaagaaggaacagcaacacagagcagaagagaacgaaaagaaaacgatacaaaaaaacaaaaagaaagacaaccaagcgagcaaagaagagagacacgaaagcggaagaaaaagaggaaagaacagaagaaaaagacgagacgagcgaagagaagcaaaaacgcaagagaaagagaaaaaaagaaagggaagagagacagaaaaagaaag

SEQ ID NO: 619300 - DNA, 733 bp, Homo sapiens
  misc_feature (662)..(662): n is a, c, g, or t
ggagagaagcagtagtcaataaagagagtgccgtatttcgcagatggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagttcttaaaaaccacagaagagcacagaanactggatattctaaaagggaaaataggcatcagctaaagtggggagagaaaaaggaaggagagaaaggaga

SEQ ID NO: 619301 - DNA, 951 bp, Homo sapiens
  misc_feature (22)..(22): n is a, c, g, or t
  misc_feature (25)..(25): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagaggtaagaatcaagaataactactgtttatatttatagtttataattataaagaatgttaacgtaatgattattatatgattatagcttacaattataaataatatgagtggttattaatgtaatatactattttaaaagcttgatttggaaggcaccagaatccggaggaaaaaacctctgggggaaagaccaaaggatgaggatgaacgcacagtgtatgtgggtaagccttagaaccggtccccagtcagaaaacggcacgaaccatatataggtaacattattggggctctgatgggaacactctattttggctgaatgataaatcgactactccagaatgttaatcccgctggttgaaagtttggcaaggggcagtggctttaagcttccatattagctcggaaccgagttcgcgcggatagaaacaatacgaaggggttttagcaccgaacaaagcgttgcaagaagccctgcagcggacaaagaaagtagagaaaatagactgatttcatacatacactgtcacacaagacaccgcatcg

SEQ ID NO: 619302 - DNA, 2118 bp, Homo sapiens
  misc_feature (22)..(22): n is a, c, g, or t
  misc_feature (25)..(25): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagccccatgtcttaacggcagcagcttttttatttattctccaagcatatcagcaaatctctacgtgcaagaggcaaacaggctactggcagatctcaaaagcttagctctctcttggcacaccacacaacggaacaccataagcacacaacaacatacaagcagcagcacattacacaatgggaccacgcagttaatacccaattaagcagtgctatcaaaagcagcgacttggatgcgatttggacacacaaagcagtacatctaggcgctcaccacacaaggctagccagtgggctttttacaaagcagacacaccaaataatcccaaaatttaaaaactccagcaggtccagcacaattggaaacccatgaacagttgcgagtactcttccaataaacacttgcgcaattgaaacacctattgcacacacaagcagccaaaacagggggacgaacgtggtccgcaaccccaagggaagcaacagttatagtggaaaccaggaacccaacaaggttcggtgaatttggaggtgaatgggtgaaaggactcaattaagcacaagaggccttattaacttggctaggcaacccaaagtcccggggataatttggggcccagcaatctcccgcaacgctctcaagtgtcagacttcggccacacaccgtggcaattacgcaaatgcccattgctagactttacaacacctccttgatgggattcgcccaaccaggtaactcaaatggcctatatacaggaacattaaccagagaccagcgtgttggaaaacactgagcaaccctacttctggggtactccgagacacacgcgtacttgaccacaaacacattagggagacacccaccgggacacgctaactaaccccggaacacagacacgcggctaaaagtaataccccacgcgccgagatttatgcgaacaccaccaggcgataaaattatagttcgtctttctgtaaaaacaccttaataaacagagtagtgagcaaaccagtacag

SEQ ID NO: 619303 - DNA, 1509 bp, Homo sapiens
  misc_feature (22)..(22): n is a, c, g, or t
  misc_feature (25)..(25): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaggaaaccatagaaaaaaccataagagagacataaatgcgagaagaagtataccattaagagtgtatcaagagcgatggtgggtttgacacaagttttagcgtacaaaagctagctgcttcttaaaaaagattcccaattaatccgaggcggattggacgccgtgggtcccaaactgggtgaaatggaaaacgccgggagggtgccccggaatatgtccggccttcgttggtggtgggatataaaagcctctgcggaaacaggtttgcgccacatttgtgtaggaagctcatcactcagggtaaaaacaaactcgcaatgggcggtgccacacatatag

SEQ ID NO: 619304 - DNA, 299 bp, Homo sapiens
tggtggaaggggaagcaacacattcttcttcacacggcgtcccccatgctgtgctcatgatcgtgagtgagtcttaggagatctgatggtattataaggggctttccccaactttactctgcacttctctttgctgccgccgtgtgaagaaggatgtgtttgcttccccttccaccatgctttctaacttctcctcaagcagctcctcagctctgccgaaactgtgagtcagtcaaatccctttcctttttaaattcaccctgtgtcaggtatttcttcatagcagcatgagactgaag

SEQ ID NO: 619305 - DNA, 304 bp, Homo sapiens
tgagccaggagtgattagtttggaaacagtccaggggcagagagggtggggctggattgtatggagtggggagaaacactgctcagctgggtttttacaagtcagaatgggtatttgaagaggacgctgctttcatcctgctgggttcaaggtcagctgcagatgctctttcattgtttctttctaatcagcttctaagaatgtggcttaaacgctcagctatttccaggtggttggcatcatttattgagttgtctgctagagttatttcatacgctgcctaaaatgactcaaaaaacaaaaa

SEQ ID NO: 619306 - DNA, 1580 bp, Homo sapiens
  misc_feature (22)..(22): n is a, c, g, or t
  misc_feature (25)..(25): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaggaaaccatagaaaaaaccataagagagacataaatgcgagaagaagtataccattaagagtgtatcaagagcgatggtgggtttgacacaagttttagcgtacaaaagctagctgcttcttaaaaaagattcccaattaatccgaggcggattggacgccgtgggtcccaaactgggtgaaatggaaaacgccgggagggtgccccggaatatgtccggccttcgttggtggtgggatataaaagcctctgcggaaacaggtttgcgccacatttgtgtaggaagctcatcactcagggtaaaaacaaactcgcaatgggcggtgccacacatatag

SEQ ID NO: 619307 - DNA, 179 bp, Homo sapiens
cctatcatattgataacgatttgtcacatccatggggccgaattagaacaccttatggtcgccaaggttcgcagtgattttgtagacgctatcgtttcgcctatggtcattgcacctcaaccgtccattacacataagccacattcaggcaatggcgatgctgagacttatcgtccgcg

SEQ ID NO: 619308 - DNA, 1658 bp, Homo sapiens
  misc_feature (22)..(22): n is a, c, g, or t
  misc_feature (25)..(25): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgaggtaagtccagatcctaaaaaaaaaaaaagaaagaaaagaaaccaagtattaaaatagtaacttttgcaatcatttcagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaggaaaccatagaaaaaaccataagagagacataaatgcgagaagaagtataccattaagagtgtatcaagagcgatggtgggtttgacacaagttttagcgtacaaaagctagctgcttcttaaaaaagattcccaattaatccgaggcggattggacgccgtgggtcccaaactgggtgaaatggaaaacgccgggagggtgccccggaatatgtccggccttcgttggtggtgggatataaaagcctctgcggaaacaggtttgcgccacatttgtgtaggaagctcatcactcagggtaaaaacaaactcgcaatgggcggtgccacacatatag

SEQ ID NO: 619309 - DNA, 263 bp, Homo sapiens
cctaagtaaattctcgtccactttcctgttaggaaacacagcagcaatatactttggcagtaaaccagagcatatgatgtaacttgctcaaccttatcttcctttccaaattctatactaatgcatctgactgttttttacgaataatttccatttggaaagccaagtgagacaaacaaattaggacagagagagactgtgagaaacttgtctgcatggctgacggaacacagatgcttaaagatctgaagtggacagtattt

SEQ ID NO: 619310 - DNA, 2096 bp, Homo sapiens
ggagagaagcagtagtcaataaagagagtgccgtatttcgcagatggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagccccatgtcttaacggcagcagcttttttatttattctccaagcatatcagcaaatctctacgtgcaagaggcaaacaggctactggcagatctcaaaagcttagctctctcttggcacaccacacaacggaacaccataagcacacaacaacatacaagcagcagcacattacacaatgggaccacgcagttaatacccaattaagcagtgctatcaaaagcagcgacttggatgcgatttggacacacaaagcagtacatctaggcgctcaccacacaaggctagccagtgggctttttacaaagcagacacaccaaataatcccaaaatttaaaaactccagcaggtccagcacaattggaaacccatgaacagttgcgagtactcttccaataaacacttgcgcaattgaaacacctattgcacacacaagcagccaaaacagggggacgaacgtggtccgcaaccccaagggaagcaacagttatagtggaaaccaggaacccaacaaggttcggtgaatttggaggtgaatgggtgaaaggactcaattaagcacaagaggccttattaacttggctaggcaacccaaagtcccggggataatttggggcccagcaatctcccgcaacgctctcaagtgtcagacttcggccacacaccgtggcaattacgcaaatgcccattgctagactttacaacacctccttgatgggattcgcccaaccaggtaactcaaatggcctatatacaggaacattaaccagagaccagcgtgttggaaaacactgagcaaccctacttctggggtactccgagacacacgcgtacttgaccacaaacacattagggagacacccaccgggacacgctaactaaccccggaacacagacacgcggctaaaagtaataccccacgcgccgagatttatgcgaacaccaccaggcgataaaattatagttcgtctttctgtaaaaacaccttaataaacagagtagtgagcaaaccagtacag

SEQ ID NO: 619311 - DNA, 2152 bp, Homo sapiens
ggagagaagcagtagtcaataaagagagtgccgtatttcgcagatggagctgagctgtggctgccagaagatagcgaactcaagcaccacataccgacagaccgcatgtatgacagtggtcccataaaattataggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagccccatgtcttaacggcagcagcttttttatttattctccaagcatatcagcaaatctctacgtgcaagaggcaaacaggctactggcagatctcaaaagcttagctctctcttggcacaccacacaacggaacaccataagcacacaacaacatacaagcagcagcacattacacaatgggaccacgcagttaatacccaattaagcagtgctatcaaaagcagcgacttggatgcgatttggacacacaaagcagtacatctaggcgctcaccacacaaggctagccagtgggctttttacaaagcagacacaccaaataatcccaaaatttaaaaactccagcaggtccagcacaattggaaacccatgaacagttgcgagtactcttccaataaacacttgcgcaattgaaacacctattgcacacacaagcagccaaaacagggggacgaacgtggtccgcaaccccaagggaagcaacagttatagtggaaaccaggaacccaacaaggttcggtgaatttggaggtgaatgggtgaaaggactcaattaagcacaagaggccttattaacttggctaggcaacccaaagtcccggggataatttggggcccagcaatctcccgcaacgctctcaagtgtcagacttcggccacacaccgtggcaattacgcaaatgcccattgctagactttacaacacctccttgatgggattcgcccaaccaggtaactcaaatggcctatatacaggaacattaaccagagaccagcgtgttggaaaacactgagcaaccctacttctggggtactccgagacacacgcgtacttgaccacaaacacattagggagacacccaccgggacacgctaactaaccccggaacacagacacgcggctaaaagtaataccccacgcgccgagatttatgcgaacaccaccaggcgataaaattatagttcgtctttctgtaaaaacaccttaataaacagagtagtgagcaaaccagtacag

SEQ ID NO: 619312 - DNA, 2166 bp, Homo sapiens
tcgtacagcatgcaattaggggttgccgaccacaataagtaatctgaaaatgataatgccgtgattcctaagatagtcctgtgtacattaatggtatgccctatgaagtatatccgcaccacagtagaatgagaaacgctcgggagtggaaactcagcggataaatggtacatggtccgaaataagagaaggtttggagaggcaataacatgagatcgtatcaaccagagagtggtaagcaatttcgaatgtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagccccatgtcttaacggcagcagcttttttatttattctccaagcatatcagcaaatctctacgtgcaagaggcaaacaggctactggcagatctcaaaagcttagctctctcttggcacaccacacaacggaacaccataagcacacaacaacatacaagcagcagcacattacacaatgggaccacgcagttaatacccaattaagcagtgctatcaaaagcagcgacttggatgcgatttggacacacaaagcagtacatctaggcgctcaccacacaaggctagccagtgggctttttacaaagcagacacaccaaataatcccaaaatttaaaaactccagcaggtccagcacaattggaaacccatgaacagttgcgagtactcttccaataaacacttgcgcaattgaaacacctattgcacacacaagcagccaaaacagggggacgaacgtggtccgcaaccccaagggaagcaacagttatagtggaaaccaggaacccaacaaggttcggtgaatttggaggtgaatgggtgaaaggactcaattaagcacaagaggccttattaacttggctaggcaacccaaagtcccggggataatttggggcccagcaatctcccgcaacgctctcaagtgtcagacttcggccacacaccgtggcaattacgcaaatgcccattgctagactttacaacacctccttgatgggattcgcccaaccaggtaactcaaatggcctatatacaggaacattaaccagagaccagcgtgttggaaaacactgagcaaccctacttctggggtactccgagacacacgcgtacttgaccacaaacacattagggagacacccaccgggacacgctaactaaccccggaacacagacacgcggctaaaagtaataccccacgcgccgagatttatgcgaacaccaccaggcgataaaattatagttcgtctttctgtaaaaacaccttaataaacagagtagtgagcaaaccagtacag

SEQ ID NO: 619313 - DNA, 205 bp, Homo sapiens
ggtgtatgacggcgagtatcccggaacgagccagtgctgtaggaagaaatgttagatgtacgccgatcaatattagtagtgagatggattaaggcgtaggtatgatctagggtgtagcctgataataggggacatcagtgaatgaagcctcctatgatggcaaatacagctcctattgataggacataaagaaagtgagctacaa

SEQ ID NO: 619314 - DNA, 973 bp, Homo sapiens
agcgtgcggcgggcccgcagaggacgctgctttccgcgctggatggaccaagcgagggagggtgcgaggggaaaccggaaggaagaggcggcggcgccagccttcctcggcggaggcggaggcggagaccccaggcgaggcggggcgggagggccattgcccccgacgccgcgccggaggggcccagttgtggactggggccacggttggagcggatcccacacctccggaaccgaggggacggcggcgcccatgtttatgatgtggcctacgtgaaagcaaaacaaaccattgtacaccttgaggaattgtcgaatgctgccaccctttacagattaataatactttatgcatacaccggggtaacttggcaattgaatgaccagcactgttagaaccaggctttagtgaaaccagcttgctttcctacaggtagaagatgtgtaccaccgttctgtcgacaactttctccttcaccacacctactcagtgcgaaccactttgtgtccgatgttgagtttgctgatctctctcacttgtggaggaattacccaccgacgtgcttaacaacgaattggtggaccccactgttcacctgctgtgtatccatcaaggcacgcgttcaatgccagctggtcacagtgacgcttacgttgataggaatattcctcgagtaggtgaccaactctacagtggctcgaacggggaaggaacacccggttcgtagaaagctgcaatggctgttcggcttgaacgattaacaacggaatccggacccaggatgttggctgttggttcttagcccgaccataagtttttgctcctttccaagttcaaccagtagcgtgtgtccgggttgcgcccataaaacctccaggtgctacgcctgtgttgccttcgcacatttacaacacatgttagcataaacgaggtatgttcgtccgccactacactgttgtccttgtttgtacca

SEQ ID NO: 619315 - DNA, 191 bp, Homo sapiens
acctcgaggatccccaaacacgcaatctgaacagttctttcttgagacagactatactgagacacaagtagtcaccagcagaagatagataatatgactttattatcttgatgaattaagcttaacaagagggtatttgaagtgtactatttatcctaacactttctgtgtctgggtaccctcttcagtaa

SEQ ID NO: 619316 - DNA, 135 bp, Homo sapiens
acaagcatcgactattactttatttatattactatgctttagttacatgataaagactacccagcagttctgtcccatctcggagaaagttccctagtcaacaccaattattttgtgacaaattactaggaatgg

SEQ ID NO: 619317 - DNA, 112 bp, Homo sapiens
aatggcaacgtcacattgcggggatggttctcttttcatgagataacaatggaggttacatttgtgtgtggccaattctgagtctgcgagtgagggacacttgttgacttct

SEQ ID NO: 619318 - DNA, 835 bp, Homo sapiens
  misc_feature (309)..(309): n is a, c, g, or t
  misc_feature (320)..(321): n is a, c, g, or t
  misc_feature (327)..(327): n is a, c, g, or t
  misc_feature (334)..(335): n is a, c, g, or t
  misc_feature (338)..(338): n is a, c, g, or t
  misc_feature (340)..(340): n is a, c, g, or t
  misc_feature (343)..(343): n is a, c, g, or t
  misc_feature (361)..(362): n is a, c, g, or t
  misc_feature (442)..(443): n is a, c, g, or t
  misc_feature (446)..(446): n is a, c, g, or t
  misc_feature (463)..(463): n is a, c, g, or t
  misc_feature (518)..(518): n is a, c, g, or t
  misc_feature (523)..(523): n is a, c, g, or t
  misc_feature (571)..(571): n is a, c, g, or t
  misc_feature (772)..(772): n is a, c, g, or t
tgggtcagttgcgtcataggatcatactctgagtagattatgaggtcgtcccaactgccatgggtcgctcgtgtccttctcgagtggtcaacgactcctggggcttgactactaacaatccttgctagtgcagcaactattgttgctatgtaatcatggtgtcccaaacgtgcatctagtctcagcccttgtctcgtaggcctttcacctttgtctggttcttcttggtacctttgttctagttcagggtttttatcctacccttggagcactattacatgagggcagacttccccccgtcgccaattntgaatctgtcnntgcacngggcccnntgncntanggatgtgatgaccaacanntgcacgtcaatgagccagcctctcttttgcgcgggaatcaagcatgtgcttcctctagactacagcagccgaaacgggannganacaatctgactgtctcnactggcagcatgaagcccattctaggtactatgcaaagggcagaggactgggagncttgnacgcttagctcctacaccctgtcatacctcaccggggcactttcaggngccaggggcctctgaagtctctaggcctatatgggacaatcaattctgactagagctcccccattcccctcgggtgaggtagactgttatttttgtagctgagaacgtggaatcccacgggtttttactgcccttcacccaacctctcccacctccaccccacatatgaatgtatttattgtgagaatggctacacttctntaggaatgcccccacttacaaccaggtgggtggaacaggtaacgaccaggtgggagccttggg

SEQ ID NO: 619319 - DNA, 107 bp, Homo sapiens
gctctttccagcaccttcctgcattagtgcagcagttccccagtcgttccatcaatgcccagcccacaccgtttgtggcaggcacacatcagtcacacctccaagca

SEQ ID NO: 619320 - DNA, 151 bp, Homo sapiens
  misc_feature (13)..(13): n is a, c, g, or t
  misc_feature (42)..(42): n is a, c, g, or t
tcggggctcacancacagggtaaaaatggttataaggcgcgntcacaaatattgcgcttgtgtaaaacacagtatgtctttaaaagcgacagactatgctgcgtaaaagagctacatacacacatctccccaaaactctaaaaagataccc

SEQ ID NO: 619321 - DNA, 122 bp, Homo sapiens
agacacagaggaggtggacaggacagagggaggtggagacggctccttcacatggcaaagtactgggaagccttccttcctgaggcaaaggccatctcctaatggaccaaggaccccagagc

SEQ ID NO: 619322 - DNA, 205 bp, Homo sapiens
gtagaagcccaagttgagaacaataatgaacaatgattgtatgaacaattgttagaaacagctaatcacaaacaacctgcgggcacaagtgacctcattccacacgtagcaccctatcagctaggaccctataaaactttcctccagaaccttgcctctgttgcaggtagaccctaactctgctgaggctgtccacgtgcaacat

SEQ ID NO: 619323 - DNA, 297 bp, Homo sapiens
gagacgcgtgatgcaatcaaatgcgagaacgaatggagtcacatgggtaaaccatgaatatacgagatctctagtatcagggaggatgaaatcatatgcgttattgaccgtaaacctggttattatactactggtaatggatgaagcctatcattaagaaagttagtcgtacagcgtgggtgcgcatacagtcgcgcgatgtagggatacttgacccagcatatgctcgccaggaacttttgtaccgatggctttaaatgctcgacgcaccgataatggcggcgagccatcggccgt

SEQ ID NO: 619324 - DNA, 469 bp, Homo sapiens
cctcgtgttcggctgcggatacttatgcaggcgccatacccaatgcaagatgcagagcggttgcaaagggaaaactgtggtacgaacgtacaggaatgtcgcaattatgaaagtttcgacacaaaagtgcctgtttggagggttttttcggtgcaaatggcgcaccaaaaaagcccagccgaggcgtctagcgcactcggttggggcgcggctgttacttatctagacccacaccgtagaacggcgttagcccaaacgggctgatcttgaagtcacgcacttgcttgcgcataggctggaaaaccgtcgagttcgcaataggcgttataggtacttgttccttaaggattttctgtgcctgctgataccacttgatgcgctgctcgcggtcgctgctgaccttggttgctgcaccagcttgtcataggccgggtacaccagactctgggcatcattcacgggtaccgag

SEQ ID NO: 619325 - DNA, 391 bp, Homo sapiens
ttacggggagagagaagcatacactccaggtgatgcgtacaagcggagaaacaaggtctgtgcatgccccatgatcctgaggaacggagatggatgaatgtgagcaggcgctggctgatgaccccaaggccaatgaccccttcgctcacctgcccaaggagtacctttgtgtaggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctta

SEQ ID NO: 619326 - DNA, 727 bp, Homo sapiens
gcctccggttgtctgtgttcctactttgcttcagtgtttttcacttgatcaagggagatgtatgtcgtgtggttaaagtgctagtgtactagccataaggtaggtgctataactttggggcgttatggaactgcttgtttagcagttggatacaatgtgccttgtgtcctgcacgaatgagtcaattccttgttgggtgatcaggctagatgttactgtttgaggagatatgatgcgtgaccgattacttactttctagaacgccgaatagactagcgtgtcaaaggacgatatttctcagtacataaagtacgatgcacttttcatgtctaaagagagtatgtcttcagctgttccttcgtttgcttataagtctctatggttgtgcactcggtgaagctcagaacgtgtagttctgttggtctagaattgtacccgtagattcttatctaatgtctgcagtagcactgaatgtttcgtgtgcaccgagaattctacatgttgaaatctcatttccaactgtgatggtatttggaggtggggcttgttggtaagctgataggtcagcgagagtaacagcggctcatgaatgggattagtgcccttatataatagagacccagagagctccatcaccccttctgccatgtgaaagggagaagacaatacatctcacgaagccaggaagtggttcctcaaccagaaaacaaatcctgtaagcacctta

SEQ ID NO: 619327 - DNA, 295 bp, Homo sapiens
tgaaaaatgaaattaaaggggggcaaacatgtccaaggaaaattggggggatttgacccctttatgacccttgtgaaaaatgaatggggggaaagggcgactaggggccaccaaaccaatattggaatggtggtaaaccgaggaaaaagtttcctcatgttaaaacccttggaacgggtataaaaaagggcggttcaccaaaaaaccccatgccctctccccaaagggcctgttttactataaggtaaaaattgggtcagggccattttcaaattagcctttttgttaaaaaaac

SEQ ID NO: 619328 - DNA, 175 bp, Homo sapiens
atctcccgggttcaagcgattcttccgcctcagcctcccgattagctaggattaccggcacctgaccagcatgcccagctaaattaaatgtaaagatagggattctcccctctgatacctctttataataaattatatttttttatttataattataataaaaaataaaaataat

SEQ ID NO: 619329 - DNA, 203 bp, Homo sapiens
agctggtaccgtgagtgagtggtgactctcaactcactgcagtcgcctcctgggttcacaccattctcctgcctcagcctcccgagtagctgggactacaggcgcctgccacctcgcctggtaattttttatatttttagtagagacggggtttaccatgttagccaggatggtctcgatctcctgacctcgtgatccaccca

SEQ ID NO: 619330 - DNA, 661 bp, Homo sapiens
  misc_feature (3)..(3): n is a, c, g, or t
  misc_feature (78)..(78): n is a, c, g, or t
  misc_feature (84)..(84): n is a, c, g, or t
  misc_feature (88)..(88): n is a, c, g, or t
  misc_feature (110)..(110): n is a, c, g, or t
  misc_feature (139)..(139): n is a, c, g, or t
  misc_feature (141)..(141): n is a, c, g, or t
  misc_feature (152)..(152): n is a, c, g, or t
  misc_feature (180)..(180): n is a, c, g, or t
  misc_feature (191)..(191): n is a, c, g, or t
  misc_feature (200)..(200): n is a, c, g, or t
  misc_feature (240)..(240): n is a, c, g, or t
  misc_feature (269)..(269): n is a, c, g, or t
  misc_feature (355)..(355): n is a, c, g, or t
  misc_feature (433)..(433): n is a, c, g, or t
  misc_feature (502)..(502): n is a, c, g, or t
  misc_feature (505)..(505): n is a, c, g, or t
  misc_feature (575)..(575): n is a, c, g, or t
  misc_feature (631)..(631): n is a, c, g, or t
ggnaaaatacctggtattacaggccccagtacctttctactctacaatgaggctcagaagcccagtgtaccaccccanccccangtgnggtgcccacatagaccagaaancccaagttccaatagccaacaggtctgtnanttcagggacancggttgttaacaaagaagttggtgagantgaaccactantcccctgantttttttttcctttttttttttttttttgtagacctaagntcctcacctccttgttcccccaggctggnagtgcaatggcgcgatcttggtctcactgcaacctccgcctctacaggttcaagaagattctcttgcctcagcctcctaactgggntaacagacacctgcaaccatgcccggctcatttttttttgtatttttagtagagacggggtttcaccaagttggcccngcagggcccgaacacccgaccccaggggttccgcccgccacagccccccaaagtgcagggagtacaggngtnagcaccgcacccggccaaaatcccgaaattaacaaggaaaaaaaatctgtcaggtgtgagaactttcctnaaagatattttttctggacatctctctctactgactgaaagggtgaggctcagaanaggcttcttccaagctcagagaggctgaga

SEQ ID NO: 619331 - DNA, 215 bp, Homo sapiens
gagtgtgtacagctccatggttgatctggttgttgatggctgtgcctctgagtcctggtggtagttcttggcgcacctgcgagttggacgcggtcgtcatggcggcgactaagtgagaggcggcggcggctggcgaattcctggcaccaccacgacgaattcctgtgcaccacgacgacgaattccagcgactgacgacgaattccttgcgctgt

SEQ ID NO: 619332 - DNA, 355 bp, Homo sapiens
aaaaaaaggattttttaaaaaaaagcctgcaaacccaggttttcaaagtggggttggccaagtccatcccccacgcttgggtgttgatcccccagccccaaataagggtccgcaaacaggtggtgaaaatcccgtccttcattgtccgcctggattcccaaaagcaaatggatttttttttgggctctccctacggggggggccccccgggccgggtaaaaagaaaaaattccaaaaagggccagggtggggctggggttggaacccacaaggaggaggattaagtccccctgtccctcctggggtggtggattgtttcgttttccccccaaaaaaacaggatcagcgctttcca

SEQ ID NO: 619333 - DNA, 110 bp, Homo sapiens
tagtagtgtcagttcgagaatgctcttcctttgttcactaacatttcacttaggggtgaaggcgcttaccctgtcgtatgtcaggatgccaggggagttgtcatctgcag

SEQ ID NO: 619334 - DNA, 387 bp, Homo sapiens
aagcagcagaatgatgcgaagaagaagtggaaacctgatagagccatcaaggtctcgatgagactgtatgcactatcagtgagaatagcgactggagtaaaggctggtcccgcagtgtttcgatgacctcccccgaggtccctcccacaacacatgggaattctgggagatataattcaagttgagatctgggtgggtgcacagttaaatcgtatcatgtccctagtgtactgtgagaaaattgtcacctcatgtacccagcgtgttcagatgaagctctgatcttcgagtggaagggtgtctgtgctgagcagatgtctagatggtcgatggccccttcacgtgtctgagcctgtcatgtggtgctgtgtcctccatctggcactg

SEQ ID NO: 619335 - DNA, 232 bp, Homo sapiens
tccccactaaggtacaactgtcgccattttcagactgatgaacaggttcacacccaaataatttgcggtgtgtttttagggtggtggtggtgttaatcttatcactggccattctacacgagtgctatctgtgtacgctctgtctaccagtagtgaaatatccaacactgcaaccagcgaacatgaactctagctggaaatgcattctcagggctgccccaggaccgtgtgt

SEQ ID NO: 619336 - DNA, 396 bp, Homo sapiens
  misc_feature (159)..(159): n is a, c, g, or t
  misc_feature (162)..(162): n is a, c, g, or t
  misc_feature (180)..(180): n is a, c, g, or t
  misc_feature (190)..(190): n is a, c, g, or t
  misc_feature (198)..(198): n is a, c, g, or t
  misc_feature (201)..(201): n is a, c, g, or t
  misc_feature (373)..(373): n is a, c, g, or t
  misc_feature (380)..(380): n is a, c, g, or t
  misc_feature (384)..(384): n is a, c, g, or t
attcactagtaatgttgactctctgaggtaagagttataagataacaatgagattccaacatcaaaaacctaattcgtctcagcttctcatactaaaacagctagggtggaggagcaaaatcgtcttaaagtagcataacccttttccctgttttgaanatnaaattaaaacaaaagttnaccatgaagnaaaacggnagnaaggtgccaggggaacccccgtcacatttttttttcaacttcccgtaactcataattatctcgagataaaattttaaaagatagcatcacacatcaaaatcttgtactatttggtacttaattcatttttctttttttaaagtgtagcttattggactgagaatggaatttnaagattnaaanactacgcacaaa

SEQ ID NO: 619337 - DNA, 108 bp, Homo sapiens
gatatcttcccagctgtgcgtgcctttcggcgtcatctcgttggtgatcagcgccgagcccctggcgtcgacgaacggaccggtgggcgaatccgacaccgcgaccgc

SEQ ID NO: 619338 - DNA, 110 bp, Homo sapiens
ttccccccccttttttttttttgggggcccaggggtttggggtttaaaaaaaaggttttttttttcccccccccccccaattaaacccccccatttgttttgtttgggga

SEQ ID NO: 619339 - DNA, 906 bp, Homo sapiens
ctgctgctttggcatgacgttactaacgcggctcgatcgggttttctgtgtggcggccctgttgctgccttccttttctggctgttctttccttacgctcttgcggtcgcggcgcttccgcgtattccatcccagccaagcttttcttagtagttgcggttgtcgccctacaaccgtcttgcaggtgttcctggcggtccccgcgggttttatgcccctcccggcctcacactaggttgcgcatgtccacctagtccgggacctcgcaatcttttgcgaccgcctttggctgattgcacactaaagcgggtgacgacttactcccggcacgggactgaggattacacttcaatattgaggatccagctacggtcgtcatgaagaccctgactactgttcagggcattgcagatgattatgaccaaaagaaacttgtgagaagctttctaaaagaaatttgcctgtaatggtactgttgattgaacatcctgaatacggagaggttattcagcttcaaggtgtacccaagaaaaaacatctgcccgtttctcttggaggttggcattgtaaaggaggacagcttaaggttcatggattctgaaatgtacctaatacgtggagaatttcttgaatagttttgttctctaaacccggtttggctgccttgtgaaatgattccctgcagtaacggacttttcatttatttaatcattgcgaacttccattcacatctgcatgattacagatacactggggtatgtagactagtacacataagaaaattgccgtaagatggtaccaaacctcatattgtctttacaattggttcccatggaaaatgttttgagtgtttattgttccgtttattacgtttcacttgattaaattttttttgttgttgtatta

SEQ ID NO: 619340 - DNA, 898 bp, Homo sapiens
gcccctcgagtgatccgagcctgtgctgcgcatgtcaacctttcagctgctggtagctaggggaaccaccgaatcacttcatatagtatgacgccatagcataccgttgaggtcagccagagttgtcaagtttgacttccctcgcgtgggacacctcagggggcatagctcgataggggcttgtggacaaagttggttggatcacgaaaccttcgtgaagcgccaacatgttcctacgagagagaggctagactctccggggagattttaagctattagtgatattacagagcctccagccgggggcaagctataacctaacatagatgtagcagagcaagaaccactaggaagtgtcgtagtgcgagcccacttcatcgtaggggctagctagcagattgacagtgggcacagagtggtagggaaatgatcgctctctcttcggtcggcgatacacttggctgcgcatttttaggcactccttggtggagccccttagtcactcatgtacgggcatcatgcgatccatttaaggaacaaaaatctttgaaggaggcaggcactaacctttttgtagtttgggcgtccctgcatgggggcaaggtatagcaacttggtggctcaaatatggggtccacctagcaacaggaagaggcttgcgcgactgcttgcggttagaataccattgtagcgtaagaattgtaggggtaccgagacaagggagatgcatgacacatgcctagttgcattgtgccgtaggtttcggcttgtttccacaatagcagacagacctcgacttagttgccccaagagacaccctggatgctcgtcaagaagtggtgtccatcggaccgtgattgaacttagaaatcccgggaaagatagtaccccttgactt

SEQ ID NO: 619341 - DNA, 1123 bp, Homo sapiens
ttccactttgtcccttctccttccatttcgcgtcttgttttgtcgtgttactctgcccaccgccctctgctcactctgctctcgcctctctctcggtcgtactaagcttgtgtgctcttactcgctcgcggggtctggctccgtggttcaccccttacatcgcgttctttgtcttattttacgtgttcctgtcttagtgcctgtctcgggttttgtgtcacctccttgttcgtcacgttttgtttggtgcgcactgctctgctctcccgtgtcccaccttgctcgttttcggcgtcacggaagtaagtaaatgaatcataaccagtaaaatgtggctctgatggagggtctatagctcccaaagtagtaacagagcaactctatgaaatactacagatgcagcaggtaatataatagctagactatgatagcctactacccctggatactgtagattaaatgcattctcttgcccttagctgagatccagacctgtccttagacgagatcacagtccagtggacgagtcactctatggcaggaaagtattcatgtattgcccttacaggcagcactagctgaatactccgaacctctggcaattatctggaacccagcattctagaacttgcctggtatacccaccctctggaattggcctgtatagagtgcctgtagaaggatgttcatagtgtgaaatgtttcagtcagaggaactgctactacagcaaaccacatagaggtgagggtgccacggggaagcggcctggtgtctattgaaactgcaaacacagatagccagcctactggagagtagctgcacaagctgcaggtacaccctaccctagtaagctggccagaaggagggagcaaaaccttttctctctgctaacatctttcctagtttcctctactggaaaagcttcattgccagctgacaaaaggaaaaatacgttaaagtggactcacgatccattttcacagagcagtcaataatggtgaatttggagatgataagcaacaaattgatgaactggcacaacttcctagctactttcgttgacttgtaatgcctagatagggtataggaaagttattgaaatactgctgtgtgcccatgaaa

SEQ ID NO: 619342 - DNA, 241 bp, Homo sapiens
ttttataccctacagtcagacaggaaaagaactgaaaatggcccccttttgacattttgaggcagctggactggcagccaagtaaaggaaagtgattaggtggtgtggggagggtggggaggcagcccaagggtgctttccccagcaggtaggagcaggcaggagtggggacaaagggaaagcttgtgactgggacagtgaaaataaacgattggcttttatcaatcccttgcccccccca

SEQ ID NO: 619343 - DNA, 432 bp, Homo sapiens
  misc_feature (29)..(29): n is a, c, g, or t
  misc_feature (67)..(67): n is a, c, g, or t
  misc_feature (132)..(132): n is a, c, g, or t
  misc_feature (163)..(163): n is a, c, g, or t
  misc_feature (172)..(172): n is a, c, g, or t
  misc_feature (258)..(258): n is a, c, g, or t
  misc_feature (273)..(273): n is a, c, g, or t
  misc_feature (278)..(278): n is a, c, g, or t
  misc_feature (339)..(339): n is a, c, g, or t
  misc_feature (421)..(421): n is a, c, g, or t
aggaaaactgtcccagggcggggagcggnatagggcccccacatctcagactctcctaccctcaagnagttaattctcaccccctgccttcctctgtcaacggtgggggtgattccaataactcttctcagnttccatacttcaggtgctcttcgtgaatgcngggtggctntaacccttgggggtcccagacaagtgttgcgcatgaatcccactgtgcgcaccattgctgctccccaaagaatgtgtcccaagtanaaggttgtatagttnccgtngtttttcacggcaacacgggcataagcagcaattatcgcacgaagtttccctagggtggtnggggatccgtctcctgccactcctggggcccttttttgtctgccttaaggtcaatgctacctgttttgaggtgctgtgtcanggttgtgggct

SEQ ID NO: 619344 - DNA, 198 bp, Homo sapiens
gagcagatctagcaggagcttaattctgcacccaacagccattctgccagggtttctaagtggaaccccagccctcggccggactcctcactgcaagaacggggatgctttccctacccaaccatgcagccccgggcccctcatgaggccactatgtgcccagggaaagggaaactctaatccgcgattataaaacac

SEQ ID NO: 619345 - DNA, 171 bp, Homo sapiens
tacgagcggtctcgtgtaaagagcggtctccacggagacggatgctgatctcgcagctgaggtccgcacccctctggctattccctgcgccatgccagtggagtctgctacatgctaatctgaccgtgttgttcctctgcctaaaaccttgacctggctccccagtgccct

SEQ ID NO: 619346 - DNA, 320 bp, Homo sapiens
attgcctgccaaaccacaggaggctgaaaatagctgaagaactgcctaaggaacctcagggcatcatagcttgctgcaacccagtaccgccctttgggcggcagcggatcaacgaaaggcaccttttaatccagcaggcccgagagatgcccctgctcaagtctgaagttgcagccggagtgaagaagagcgcaccgctgcccagtgctgagagattggagaatgttcttttgggacctaacgactgctcccatgcccttcgggatggttatccaatcatccaaaccagtggatctgtgccagttcagaagcaggcgagc

SEQ ID NO: 619347 - DNA, 392 bp, Homo sapiens
  misc_feature (203)..(203): n is a, c, g, or t
  misc_feature (205)..(205): n is a, c, g, or t
tcacgtattaattaacaactccctgttgctgtttgaaggctcattagccattttaagataagtcccagcgcagcttgcaccatggcagagtttacatggaacttagagtcagtatgatgcgaaagtctactgagtctgagttcttacctgtttcacctcaaagtgattttgagtatacctcataagctgagaggagtagtganantatctgaatcattacctgttggtttactgacacttaaagcctgtggtacttgaggagtagagtaatagggcaagagaaatttaattttactatgtagataaagaatggggcaagctgtagtaattcctttatttttaatcgaggatttaagttatataagtacacattaagattctgtttttattgc

SEQ ID NO: 619348 - DNA, 411 bp, Homo sapiens
gtcgacatcgtcgccatcgcccctgagctgctcaacggtgtgtatggcgggaccaaggcttttgtactggccttcactcagtccctgcatcacgaactgagcgaaaaaggcgtcaaggtccaggccgtattacccggggcaatcagcaccgagttctgggatatcgccgggttgccgatacagcatctgcccggtgagatcgtgatgaacagcgaagacctggtggatgccgcgctcgccgggctggctcttggggagctggttactatcccgtcgctgccggatattgccgattggcaagccttcgaacaggcacgccaggccctgaagcccaacctgtcgcatcaggtgccggcggctcgctacacagtaaaaggctgaccttgcaacctgccaccagactcggtcgac

SEQ ID NO: 619349 - DNA, 751 bp, Homo sapiens
  misc_feature (120)..(120): n is a, c, g, or t
agactggagtgcagtgagctgatatccccccattgcactccagcctgggggacaagggtgaaattccatctcagagaacaaagaaaaaaacagaatgttgttatgctacttgtcactgtngggttttttttttttttgggagatgggaggtctcgccctgttggcccagggctgggaggtgcatgggcttggatcccggccccctggcgggcctcccgactccccccgggttcaaggggattctccctggcgttctggctctcccggatatagctggggatctcacgggcacttggcgcaccacgcgcccgggctaattttcggggtaatttctacagctaggagaatggggcgcgtttccaccacaatgtgtggagccacagagaagcgcgcccccgtgcgatccccctgtggaactctgcggcgcaatctcggcccctgccctcctctaaaaggtgacatggggccattacgcgcgggtgtgatggaaggcctcaaccggggggtctccccgagggccaccagaatctctcactcaaatcggaacgaagaaaacccaacccaacaaacgtggggtgccacaagttgcgcaacagcaggggaacacacaagggccagcgaggttacacgccccccacaaacacttaacagagggacaaaggcgccgatgcgacgagctgggcgggggacaaccaacaccccaaaaggggcgccagaggaggcatgtaaagaacgaaccaaaagaccacgg

SEQ ID NO: 619350 - DNA, 944 bp, Homo sapiens
tggggtaaagttggttttttctaaagaaatttgcaatgcaaggtctccttgaccccttgccaaaccctgaaacagctggcccgtggggtccccgtgttttcaggggttctccgggaccacccattgtttctcccacaacccgtgatgcgctgacattccctttagcaccagttgtcccacctccaggttcctgaccaggtcagagatgtccccttgccatgcaaagaaggaagcctcagtgggggccgtggagtgtcccgtgttccagcctgtgccgagggcacgggtttcatcccgtggatactctgtggcccaccgaagaatctgtagccagtcaaaggaggaggaaaaggagcccctttagcaacaatggctgcaagatattcagatcagaagttgtgtctccttgtggcttcaaacccaagagaatatccctgcagggggcctataagcatttccaggggccggggcaagtggggaagccaccaatccctttacaacaccgaccaccaattaaaccagagtgtggggccttcgtgaacatccgcgaatactaggtgctttgacccccaatactacaggggaaccatgaatgttcaacagataaattccagaaaggacaataccacaaaagaggggacaacatacgctggtgaaaaaaggaggcaacactggatcttcgagaggcccccgcaaagaacaatgtgattcacatgggcaaacgaatttgacaaaacaacaacaaccatagcccgtgagtatgggttccacccaaataggtgattaccacaaccaaccagatggattcggatccgacaccatatatcgacaacatgacgaggagaaaacggagggagagaataatactcgaggacccacgcacaagtagacgaatggaaaatcgagggagaggtagagaaacacatcgaggggaaaatagagag

SEQ ID NO: 619351 - DNA, 140 bp, Homo sapiens
tcagctcgtaccccacattacaaatgcttgtatatgaggttaaagaggggctgtgcgtggatatcatgcatttgccattcctggaatcaatgaatcctgagtctgggcaatgaaaccaaatgccaggagttgactggggt

SEQ ID NO: 619352 - DNA, 421 bp, Homo sapiens
ggtagcttcaggttgacctgcttatcaggcctacgtcctttttgatttaagtacagctggaaagtattatctaattaagttcatgatagtgcttttggagaacttgtcaaattacagccaatgagaaaataaggacctagcataccgtggagaaccattaaaaatttgagaagaaaccaccagtattatgtccacctacctccaaaggggaagttttgggaatttaatccagtaaagattcccctgttttatgattgttccttgaaagtcaaatgggggacctgtccattgtgctctattattctggtcaaaaaccggtccccaaaccaaaatttgagtttgcccttgttctagaagttactgggtagttgtaagtataatttttattaaatataatgtaaaataaaatgttaagagactt

SEQ ID NO: 619353 - DNA, 353 bp, Homo sapiens
gcctgggtcctaccccttccaattatgggggggcaacgcccctttttccggggacccctttttcggaaaaaactcttccctttttttaataatttcccccccaaattcctttatttttacctttccaggccccgggcttattatttttttttttttttttggaacccccctttttccccccttggggttttttccccggtggggggaccaggccggaaggctggaggggggggcaaactttttttttttccccctggggggggccccttccccacttcttgggcttattttcccttcccaccccctgggggcccttaaccttttttttctcccccctcccccaccggtttgga

SEQ ID NO: 619354 - DNA, 307 bp, Homo sapiens
  misc_feature (2)..(2): n is a, c, g, or t
gntctctaccggggaggcgggggaggaggggtggagtgtatgggtggagagcgtggattctgaagcccaatggccggggctcaagtcccagctcaacctcggccactggtctgtgatctcagacaagttatctaatacggcggggcctcagcgtactcatttatctaagggggataaaacagtaaatacctcataggttggtcatgtggactagataagttagcaaaggtagggtacttagaacaagtccgggcacataatagggggttcgcttacaaaagttcaggtggaagagaaaggtagagag

SEQ ID NO: 619355 - DNA, 544 bp, Homo sapiens
gttggaacaaatgctgttttttttaatagctcttttgggcagcaggattcgaccggtgcaacctccacaatgatgttttgaaaggtggacttcctctcataaaaaactccgatgcggaaaatgtgaaatacaacagggatagaagtcccctcttgctcacttgtaagattgttgaaaccagtctatctgagacaaatatcatcaccttctagaaaggaatacatcgctatagttatcgaagagcgtgccgattgcataatatatgcgagaatcgcgggcaacaaaaacgcgctctatctgataaccctttaagacaggagggactacgtgtgatcgagagttgataggatgatgagcggtgaaagatcgatccattctcttatcgttcacattggtctgtgcatcctagaagtcgaaaatctgccgactgagcactatggctctgtgaagcaggctctgaccttcgtacttatgtggcgcaaggagcatattgactccttgctgtatagagatagtttcaataagctgtgccctgctttgcatg

SEQ ID NO: 619356 - DNA, 680 bp, Homo sapiens
  misc_feature (516)..(516): n is a, c, g, or t
  misc_feature (533)..(533): n is a, c, g, or t
  misc_feature (596)..(596): n is a, c, g, or t
tcagtggaatatttgattcaattaggggattaggattccagtaaactgaaaccttgtccacagggattaccacagtgagatagtggaaaacaagtggaacagaaaggatagctcatgcctatgagcgttcaggcaaaaagagaagtgaataaatagaagtaatgagattaaataagaaatgatttcatagatttctatttccacagagccagaaagaaaaatcgaggaagatgagcaaatttagcaaaatagcaagaaagaagaatagggagatagagaaaaaaaaaaggagagagaatgaagcatcaagatggaaaatacagccaataagcccactattgtgatcattattttttaggtgtggtatcctgtggtagacattcaacttggtgctccttttctcattacacacactgatcagtagtggtcctagaggataggatgaggcagttgtttttggcacattgtagaaggtgttttctcttctctgcctgcacaggtagatccacacccctntctgtgctccttccttnccacaaactctgtacatacctctcttttcctctgctgctgcatttacccagtccaaaccaccnagatttgtaaaagataatacttctgttggtctttaggtgaatcaagatatcaacaaattttgtctacaggtttgctttgctcac

SEQ ID NO: 619357 - DNA, 146 bp, Homo sapiens
tctcccacctcagcctcctgagtagctaggactacaggggcacaccaccatgcccagctaattttttaaaacattttttatagaaatggggtactgttctgtcaccaaggctcatcttgaactcctgggctcaagcagtcctcccg

SEQ ID NO: 619358 - DNA, 121 bp, Homo sapiens
atgagatgtaagctcttagcttactgttccagcactatgcatgcctgcttgctgctatgttctctgccatgatgatcatgaatggactcaccctctgaaactgtgatgaagcaagccccag

SEQ ID NO: 619359 - DNA, 523 bp, Homo sapiens
  misc_feature (185)..(185): n is a, c, g, or t
  misc_feature (190)..(190): n is a, c, g, or t
  misc_feature (194)..(194): n is a, c, g, or t
  misc_feature (211)..(211): n is a, c, g, or t
  misc_feature (248)..(248): n is a, c, g, or t
  misc_feature (280)..(280): n is a, c, g, or t
  misc_feature (341)..(341): n is a, c, g, or t
  misc_feature (363)..(365): n is a, c, g, or t
  misc_feature (413)..(413): n is a, c, g, or t
  misc_feature (419)..(419): n is a, c, g, or t
  misc_feature (489)..(489): n is a, c, g, or t
gtttatcgactgccacatctgcatgtgtcattcgtccacgtgtgagtcgtccacgtgtgagtcatctgcatgtctgtcagtcgtccatgtgtcagtccacatgtgtgtcagtgtctacatgtaagggtcagtcatctgcatgtatgagtcagtcatctgcatgtctgtgagtctgtcgtccacangtatnagtnggtcatccatgtcagtngtctgcgtatgtatcagtcatccgcatgtgtgagccngtcgtccacatgtcagagtcagtgtccacatntgtgtaaagtcagtcgtccagatgtgtgtgtcagctccagggccctctcttttgatgcatngatctgcatatctgcctttagnnnagtactgtcctttcttgactgatgtagctttacagtaggtcttgcaanatcatntttctcctcccaaacttgatactgctattctcctatattttacacatatatatgttctgaacaccataanagccctgtagttattctgtttgaacagtcagtgg

SEQ ID NO: 619360 - DNA, 88 bp, Homo sapiens
tctccacaaggcttcatgtggccccttatagggcaggcctgccctctgcgaaggtcccttcatgctggaggcacacagctttaaggaa

SEQ ID NO: 619361 - DNA, 870 bp, Homo sapiens
aacaataacatagcaacaacaccaattaggtcatgtacgaggctcgggtgtgtatgaatcccatgcggtgacagagtggagccatggctagatggcatgaagatgtccaatgccccgcgcggtggagtgcggctggcggctgtgctgtgctgtgctgtgtggcagctgacgtgccctgttgccctgtgagatggtgtgagctgtgatgtggtgcccggggaggcccctgcacctgactgtgttgttgatgaactgtatttacctgtgtgcagtcaaatgatctattcctacatgagccctgaacaaatgctctggaatgctgtttcccccttcagtgaagagaactcatgttacacatcacgaatgtcaaatgccagtggtgaaaccatatagcctggaatctacagtgaaactgatgaatgatgaaaagaaatgcttgggaatcgcatgtactgtgatgctgccatgaatgtcctgagtgaacatgaagatcaaatgacgccatggaaatgtgtcccctgtgtaccttttccaaaccaaaaatctgaatgcatgcatgaacctccaaaagactccaccctcatcttgtgattccaccaatgcagccatctgccaagcaatgccctgaaaaagcccatcaaggtgcaaacatgtgcccccctgaaaaaaagctcatggaaaaactgcaacagaatctgcagacttacggatttctaccctgtcctgaaggagctccagtgaagagcaaaagccgagctgcagtctgaagaaatggacagaatagatgattgtttgaacgtgggcagtgagatgcatgatattgcctcatcgatggcaggcggggtgtgttcccccacagttcccgtgtat

SEQ ID NO: 619362 - DNA, 258 bp, Homo sapiens
gaggacacctcacagaaccccactcccagcccagaacttccagatccctggaacctcatagggaccaactgggactcattatggaagaatggggtgagcggagaaatgaggaaagaccctcttatttgtgattctctgtgtacatgttgctgtttatagttgcgcggcaagtgggggaccatcccccttctcaccactgttcctcttgcacgtttaccctcattcatgtggctgtacttaaccttctccgcgctcgaa

SEQ ID NO: 619363 - DNA, 90 bp, Homo sapiens
gcttcgggccttctgggcatgtctgccgtatggctccaggtttgtttttctccccgggactctgacggggagggctcccgtcatctcctg

SEQ ID NO: 619364 - DNA, 289 bp, Homo sapiens
cccttaaaagaaatgaaactatcctcataaggcctgatggctcacaccatccaggagatctcctctgctaccaactcccagcagctgattcagcggtccttcatgaacaataggcaactgaacaagaaaatgagtttatattgttcaaaagaaagaagaatgcctcttttttcccttgaacaagggaggtggagactaacaaaagattctttgcttgaccaaactttagtcaggcttctaaatcttcccctcggcccgtctgtgcacttccttgtgaaatccagtttta

SEQ ID NO: 619365 - DNA, 924 bp, Homo sapiens
tccagcggtagataataaaaattaaatagcaatatcataaaataacccccctttttaaaaaatcaagtattagttccggattattagaaataataatccttaataaatccaacatactgatagggcggcaaaataaaattaattttcaaatacttatttatgccaccccagccggcttgggcactccaggaggttcaaaacacttggctttttattcacgcaaaaactatcgggcactggttagcacacctcttaacgaaaaaccgaggtttatactgggctattatggtgtattgacagcgggtgtgtatccacacaattctttaatgacctaactaatatcctctctataacagaaagaagtccaacgaggcaaaactatttccctccctcaggtatcctagttcaccaaaaagcggtccacgggtagtcaaaaaaaaaacaacaaaaaaaaaaaagggggggcgccggcccatcaagaatctttcccccccgaggagggggccccagcgttcagcgcggctaacccccgattttctcgggacacaaggggggcccctaaagaggaggagcggtcaaaaaaaaagccagaggacgagggccacgcagcaaaaaaacaacgtccgccgcacgggaacaaacgggcccaacggcgacaccctgggggaaggcaccccccaacccccgggcgggcggagaccacattgggacaaccaccacctgcaggagagatacaacggcccaaggggaaacctcaaaccttcacgggcaccagggggcaacccaacacgcatttcggcggggcgacaaactggcaccggcaactatttagcaaattatcaggggagacaacccacccccacaccaccacaccagcgtccagcggcgaccgacaccccacatcaccacacaccgcgaacaagc

SEQ ID NO: 619366 - DNA, 250 bp, Homo sapiens
tactcaagtctataaagactcgatttggattacactttatggctgctgctttacatttctttgataatgtatattttttctttcaatacccagaacctggcttggctcacacgggaaattgttgcattactttggataccgattgctttaatggctcctcgtgccgtagatttaatttatacaggtaaagtggagtacgctttcgcaataattcatagttttgtattagcccactggattccctttgggg

SEQ ID NO: 619367 - DNA, 361 bp, Homo sapiens
  misc_feature (273)..(273): n is a, c, g, or t
  misc_feature (299)..(299): n is a, c, g, or t
cttcctccagttacctctccctcacccaactcttcaccccctctggggagccttccccacccttatctgtctcctcccccagggagggatggaggagataatttgctatatattcttaaacgaaacatgtctgagccaggagtttgggacacagcctgggctatatagcaagaccccatcactacaaattttttacaaattaactaggtgtggtggtgcgacacctgtggtcctcaactactcgggaggctgtggtgggtggattgattgagnccaggtggttgagactccagtcagcngagattgcacctctgccctccagcctgggcaacagagcgagaccctgtctccaaaaaaaaaa

SEQ ID NO: 619368 - DNA, 122 bp, Homo sapiens
cccgaggaaaggtatcgcctcaccattgctgaagagagagacaaaagactggatcagagtagtgggtgaaatgggtccctgggtgacatgtcagatctttgtacgtcatttaaaatattgtg

SEQ ID NO: 619369 - DNA, 300 bp, Homo sapiens
cctctagacgcaaacgaacagcgccaggctcatctcactaaccagtatacgcagagaatggtatgtgtacgagctgttcccaagcctgttatcaacccctaccatccaggacctccttcgaggttacttcatggctggtatcccacatactcaaaaccgtgctgcatactattctcctagctatattgctcaattaagagcaagtcctcgctggactggtcaggatgccagagctcatccattccataatatgcccggtgctatccgcccagttgctcctagagcaccctcctctttcga

SEQ ID NO: 619370 - DNA, 330 bp, Homo sapiens
gcactttgggaggctgaggtgggcggaccatgaggtcaggagttcaagaccatcctggccacatagtgaaaccctgtctctactaaaaatacacaaaattagcccagtgtggtggtgtgcgcctgtagtcccggctgctcaggagggtgaggcgggagaatcgtgtgagcccaggaggcagaggttgcagtgagccaatatcgcaccattgcactccagcccaggcgacagtccgagactcatttaacaacaacaacaaaggttatttactttctaccctttcaatcggtcgtccagggcctattatagggttccctaagatgttatatc

SEQ ID NO: 619371 - DNA, 1434 bp, Homo sapiens
  misc_feature (450)..(450): n is a, c, g, or t
  misc_feature (454)..(454): n is a, c, g, or t
  misc_feature (458)..(458): n is a, c, g, or t
  misc_feature (701)..(701): n is a, c, g, or t
  misc_feature (787)..(787): n is a, c, g, or t
  misc_feature (805)..(805): n is a, c, g, or t
  misc_feature (819)..(819): n is a, c, g, or t
  misc_feature (823)..(823): n is a, c, g, or t
  misc_feature (830)..(830): n is a, c, g, or t
  misc_feature (842)..(842): n is a, c, g, or t
  misc_feature (844)..(844): n is a, c, g, or t
  misc_feature (909)..(910): n is a, c, g, or t
  misc_feature (935)..(935): n is a, c, g, or t
  misc_feature (963)..(963): n is a, c, g, or t
  misc_feature (973)..(973): n is a, c, g, or t
  misc_feature (975)..(975): n is a, c, g, or t
  misc_feature (989)..(989): n is a, c, g, or t
  misc_feature (1007)..(1007): n is a, c, g, or t
  misc_feature (1021)..(1021): n is a, c, g, or t
  misc_feature (1033)..(1034): n is a, c, g, or t
  misc_feature (1060)..(1060): n is a, c, g, or t
  misc_feature (1071)..(1071): n is a, c, g, or t
  misc_feature (1075)..(1075): n is a, c, g, or t
  misc_feature (1078)..(1079): n is a, c, g, or t
  misc_feature (1081)..(1081): n is a, c, g, or t
  misc_feature (1102)..(1102): n is a, c, g, or t
agcggggcggaacgggggcgtgtccccctttgaccccgcccccgaatggatgttccattcaattggctatcatcttccctcattccctagccaagcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgngcgngagnacacggtgggtccggcggcgggttggcgccccaggcggcgttccctgtggcctggcgcctgggccgctgccctgagcgggttccgccccagagcccgacctcctgggggctctaggcggagtcccgcgagccgagggggaccggcgaccgctgccgaagcatgaagaaggggtaaggcgtgagcccccaagatttcacggtgaactggcacaaaggttaatctcaagatgccgctagtgaacnagaaacatcgatcctaggcacttgtgccacacagcactgcctagaggcattaagaatgaactggaatgtgtaaccaatatttcctnggcaaatataattagacnactaagtagcctangtanatatgcngaagatatattngnagaattattcaatgaagcacatagttttccttcagagtcaactcattgcaagaacgtgtggaccnntttatctgttagtgttacacaggtngatccaaaggaagaagaatggtcttgcnagatataacnanggaggaaagctttncgaagttctacaattcangaccagcagctttncgatcgcaagannttgctattccattacaggagacgtangatgttgtgancagnctnnanctctcaatatactcactcctnatagagatgatggtaaagagggcctggcagatatgatcccagctccttcgaaattctatgagcgacggcagagcacgggtgccgagtccgaggctccgagcaggaccagcggcgccgaagcgcgcaaaatctgatggtctctgtacgcgaaaaggtgcaggccctcatgcatggtgcgcggaaggagaacacggccaggcacaacgtggcgacaagcggacagcgcgacaaagaagtacagagcgtggcggcgcaacgtggacacacggacgcgctaagggacgccccggcgctggaacgtggctgacggggaggagccaagccccccacga

SEQ ID NO: 619372 - DNA, 193 bp, Homo sapiens
gctcgacaaactgcttaaaaataagtaatgtattagacatttttcatatcccttttagcccatagtatagtgctaggccagagtcggctcttattaatagtggtggctctttctggaagcttcctaagtttttgtgctgaggattttaaccctcctgtaaaacagataatgccttcccaatggcctttttttt

SEQ ID NO: 619373 - DNA, 104 bp, Homo sapiens
cgtgaaaggccctggcgacgcggccaggcgcgcctgcagcttctccacaacttggagcgccgactccgccgccatcgctgtcactggcgccgaggctatagttg

SEQ ID NO: 619374 - DNA, 536 bp, Homo sapiens
attcattctgaatctgctggtgtctagggaatagaggtcccagtctgaatctggcgacgtgacgaggaggaatcacgtggcgccagtctggagattaggcaagtgtaccagggtaacagatgccccattctggagttggctgagtgttcgagggagatagaggccctgactcctggagttggtgagtgtacgagggaaacagaggccccactcctggagttggcgagtgtaccaggggaacagagactccactctggagctggtgagtttacgaggggatgagaggctccaatctggagtctgggagtgtaccaaagggaatagaggccgcaatctggatttgacgagtgtacgagggcaatagaggccccactctggagttggcgagtgtacgaggggaatagagtccccactctggagttggcgagtgtacgaggggaatagaggctccactctggagctggtgagtgtacgaggggaatagaggcccgatctggagttggcgagtgtacgagggcatagaggcccatctggga

SEQ ID NO: 619375 - DNA, 1544 bp, Homo sapiens
  misc_feature (450)..(450): n is a, c, g, or t
  misc_feature (454)..(454): n is a, c, g, or t
  misc_feature (458)..(458): n is a, c, g, or t
  misc_feature (811)..(811): n is a, c, g, or t
  misc_feature (897)..(897): n is a, c, g, or t
  misc_feature (915)..(915): n is a, c, g, or t
  misc_feature (929)..(929): n is a, c, g, or t
  misc_feature (933)..(933): n is a, c, g, or t
  misc_feature (940)..(940): n is a, c, g, or t
  misc_feature (952)..(952): n is a, c, g, or t
  misc_feature (954)..(954): n is a, c, g, or t
  misc_feature (1019)..(1020): n is a, c, g, or t
  misc_feature (1045)..(1045): n is a, c, g, or t
  misc_feature (1073)..(1073): n is a, c, g, or t
  misc_feature (1083)..(1083): n is a, c, g, or t
  misc_feature (1085)..(1085): n is a, c, g, or t
  misc_feature (1099)..(1099): n is a, c, g, or t
  misc_feature (1117)..(1117): n is a, c, g, or t
  misc_feature (1131)..(1131): n is a, c, g, or t
  misc_feature (1143)..(1144): n is a, c, g, or t
  misc_feature (1170)..(1170): n is a, c, g, or t
  misc_feature (1181)..(1181): n is a, c, g, or t
  misc_feature (1185)..(1185): n is a, c, g, or t
  misc_feature (1188)..(1189): n is a, c, g, or t
  misc_feature (1191)..(1191): n is a, c, g, or t
  misc_feature (1212)..(1212): n is a, c, g, or t
agcggggcggaacgggggcgtgtccccctttgaccccgcccccgaatggatgttccattcaattggctatcatcttccctcattccctagccaagcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgngcgngagnacacggtgggtccggcggcgggttggcgccccaggcggcgttccctgtggcctggcgcctgggccgctgccctgagcgggttccgccccagagcccgacctcctgggggctctaggcggagtcccgcgagccgagggggaccggcgaccgctgccgaagcatgaagaaggggtaaggcgtgagcccccaagatttcacgtgtcggagaaatcagcatgttaaaacaacttgtcgcatgatacgctggtgcagttaccagtgcagtggaacgctatggctgcacaatcgtttaaaatccttcaaggtgccgtgaactggcacaaaggttaatctcaagatgccgctagtgaacnagaaacatcgatcctaggcacttgtgccacacagcactgcctagaggcattaagaatgaactggaatgtgtaaccaatatttcctnggcaaatataattagacnactaagtagcctangtanatatgcngaagatatattngnagaattattcaatgaagcacatagttttccttcagagtcaactcattgcaagaacgtgtggaccnntttatctgttagtgttacacaggtngatccaaaggaagaagaatggtcttgcnagatataacnanggaggaaagctttncgaagttctacaattcangaccagcagctttncgatcgcaagannttgctattccattacaggagacgtangatgttgtgancagnctnnanctctcaatatactcactcctnatagagatgatggtaaagagggcctggcagatatgatcccagctccttcgaaattctatgagcgacggcagagcacgggtgccgagtccgaggctccgagcaggaccagcggcgccgaagcgcgcaaaatctgatggtctctgtacgcgaaaaggtgcaggccctcatgcatggtgcgcggaaggagaacacggccaggcacaacgtggcgacaagcggacagcgcgacaaagaagtacagagcgtggcggcgcaacgtggacacacggacgcgctaagggacgccccggcgctggaacgtggctgacggggaggagccaagccccccacga

SEQ ID NO: 619376 - DNA, 579 bp, Homo sapiens
gtggagaaccctagcatgagtgtatgtagcccactgtcgacctaggaattgaaagtcatgaagtgatgcgaggacaaagcctgcggagtatctcaccctgtgactcatgctctacccacagccgcgtgcagttggaacacccatggctcatcgtcagactccggagagacctgccccatttgcaagccagccgtgttcctatcggggtcactcgggacgaagaccaacaggaagaaactcaagggcaagaggagggcgatgaaaggggagccaagggaccacccgtgccatcagaaaggaccccacttgatgggctgtctagccccactcttcccacctcctttggttccttagccccagctcccattgattcttattacctgggccttcaacagatcccccagcatgtcccctccgctcttaccccatgtgtatcctggtctaataaccccgcacacaaaacacctctggtgacgcatactttgacacagaccgtcgtcttcacctccagtcttctgagggataggggacattccatccaaagcttctccctacctacacctatcctttgaggggctt

SEQ ID NO: 619377 - DNA, 339 bp, Homo sapiens
ttccccgaatagggggggcaaatgggctcgagccccccgggccttccccctccctaagctttcgggatgggccccccctattggccggtttggatccttgcctaggcccttttcccccccagatgggtttttcctccagggggccccccctggcccccccccattggcccccctccccctggggtttttccttcctttgaacttttttagggggcccggcttgggggggtcctggggcccttaacccatgcctttgggggccgcccttttttttttttttttttttccaggtttgggagggggggggggattttttaattaatcctggaatccatccca

SEQ ID NO: 619378 - DNA, 153 bp, Homo sapiens
  misc_feature (1)..(1): n is a, c, g, or t
nagtggaaagatgcttagagcctcatgtaccgacaggaaaagatgtacacaccagagtattggcagcaaagttttttcaagtccatctgctgtgagctctcttttattgaccatgcaacctgcattattgtatcacgaacatggtagtttatg

SEQ ID NO: 619379 - DNA, 370 bp, Homo sapiens
gacccacctaggattatataataaaaggggtaagcggtataataggaatgtctgttcagacggtttgaaaacagttaccttgagaatttgtattccttgacccagcaatcccacttgtgaaaatctgtcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaatagtttgctgggcatggtggtgtgcaccagtagtcccagctatctgggaggccaaggcgggaggatcgcttgagcc

SEQ ID NO: 619380 - DNA, 122 bp, Homo sapiens
gatacgactctcattctgttgccaggtgagtgagtgggtgatctcagctcactgtagccttgggctccaggcttaagtgatctcccacttcagcttcccgagtagctgggacgcacaggcat

SEQ ID NO: 619381 - DNA, 625 bp, Homo sapiens
  misc_feature (543)..(543): n is a, c, g, or t
  misc_feature (549)..(549): n is a, c, g, or t
  misc_feature (583)..(583): n is a, c, g, or t
cagtgtttccctgtctcctgcccatatcactggaggtgtctgtgagggtgtgcaaaaggagattaacatttgagttagtggactgggagaggcagacccacactcaatctaggtgggaccatctaatcagttgccagagcggctaggataaagcaagcagaagaacgcggaagggctagacttgctgagtcttctggacttcatctttctgttgtgctggatgcttcctaccctcaaacatcagactccaagttcttcagcttttggactcttggacttagaccagtggtttgccagggactctcaggcctttggccacagacagaaggctgcactgtcagcttccctacttttgaggttttgggacttggactgatctaccactgacttccttgctcctcaacttgcagatggctttaccttgtcatcatgtgagtcaattctccttaataagctccctttcatatatacgtatatcctattagttctgtccctctagagaaccctgactaatacaataggatgcacacacacacagaaaancaaaancaaataaaagcaaataaaacaaaagctcaggttnctctccagttgacattcaaaaccagaaaaatatgtaaccatg

SEQ ID NO: 619382 - DNA, 585 bp, Homo sapiens
  misc_feature (279)..(279): n is a, c, g, or t
  misc_feature (323)..(324): n is a, c, g, or t
  misc_feature (327)..(327): n is a, c, g, or t
  misc_feature (355)..(355): n is a, c, g, or t
  misc_feature (363)..(363): n is a, c, g, or t
  misc_feature (389)..(389): n is a, c, g, or t
  misc_feature (396)..(397): n is a, c, g, or t
  misc_feature (399)..(400): n is a, c, g, or t
  misc_feature (405)..(405): n is a, c, g, or t
  misc_feature (412)..(413): n is a, c, g, or t
  misc_feature (422)..(422): n is a, c, g, or t
  misc_feature (424)..(425): n is a, c, g, or t
  misc_feature (441)..(441): n is a, c, g, or t
  misc_feature (449)..(449): n is a, c, g, or t
  misc_feature (451)..(451): n is a, c, g, or t
  misc_feature (490)..(490): n is a, c, g, or t
  misc_feature (493)..(493): n is a, c, g, or t
  misc_feature (496)..(496): n is a, c, g, or t
  misc_feature (507)..(508): n is a, c, g, or t
  misc_feature (519)..(519): n is a, c, g, or t
  misc_feature (527)..(527): n is a, c, g, or t
  misc_feature (535)..(535): n is a, c, g, or t
acgcggcaccgcgcgtttcaaatgcaggcgattcctgaggacgccatccctgaggagagtggcgatgaggacgaagacgaccctgacaaggcgcatctcgatctgctcctctgacaaacgaattgcctgtgaggaagagttctccgacttctgaagaggagggagaggggggccgcaagaactcttccaacttcaaaaaaagccaaggagagtcaaacacagaggatgaacaaagagaaagacccagaggagaagaaagaagtcacgaagaggagaaancaaggaggagaagccagaagccaaaggggtcaaggaggaggtcnngtnggcctgaatggacctctccagctctggnttcctgcngagtccctcacgtttcttccccaacncctcagnntnnatatnttctatnnctctgtgtntnnatatcaaatttattanatataatntnccccagggacagaaaccaaggccccgagctcagggcagntgngcngggtgagctcnnccaggagccancttgccanccattctncccgtacttaactttgaaccgggcggagcgacgtgcggtaccgagctcga

SEQ ID NO: 619383 - DNA, 129 bp, Homo sapiens
ggagcatcagcagtgcacatcacgatttgcacagcacatgttttcattcacatcacagcacagcacacagtggcaggttgcacagcagcatcagcatcagttgttcagtttgcacattcacacagcatg

SEQ ID NO: 619384 - DNA, 853 bp, Homo sapiens
  misc_feature (16)..(16): n is a, c, g, or t
  misc_feature (65)..(65): n is a, c, g, or t
  misc_feature (79)..(79): n is a, c, g, or t
  misc_feature (83)..(83): n is a, c, g, or t
  misc_feature (85)..(85): n is a, c, g, or t
  misc_feature (104)..(104): n is a, c, g, or t
  misc_feature (112)..(114): n is a, c, g, or t
  misc_feature (125)..(126): n is a, c, g, or t
  misc_feature (132)..(132): n is a, c, g, or t
  misc_feature (146)..(146): n is a, c, g, or t
  misc_feature (163)..(163): n is a, c, g, or t
  misc_feature (170)..(170): n is a, c, g, or t
  misc_feature (175)..(176): n is a, c, g, or t
  misc_feature (181)..(181): n is a, c, g, or t
  misc_feature (185)..(185): n is a, c, g, or t
  misc_feature (190)..(191): n is a, c, g, or t
  misc_feature (194)..(195): n is a, c, g, or t
  misc_feature (197)..(198): n is a, c, g, or t
  misc_feature (201)..(202): n is a, c, g, or t
  misc_feature (207)..(207): n is a, c, g, or t
  misc_feature (209)..(209): n is a, c, g, or t
  misc_feature (215)..(215): n is a, c, g, or t
  misc_feature (229)..(229): n is a, c, g, or t
  misc_feature (231)..(231): n is a, c, g, or t
  misc_feature (253)..(254): n is a, c, g, or t
  misc_feature (261)..(261): n is a, c, g, or t
  misc_feature (271)..(271): n is a, c, g, or t
  misc_feature (273)..(273): n is a, c, g, or t
  misc_feature (284)..(284): n is a, c, g, or t
  misc_feature (296)..(296): n is a, c, g, or t
  misc_feature (299)..(299): n is a, c, g, or t
  misc_feature (306)..(307): n is a, c, g, or t
  misc_feature (320)..(320): n is a, c, g, or t
  misc_feature (341)..(342): n is a, c, g, or t
  misc_feature (344)..(344): n is a, c, g, or t
  misc_feature (346)..(346): n is a, c, g, or t
  misc_feature (350)..(351): n is a, c, g, or t
  misc_feature (358)..(358): n is a, c, g, or t
  misc_feature (370)..(371): n is a, c, g, or t
  misc_feature (377)..(378): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (411)..(412): n is a, c, g, or t
  misc_feature (432)..(432): n is a, c, g, or t
  misc_feature (441)..(441): n is a, c, g, or t
  misc_feature (446)..(446): n is a, c, g, or t
  misc_feature (455)..(455): n is a, c, g, or t
  misc_feature (457)..(457): n is a, c, g, or t
  misc_feature (468)..(468): n is a, c, g, or t
  misc_feature (480)..(480): n is a, c, g, or t
  misc_feature (512)..(512): n is a, c, g, or t
  misc_feature (538)..(538): n is a, c, g, or t
  misc_feature (562)..(562): n is a, c, g, or t
  misc_feature (570)..(570): n is a, c, g, or t
  misc_feature (583)..(584): n is a, c, g, or t
  misc_feature (588)..(588): n is a, c, g, or t
  misc_feature (606)..(606): n is a, c, g, or t
  misc_feature (608)..(608): n is a, c, g, or t
  misc_feature (613)..(613): n is a, c, g, or t
  misc_feature (620)..(620): n is a, c, g, or t
  misc_feature (632)..(632): n is a, c, g, or t
  misc_feature (670)..(670): n is a, c, g, or t
gggtcccttccctgcngggcgcggactcggtagaccccccagaggaaggggcctagggagggggnggttccgccgcccnggananccgggggccacgcggtganggcaaagnnncggggcccagnncctggnaaaggggtggaggngaggggcgcggggcggngggcgcngggcnntgggnagcnccacnngcnngnnccnnggaangngggggntcaaaggggggggngngggggcgggaggggggggcggnngggcggngggagggggngnggggggacagngggggggggagnggnggggcannggcaaaggggganggggagggggggggggggggnngngngcgnnggggggncaggggggggcnngggggnnggggcnggnggngggggngggggggggagggcnnagagcccccagggagggggngggcagggncaggncagagccangnaggggggccanaggggcgcccanggggggggagcgaccccaaccgacggaccganggggggaccacagggccagcgagggnaaaggaggcccagaaaggagaaangcgttgcncaacagccacagnnggcngacgtaaccgagtgtagngnagggncaggggnggcctgagggangagccaggggggtgggcaggggacacaccagggccccnccctggcctctgccccacccagccctctcctgcacggctaccagaagatgtccgggaagaacagactagccctgagtagggagtgtggtcaggtgcagaggagggcaggggcccggatcctggcccagaaacactctaaaacagaatccgatcctgagatgatccaaatcaaacagaaacttg

SEQ ID NO: 619385 - DNA, 1226 bp, Homo sapiens
  misc_feature (907)..(907): n is a, c, g, or t
tgaggggtgagcagagtgatgacgtgctgaggggcgggtctgttcgtgttgtctcgggaccaccccagatgtcgctcgttggcgcgccgctcggcagtatcagctctgtctgtggtggacagagggagatcaaattagaagggtctgttcatacaaagtgtgttgtgcatcgtcgtggagaacacacctttgggggagttgtgtggttagagggagttgtttgtagaaacaccagcgtgcagaccccccttctgttggaatggggtcttttctgtcgggaagagaggacagtctttgtccaaacccttgcggcgagagaggagaagacttcttgtctgtttaagaggccgttgacgcctttacacccccccgaggggggaaacctttataggacccgtgttttaaaaataattacgtggctccccgtgagtgttcccccggtgggtgcttcaacgtgttcctgttcccgtgtctgttgaaaccgaatgtgagaactcttgggaggaaccggcgtggtccttcgacaccagtgtccctgttggcccctgggcctgggcccggggaaggtggccaacggcgacccggactgaccctgccagtgacccccggattgcccgccgccccgagggaccacttttatggcttcccatttcgcagaagctcgctcgccccaagacgccctcggcgaacaccccacccttcgcggggctcggctttcggagaggacccccgccctgcgcttcccgggttcgtgtgtccccggggactgtgttctgtacacgggccataagtttctggataatcgcacacatccccggggcctgtgtgtctgtgagctgcggtctcgtttctcgataatcccaccacaccctctggtgtggcccgcccttacattccctgcgttcgnagaaagtgataaccgtggagaatacccaccgggacccaaatattcttcgccagaggccttgcccggatggttgtcccataaacctgtagagtcttaattgcgtgatcccactcaccagagaattaatcgttccagttgaaagcaagttactgatagacttttccaaaaccaaatggacccccgtgagctgaccagagaacccgtatcgtagaggtttcgtagtttagtgcttttattttgccatagttgatagttgactagctaatataacttgtaaatgtataaccatgcgaatataactgcgttttttatttttcca

SEQ ID NO: 619386 - DNA, 499 bp, Homo sapiens
aatcatatcatatctggacacatgagcgataaagccaagatactcaacccttgcagaagagaagtacttccatacagtgaatcaggaattttcaaaggtaatattggaactagacgccatttctgatttgcgaaaaaggacttctactatacaactatgacagcaatactcggcactggactagacctcccactgtaaataacgggaaaaagcgcaaatacattaaacaatactagtacgccaatagataatcggcagagtgcgactgtgatctctctgagaaggaagccagtcaggtgagcactacaatcatctcagctataaacttggagatgtttaccaaaccaagtacaggtcggaggaacccaaaataagcacggatattttactaaactccgcaactagtgatcaggagttcagtgacagtggggcagctagaacttgctgaacaaagtacccgagaagagaaggaatgtagaaaatagaaaaaaaattgaat

SEQ ID NO: 619387 - DNA, 119 bp, Homo sapiens
ggaggcgccgccatttttgctgcccggacgcggagcgagaggctgagagagtcggatacactatccgcttccatacagatcgctgaacctgctgtttccgctgccgctatggatgatcg

SEQ ID NO: 619388 - DNA, 407 bp, Homo sapiens
  misc_feature (246)..(246): n is a, c, g, or t
tacatgttccatggaggcacaaattttggcttcataaatggagccatgcattttggtgactacaaggctgatgttaccagctatgactacgatgctatattgacagaggctggagattacactgccaaatacaccaagcttcgagaactctttggaaccttctcaggtacaaacaaggaacagattcaagcatccacttgggctcgtgcttttgctatgagcccttggagtttttgctgtcttctncctatcctacctcaactctagctaacccatattcaagaatgtcctagactgctgtgaaacgtatctcagtgtgtgcataaggccctgtattccacccaccccactgccaaaaataaataagtaaataagcaaataataaagccaatcttgtagataaagta

SEQ ID NO: 619389 - DNA, 665 bp, Homo sapiens
ccatagtggttggacgaaagctgtccctgacacagaaaccaattggctgtatcaggctgctgatgtcggcccaaacagaggcagggccggatgagattatatgataacttgcttgtgggaaggaatgaaaaagcctgtactaagacctgttaaattttctaaattacaagaagtcacccaggagccgtctgagaacctcacccttttccaagctagattggtggaggccatgcgtaaatatgtaaatttagaccctgaaagccctgaaggccaatccattctcgctgtacattttgtaagtcaggcttacccagacataagacaaaaactccaaaaattagagcaaggcccacaaactccctttcctattttattaaatacagcctttgaggttttcaataaccaggagaaaacatcaaaaataaaaaaggctgaattggaggaggaagaatgccatcactaagctaattacatggcaacagccttggcacattctttttcttcatctaataaccccaaggctcatccctacactactaacagaatgggggcctgtcattgctgcagaatccaggacactggagtagagaatgttccaaccggcaggttcaagccattccaggacctgtctcttgcaacagaggtctggagagcaggtctctctc

SEQ ID NO: 619390 - DNA, 329 bp, Homo sapiens
ttttttttttttaaataataatgcattgtatattttattttgttttgttatttattatttttgagacagagtctcacaatgttgtctaggctggtgtcaaacacctaggctcaagcgatcctctggccccatcctcctgagtagctgggactacaggcatgtaccaccataccacaccatttgtatattttaaaattgcttgtgtacgatgctcacgatctggctgacaggatcattcataccccaaacctcagcatcacacaatatacccatataggcaagcctgcacatataccccattaatctaaaggtaaaagttaaaaatactt

SEQ ID NO: 619391 - DNA, 175 bp, Homo sapiens
gttttaactttggcccgggggggggttacctttttcccccgggaaccccttttgccctttggccttttttggtggcccttttaaaccagttttttccaaaaaaccgggtgggtccggtccgggatttccggggtttttttgccccccgggtccccccccgggtccggcctttcca

SEQ ID NO: 619392 - DNA, 444 bp, Homo sapiens
caagtggcttcaaatatcaggtgaacaacactatcaaagagatagtgctgtcatccaggctatatagtactatcaatagagcagaggcagagcagatatcgtagtcactctatcaggacccaaggatattcagaatggtcaatgaacatggcttcaaagtaaccagcggagttaacccctcacaaggaattcagctagacctttgaagctttgaagccaggaatgaacttctcgtctagctcagcaaagtcctcacagagtatcttccaatataaggctgtatagtctacgtagaaaatcgggtttagtgagtgtagccatcttcatgaattacctcagctagatcttctcaaagaacttgctgcagtttctacatcaaacacttgctgctttaccttgcacttttatgttatagagactctgtctttccttattttttctttg

SEQ ID NO: 619393 - DNA, 969 bp, Homo sapiens
taatacgtagttataaatatatttggtcaaaatatttgatcaatatggtcaaaacatttgcacgtaaagctataaaataaggtcaagggtgaagtgtttagggattttttcttttttttttttttgtaaaatataaaagctccagtatatataaggaagcagtcgtggtgataggggtggtggaaatgtgtgtgtgtgcccgttgtgtgttgttgtgtgtgtggggtggtggtggtgtgtggtgttctcgtggtaaccctctcgtgtgtctccccagtggatacagtgtcccacccgtgtgctccccaaagactccaccttatttcccctccaaaaataaaaaaaacaacccccacaggagaactcggaggagaaaggacagaagagacaaaatccgcgcggggagcccccccaagaggaccattatatggtagagcacaaaaaaaagtgggaggggcacaacaaatttaaaacaaaaaacacaaacaacacaacaaaaaaaaacaaaaaaaacaaaaaaaaagaagaaagaaacaaaagagaagaagagcaccagagccgcgaaaaagagggcagacaagagaaggaagagagaaaaggagcaccagagaggaacagaaagagcagaaaagagagaggaggagagaggaaaaagagacagccaacggggggggaagagacacacgcacgaaaagaagagacagaaggaaagaaagaagccaacaaagagaagagaaagaaagcggaggaacgaagggagagagccacagacagagggcagggagaccgagagacggaagcgaggcaaaaagagacgaaacaaaaaaacgagggacgggacaaaagaaaggacgaacgcgagagaagaagaaaacagcgaaagacaagaagaaaaaaaaagaaacagaaaggacaacacaaaaagacgacagaagggaaaagaaagaccagaaagcgaaaaaaacaacg

SEQ ID NO: 619394 - DNA, 241 bp, Homo sapiens
gtagctcaagcactgcctgccttggcctccaaaagtactggaattgcaggtgtagagccaacatggctggccctatcatatagatcttacacataattttttcgacttacaactatttctttttggggggtgtaaatgtaaattacatggttttaaatttctttctttttttcttttttgagacagagtttggctcttgtggcccaggctggagtgaaaaagcgagacgagactccatctc

SEQ ID NO: 619395 - DNA, 256 bp, Homo sapiens
ggcgctgcaccgggcccaggagcgcctggatacagccctgcagacgctggcggaggcgagacaggcggctgatgcgacgcgagagcggacactgcaggtcactcgacaaaccgggccatgacggctgaggagcagatggaactgcaggagatgcagctggagggggccgcgcgccttctcctcctaacacgcctcaccatgccctcaccctaccttgcctggtctccttctcccatcgctggatgtggggctgcgc

SEQ ID NO: 619396 - DNA, 130 bp, Homo sapiens
  misc_feature (77)..(77): n is a, c, g, or t
gagggccaaggtttgggaagcataacaagggcttaagcactgcctttttaagttggataagccaacaaagcgtttgnggcaaaagtacttgttggcagccgcacaaaagaaaggtgttgtcccagggaaa

SEQ ID NO: 619397 - DNA, 325 bp, Homo sapiens
ctggttgctcatagttctgcctcagcatcccaagtactgggattatatgtgtgaacaccacagcttgccagaagacaatttatctatagatagtggaagggagagaaaggagacctgggtctcccaggaagcaaaggggacaggcgccttaaaggagattgcaggagtcatagggcctcctgtgagcccacgggagtaaaggtgacttcgggaggacaggcccaccaggtttggctggttttcctggagctaaaggagatcaatgacaacctggactgcagggtgttccgggccctcctggtgcagtgggacacccaggtgccaa

SEQ ID NO: 619398 - DNA, 152 bp, Homo sapiens
ttttggggggggggaaaaattttatttggggagaattttaaaaaccccaagcttttttatttgtttgaaaccaactttttgcccgttacctttttggtttttacccattaaaaaagcccagggcctttttgttttttattgggttttccccc

SEQ ID NO: 619399 - DNA, 127 bp, Homo sapiens
aggttaggcattgagcagacttacagcctaagattacagatgctgcttctgactcaatgtaaagcacctgcctcaatgtaaagcgtccagcggcagtgcgacctgctgctggcttcgatgattttga

SEQ ID NO: 619400 - DNA, 795 bp, Homo sapiens
tacatggtattgtgaagacgtgactctttctctgtgtctagaaacaaacacggatgtgaacctttggagttcccattggttgcatattaaacaaccaccggatggtcacacccacgtgagccgctacacttacacttcatctggcggacgtaatgcatttagcaccaccacgggagcgtggcaccatatgttacgccagaagacctatatacatcactctatgcgtgcggttgaatagaaaattggcgcctcgttattttagtgggcgccgcacattgtgggaacaccctcctgtgggtcaatgccctccctctctggacgttctaacgacccccttcttttagaagagtcataacctctcgcactcgctccacgacagcctcgctccccgagtggggagagacatgacgcacgccgctccgccacaccccttgggtgggtggagccccgctcacgccgcacgggagaaagtcatgtctttatttaacaaccacgcgtctctctatagaacaagatgaatcactcactcttgtattcaaagaggcatctttatattatgcacccaagagagtaatacatagattatgctcaccattatgcggcacacatgcctcgtcacgaagagttcatccttctcgatgttatacgacacctcaagatgacaccccccattttcgagaacactccccatcacaccttcttctacgcatggtagtagagtttattgtaccatacgccgatcctctctaataaccacccttgcttcttcgtctacaaaccagacaaacaaaacac

SEQ ID NO: 619401 - DNA, 161 bp, Homo sapiens
  misc_feature (139)..(139): n is a, c, g, or t
caaagtctcctctcctcccattcaaaaacaagtttattttccttctgcattgggaatcttgtcccagagatctaaagtaccttagttttgtgtatctttctcccgctttctggagcactcctagaaatattggttgccnacagacttagaatctgtgctta

SEQ ID NO: 619402 - DNA, 1028 bp, Homo sapiens
gtgtcatcacttcctctcaagctaggggtgtgttaggtggggttacacaacgggttcaccatggcgtatcgcaagaagtgttattatctagtctcggggcccgatctatcctgggacactggcatgatgttcagtccagcaaacgattgccaaggtgttcagattttagcaaatctaaatgtccatacagatagactttacaatagagcaagcgcaatcctcgcaaagttagcgtggaccaacagcattccggataagcagttggtaaagagcttacagtggataattcatttgaatttgatgtagatcgtagtaaatgagacctatctaaatacgcagcgagagctatgcgaataaacacgtatctgatgcgatgtaagagagttgacagaaagtcaaatcagaagcgccaagcttaaatttataatgaacagattgtccgacaaaatgaaagagctacagaacagctccaggatatcagggaagtcacgcataacatccatcttatccgagcccctcttgcaggcaaagggaacacagtttggcaagagcaacatggtacagtcagttacaagaggatgtggacatggaagatgctccttaaaaatctctgtaaccatttcttttatgtacatttgaaaatgccctttggataacttggaaactgtaaatcatttcatcttttacataaggtcacttaacatgaaaagcgattaaaacgacatctctttcctggcattgtgcatcttacgttattatcagattattacgggatgtacagaatgcatctcagtgttcaaatctttacgtgtgtagcatgttcttcaggtacatctccatgaacacttctactttgtaactctcgacccgcaattttcgccgttaaaactgtgttgtgccccttgggacaagtggactagccgcattcgcattagcacccaaaggcgcaacacttctggcacacgggttaacaaagatacttcttcgcacacaatccgcctgtacgggtcacaacggggccacaacag

SEQ ID NO: 619403 - DNA, 291 bp, Homo sapiens
actgactacgaagctagcacctaccatctgcttggaccacatgacctacaaagggaaggggatgccgattgtggcgagagagcgggcgaggcgcctttactacatgtgtgatctgaaaaccctgcttggttctgagctgcgtctatgcgaattggtaaagcaataccaatggctttttatcatttccttcttccctttaagtttcacttgaaattttaaaaatcatggttatttttatcgttgggatctttctgtcttctgagttccatttttctaaatgtttaaaaatat

SEQ ID NO: 619404 - DNA, 350 bp, Homo sapiens
gacctccttgcctacattttaaaaacctagagctgggcatgatgccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccatcctgggtgacagagcgagacccagactcaaaaaataaaaataaaaaccctgaatatcttccttcta

SEQ ID NO: 619405 - DNA, 296 bp, Homo sapiens
acgataccgcatcctcgtgttcagcatcacacacgaagatatgccataaagaaggtgagaagagcaaaactactgctgctattaacaaaactgacgacagagagaacaagtggcagaaaggatggattggaaccattgacaacagaaaagcctgaaacacgagaggcatctagcagaaacgcaaacgaaaacgcccttgatggacgacacaaaataaagcactcagactactacgtgaactaccgtaaactcagacaaaacggcaacaattacagacaccaacgaccagggacgct

SEQ ID NO: 619406 - DNA, 138 bp, Homo sapiens
tgctgcggtgatctagaggatcccagcgggaacatcactttggctagcactagcaaaagtgaacaaataggattacatgaagtgaaaaagcttatgtacagcaaaggaaacaatcaacaaaggtgattgttccccgct

SEQ ID NO: 619407 - DNA, 207 bp, Homo sapiens
  misc_feature (63)..(63): n is a, c, g, or t
  misc_feature (70)..(70): n is a, c, g, or t
  misc_feature (103)..(105): n is a, c, g, or t
  misc_feature (112)..(112): n is a, c, g, or t
  misc_feature (115)..(115): n is a, c, g, or t
  misc_feature (127)..(127): n is a, c, g, or t
  misc_feature (135)..(135): n is a, c, g, or t
  misc_feature (153)..(153): n is a, c, g, or t
  misc_feature (159)..(159): n is a, c, g, or t
  misc_feature (185)..(185): n is a, c, g, or t
  misc_feature (189)..(189): n is a, c, g, or t
  misc_feature (194)..(194): n is a, c, g, or t
  misc_feature (198)..(199): n is a, c, g, or t
agataatagtgaattgaatgaaaatatcattctatttacccaacctcatataaaccgttaaangtttccngtgagtctcttctgtaaattcatttaacaaatnnnggactcntcngcggttttgcangtttcacngtttcccacggtaatccngtctgncagcatgtattcacaaactcaacctnttcngttgntcannggctcaag

SEQ ID NO: 619408 - DNA, 1109 bp, Homo sapiens
taggttagagaggccgtgttatcggacgagggcacccaccgagttgactgaaagtgtgggtggggatcatgctgcctgtgctgggcattcaagtctctgtctccctttgccagcacatacctggatcggctgcgtcctgatgcatcccaaccttaccaagggcttcggcagtgatatggccccaaggacttcttcccacttctggactttgcctatatgccgaacagactccctgacacccagcctgcaggagcagctgtgtcagctctacccccgactgaaaatgctggcatttggagcaaagccggattccacctctgcataccttacttcccttcttgcctgtccagagccacgccctagctgtcccccatgagatgaagaaagagctcctgagcaagactgactgagtgcctgacggtggaccccctcagtgccagctgtcgtggaggccagctgtaccctaagcacctgtcacagtccagcctatctgctggagcagattgctcagctcctgggaggccgattgcccgagacggtcagaggtctttgccggagaccattcacatccctcaagcttaccaaccatggagctgctgcggaagggttgcgtagcacccaggatgtcgtccctgtgacatggcctgcatcggcctgtcgcagcaggtgccgggttctcggctgcctggacgcggctcctcctgtgctgctgctcttcgctgtggcttcctgtgcatggtcccggtccacagctcgttccagccccgcttactgcccgattgcttcgatatctggcttctcaccggctagcaacaagcgtgtggccagttatctcaagctggaaagtcacgcaggtggaggaacacggcgtccgaagaaccagcagatcacggcggcgcccacttacaggctgggccccaagcacagagtacataggccaaggactcactcaagtagggacgacacacactcacaagcagacacacccgcgaatcacgcaacagagcactgaccaaggcgcagactcacccgccaccaaaaacggtccaacttcgcctctgttgtccgctagcctctccgtgcccccccacaccacaaccacaacaaca

SEQ ID NO: 619409 - DNA, 126 bp, Homo sapiens
agtattgagatccaggaaggttgaggaaggttggttattcaggtggctggcatgtagtatcagacctggagcgtgattggctcacgtatggagagctgtcgttaattggtggagtattgagcagag

SEQ ID NO: 619410 - DNA, 236 bp, Homo sapiens
ttatgatagctgagtagtatcatggtatggatgtaccacagtgtgcttaaccattcacccactaaaggacataagagttgttttcagttttttgccctaataaagctgctgtgaacattcatgtacaggtttttatgtgaacatacattttcattttctgggataaatgctcaaaagggcaactgtagggttgtatggtaaacacatatatttttgtaagacaactaccctactct

SEQ ID NO: 619411 - DNA, 137 bp, Homo sapiens
tggtggaacgctgcaagagcacccctccaccccattggctcgcagtatcctagaatcttggtgctctcgctgcagttcccgttggggttccatgttttcctggtcccctcccaggctagctggatggcagcgtgcca

SEQ ID NO: 619412 - DNA, 460 bp, Homo sapiens
ggcccctgtgcttgctcaggtctgtagcgatggggtgtcgcctggttgctcaggtctggctgaattttctgccctgaggatctgggcttatgtggttgatacttgagagaccttcagtgtagatccagatggccaatctgtccttgttatgttacttgcttcttgggaatcagtgtccccttctgagctgaaatggaaatggattccaaatctcttccaacctttaaggtgatagatagtttgatgcaagactggagaatggacaacactatgaagctgtggctagaaagggactgtctatgtcccatcctttggtcccgatttgactggggatgtccggagcagatggcctgcctgggtggggagggccacatctgcacacaagccagtggctgtttgccgctcactgctgtgatgccagagcgtgttgcaaggtcactctcctgctcttctggactct

SEQ ID NO: 619413 - DNA, 635 bp, Homo sapiens
  misc_feature (335)..(335): n is a, c, g, or t
  misc_feature (366)..(366): n is a, c, g, or t
  misc_feature (487)..(487): n is a, c, g, or t
  misc_feature (584)..(584): n is a, c, g, or t
  misc_feature (594)..(594): n is a, c, g, or t
gttgcatgtcttccttagaaagcgtacgcatggttgcatttgtcacctgtggtgacatgaccagacaggatgtactaggcctgggtatccagcgaggctctgcatccctgctgtagggccctaactagagatctagagtttctgattctggtgctcagtagaccttttacaggctggctatacttgatctgcttcaaggaggtcgaccttctaatgtatgaagaatgggatgcattagatctcaagaccaaagacagatgtcagagagctgctctggccctgatgtgcacggctgtggcagctgctgatgctcagtgcctctaactcatgctgtncttgtgattaaacacctctatctgaattgangataagcacatacaggctgaagctctacgatagatgagtgtatgatcttataccatcgagctacttccgataagtaccactgatgatacaacactcttcacccacctaccatacgcaaggngatgtcgatactacggccacagtaactggtggtaggcatcttacaaacatgaccacttatactggactgctgaggcatgagatcacagcacgatctngaacagcctntgccctggagatcgttcatgatcccgtattgttcacagttt

SEQ ID NO: 619414 - DNA, 596 bp, Homo sapiens
  misc_feature (16)..(16): n is a, c, g, or t
  misc_feature (73)..(73): n is a, c, g, or t
  misc_feature (79)..(79): n is a, c, g, or t
  misc_feature (128)..(128): n is a, c, g, or t
  misc_feature (130)..(131): n is a, c, g, or t
  misc_feature (144)..(144): n is a, c, g, or t
  misc_feature (151)..(151): n is a, c, g, or t
  misc_feature (181)..(183): n is a, c, g, or t
  misc_feature (186)..(186): n is a, c, g, or t
  misc_feature (226)..(226): n is a, c, g, or t
  misc_feature (231)..(231): n is a, c, g, or t
  misc_feature (240)..(240): n is a, c, g, or t
  misc_feature (254)..(255): n is a, c, g, or t
  misc_feature (261)..(261): n is a, c, g, or t
  misc_feature (264)..(264): n is a, c, g, or t
  misc_feature (294)..(294): n is a, c, g, or t
  misc_feature (315)..(315): n is a, c, g, or t
  misc_feature (321)..(321): n is a, c, g, or t
  misc_feature (333)..(333): n is a, c, g, or t
  misc_feature (340)..(340): n is a, c, g, or t
  misc_feature (359)..(359): n is a, c, g, or t
  misc_feature (366)..(366): n is a, c, g, or t
  misc_feature (384)..(384): n is a, c, g, or t
  misc_feature (401)..(401): n is a, c, g, or t
  misc_feature (407)..(408): n is a, c, g, or t
  misc_feature (427)..(427): n is a, c, g, or t
  misc_feature (434)..(434): n is a, c, g, or t
  misc_feature (445)..(445): n is a, c, g, or t
  misc_feature (458)..(458): n is a, c, g, or t
  misc_feature (474)..(475): n is a, c, g, or t
  misc_feature (502)..(502): n is a, c, g, or t
  misc_feature (512)..(512): n is a, c, g, or t
  misc_feature (517)..(517): n is a, c, g, or t
  misc_feature (521)..(521): n is a, c, g, or t
  misc_feature (524)..(524): n is a, c, g, or t
  misc_feature (527)..(527): n is a, c, g, or t
  misc_feature (534)..(534): n is a, c, g, or t
  misc_feature (539)..(539): n is a, c, g, or t
  misc_feature (543)..(543): n is a, c, g, or t
  misc_feature (565)..(565): n is a, c, g, or t
  misc_feature (582)..(582): n is a, c, g, or t
actgcactcagttgtncttccggcccagtgccgcgtcagatactaaaccatgggagaaagttcacaccctggnactggncacccatcttcagctctctcctgtgagtcaggacgcatgctggccccangnnctttactcaacanggatggntcctgggaggaagtgggcacagtaaattgnnnggngctcatggcaggggatcattagtcctcagcaaagctctcntctcngatgtcttngtcgtcgacaccannctcggngtnctcaacctcctcactgtcctcttccgagtncgtctcctccagctacttctntttttnttggttcatctncaaaaangaattccacgcctccatcntgtgcangttcaagtagtgcaggtngctgaaggtgtactggnggtagnnggccataaaaacatgcccncatagangtagagcaccncatgcttcaaagncagaatggtgttgganngtggaaaaggaccatgtgaggggctgncggcctcctnaaggntgtnttngtntcagacnggggntganccgacgagttggtgtggtgagnactgcttaatggtgatnatggtgtcattttt

SEQ ID NO: 619415 - DNA, 1084 bp, Homo sapiens
agaaaacacaacgggtttgaattctggaaacagctataaatcacagatggccgacacagagatgactcgcattgacaggcatctgctagtttgcgtagtaatggcgagaacacacatcgtgaacaagcaccaccattggttaacaggacgtagccaacaggatggcttgacttcaacagtatggatattaacgagatgactctgacacatacaaaaagaagctggtaggcatggacctgtgacttggttggtagttatcacaagtatcaagcaactaagctgtagtttctccgaagatggtgtctttactagtgagttagttaggaggaaatagtcagaatatgggatgctgtaagatgggaacttgaaatgtacattatgtccaagcgaggctgggaaaataaggcagcgttagcttggggagattgagcgtgttcaaagtatctacttggtgctactgaaaatggcattctttgctgtgggaatctgctgagctgtgcattggagtggaatgcaaagattcaatgttagagttatggaacccgagtcctaattcagagaatattgctgcaatctctcagtcttcagtgggttcagacttgttggtatttaaacctagtgaggcaaagccattgtatattccacaagggtatctccagagagaaagtccagtggggagagttggtccacgaggatgtgcctgaatccttcagctcagaagcttaccagtgggtaaatagatgccaggtttattccctaacaagatccagacggtattggcattcagacacaagtctccgaaagaaaatccgcaaaaggcagcagtgttacgagaaaagtctcccaagccatttattcactcgcggaaacagggacaccgggggtgaaaacaagcgaaattagaaaggagcgggggaaaccctcagaaaaaaacgcccgaagggggggtcacacaaatcagttctgcacaggtacgggcccagctaaaaaagggcctgaaaaaacacacggcccgatgtgcgagcagcgacgaaacgatgacagacactgctcgcgcatgatgtacagcgaggcgatcacagaa

SEQ ID NO: 619416 - DNA, 131 bp, Homo sapiens
ctctaggtttgaaatttagtcagaaatccatcatacttatttagtatagagttatgtccattactactactaataaatatacatttgattgataacgtctagatctgagattttaatcgttttcctacgat

SEQ ID NO: 619417 - DNA, 462 bp, Homo sapiens
cacagcaggacactgcaaacgacatggaatagagatccctccaaggaggatatgcaaatggccaacaagtatgaaacgatactaaacatcactaccaatcagagaaatgcaaatcaaaaccacaatgagagtactgtctcatatctattaggatagctaatcaaaaaaaaatatagaggccagatgaggctagatccagcagagagggaggcgtgaggtgggcaacgtcacctgaggtcaacagtacaagactagcctaggccaggatggtgacaccccatctctaccaaaatacaaaaataagccaggtataggtgatgcgtgcctgtaatcccagttactggggaggctgaggcagaagaatcgctggagcctgggatgcggaggttgcggtgagccaagatcatgcgactgcactccagccggggcaacagagcacgcacccatataaaaagaacaaca

SEQ ID NO: 619418 - DNA, 128 bp, Homo sapiens
ccctctatgttatggggcagacttctatataaatcaccaatcactgtgctggtgactggactgagaaactgtcgtgctcctgtgaaggtaaatgagaatgtattacatgaatctatatgtggatatgc

SEQ ID NO: 619419 - DNA, 318 bp, Homo sapiens
ccgttagtaggaagtcatctgcccatccctcatctgcgtctgaaggaagtcatacacccgttcctcatctgcgtccctgaaggacgcctaaactcaggcatgggtgaataacttccttcaggacgccatactgaggcatgggtgaattacttccttcaggacgcagataaggaacgggtggatgacttccttcaggaggcaaataagggacgggtggatgattcccttagagaaggcatattaaggaatggttgtttgattccttacggaagcacataagggatgggtggtttacttccttcgggacgccaataaggg

SEQ ID NO: 619420 - DNA, 370 bp, Homo sapiens
  misc_feature (304)..(304): n is a, c, g, or t
ctgaacgcagcctgctgagtacaagtttagatgggagacaaagatctggatgttgatttgccgcaggcatttgaaacgatgggagttgataagatccaccagggaggctgtggagagagagaggagcaggaggctgggtttggggccctgaaagatgccagcatctgaggatcacaggaaatagatctagcaaaggaactagaatgtgcagttacagatgagaaaggtcagtgtagtgtacttgccagctcaagggtgtggcctctgtgaaccctctttctgtagtggatctttcccatcagcngaaaacatcctgttatttccccttttaaataaaacctcagtttgtttaatgcctctcttttactgc

SEQ ID NO: 619421 - DNA, 388 bp, Homo sapiens
atagaatccaggtgaccggtagagcggtctagacgcggtgctgtaactacacacagctcacagcaaggtcggatccttaacccactgagcaaggccaggactgaacccacaacctcatgaatcctagtcggattcgttaaccactgcgccacgacgggaactccctcaagtatggaataattgaaagtattttgcatatctaatcttcctctctattttcactgccttacttggtgtcacttagagaccgctcttaccgagaccgctcttaccgagaccgctcttaccgagaccgctcttaccgagaccgctcttaccgagaccgctcttaccgagaccgctcttaccgagaccgctcagaccgctcttactgagaccgctcttaccg

SEQ ID NO: 619422 - DNA, 233 bp, Homo sapiens
tatttaaatacactcgtgattttttttttgaaccattagaaagttgcagatatgagactaaaacaaaaaagttcagaccgctgttaccgagaccgctcttaccgagaccgctcttaccgagaccgctcttaccgagaccgctcttaccgagaccgctcttaccgagaccgctcttaccgagaccgctcttaccgagaccgctcagaccgctcttactgagaccgctcttaccg

SEQ ID NO: 619423 - DNA, 736 bp, Homo sapiens
agcgtggtcttaccctggcagcgcgaatcgcgcgtaggcggatgcttggttagcgttcaccattcagctttatccgtaacccaccgctatggactaagaacgacttgctgctgtacgtgtattgtactttcataatgtttatcaagaacgttctgaagaatgccctctttcacgatgttctagcacgtgtaattcgccgatagcatgccaaaagcgcttatcgagtagaggctgccaatcgtcctatctttctgtcgtcgcttctgcattccaaacttgtcgctgacgcataattgtaattgtcatagagtccggctggaagcgtccctatttgtgcatgataacactcagactcacttctaatattacgggttgagttgacagcactctgagacctaggaacaggtagagggatacagccatttcggtgcatagttgaataggaaaatggggaaaatcccccgtaaaaggatgccttcgagtcagctagtttggtcctacgcatattagaggggacttaattgggcaacggcatatcgtcaaggccgcacggatagtccattttgacacgacgtactatttcacacatagcctggcgataatttgatgacctctaatggtctaacgggctcttagcatagagagtatagagacataactttcttactctcaattgtttccataccgagcgacgggaacccgagcggtcactttacgccgaattaccatagagggg

SEQ ID NO: 619424 - DNA, 316 bp, Homo sapiens
cgatccacccatccatccatccatccttccatccttcttccatccacccacccatccatccctccactctccttccatccatccatctgaggaccagctgccttcccatctgagcaccagtgtatgccccactttactgcacaaacatgaagagtggccatgggaccgcccgagaccgctcttaccgagaccgctcttaccgagaccgctcttaccgagaccgctcttaccgagaccgctcttaccgagaccgctcttaccgagaccgctcttaccgagaccgctcagaccgctcttactgagaccgctcttaccg

SEQ ID NO: 619425 - DNA, 275 bp, Homo sapiens
taagagcggtctctcaatggaataaagggactggtcgagagaacaaaatagggaatcagtaaaataaggattcaaaaaaatagaataaatcaataaaaaaccagaccgctcttaccagaccgctcttaccgagaccgctcttaccgagaccgctcttaccgagaccgctcttaccgagaccgctcttaccgagaccgctcttaccgagaccgctcttaccgagaccgctcttaccgagaccgctcagaccgctcttactgagaccgctcttaccg

SEQ ID NO: 619426 - DNA, 283 bp, Homo sapiens
aattgcccttgctacctcagaagatatatcaagggagcaaagaccctaagtgccatatcaacacctccaataagctgcagttgacccaaagaacaagccagtccatctcccatgggtaccacacaccctccactactcatcaccagacagggaactctggcttgggcccacagcacagaccctccatcctgggccgattacactaagtgattgctaactcacatgtctctgggatggagcacccaggagacaagcaaagtgttggagccgcgtagtcagatcg

SEQ ID NO: 619427 - DNA, 349 bp, Homo sapiens
  misc_feature (97)..(98): n is a, c, g, or t
  misc_feature (127)..(127): n is a, c, g, or t
ttcatctcaatagatgcacagaaagcacatcagttcatgattttaaaaatcagaaaatggccgggcgcggtggctcacacctgtaatcccagcactnngggaggctgatgtgggcagatcacgaggncaggagtttgagaccagcctggccaacatggtaaaacccattctctactgaaaaaatacagaaattagccaggcatggtggtgggcacctgtagtcccacttactcgggaggatgaggcaggaaaatcgcttgaacccgggaggtggaggttgcagtgagccaagatcatgccactgcactccagcctgggcaacagaccaagaccgtgtctcaaaaaaaaa

SEQ ID NO: 619428 - DNA, 112 bp, Homo sapiens
tatccctgggtcgttcttacaggattagaggaggcggctgaggctgagactgcgcaggacaatagtcaagctcaggaccaggaagagaaagaagatagctgagaaagaaaac

SEQ ID NO: 619429 - DNA, 133 bp, Homo sapiens
gcgttgctgatcatcgtcttgctcgatgtcgggcgtcctctgcttcttccaggtcctcgagatcgtcatcatcccctgccccatcctgggcaccgcgtctccaggaatttgttaagagcatccagcgtgtgca

SEQ ID NO: 619430 - DNA, 366 bp, Homo sapiens
  misc_feature (33)..(33): n is a, c, g, or t
  misc_feature (74)..(74): n is a, c, g, or t
  misc_feature (79)..(79): n is a, c, g, or t
  misc_feature (85)..(85): n is a, c, g, or t
  misc_feature (87)..(87): n is a, c, g, or t
  misc_feature (142)..(142): n is a, c, g, or t
  misc_feature (198)..(198): n is a, c, g, or t
  misc_feature (224)..(224): n is a, c, g, or t
  misc_feature (283)..(283): n is a, c, g, or t
  misc_feature (300)..(300): n is a, c, g, or t
  misc_feature (322)..(322): n is a, c, g, or t
aaataaaaactctgattaaacaactgcaacaanttgtaaaagcaaggcaataataaccctgatccgtccaactnatgcnctgtancnaagacctaagaaggcgagggacttagtaggtatcttcagggtcagagcctgagtnctcgccttgttggttctgaatctgactttgcttccggtacaaacaggccacctgancactggtggtggcctgctccggctgnttgtattcacggactcgaataaaccgagggaagcgaagggagatgcccttgtcactatncaccaggccccgcgcanagggtagatgggagataggganatgtcagcgcacttcacctcccacacagcgctggggtccagcca

SEQ ID NO: 619431 - DNA, 153 bp, Homo sapiens
tcagagacacccaaatctacacagaagcagatgcagccacgtatatgccagtacaggatctatcattgccactccgagggaaaagaggcctggtgcatggccggggctggtttctgcgtgaatactctactgtgcccaattgacatccagcaa

SEQ ID NO: 619432 - DNA, 105 bp, Homo sapiens
ttacctcctggatcttcctaacatatatcttcataacatacttgagaggctgaggtgagtcaatcgatttagcccaggagtttgagatcagcctggacgacaggt

SEQ ID NO: 619433 - DNA, 224 bp, Homo sapiens
tggcgaggctctctaccttctggccttctggtctcttaaatctggaaccacaaacagcaccgtccatactccacttccctctcgagaacttttttttttttaaaagacggggtctggcgctggggcacgggggctcaggctggtcatctcagcattggggaagtccgaggcggccagaacttgaggtcaaaagtacggaaacctatcggggccaactaggctgg

SEQ ID NO: 619434 - DNA, 861 bp, Homo sapiens
  misc_feature (679)..(679): n is a, c, g, or t
gggcagaggtgggaggatcgcctgaacccagaaagttgagggtgcagttagctgtgatcgctcccctgcacttcaggctgggcaacaggagtgagaccctgtttcaaaaaaaaaaaaaagaggcaaaacccgggcatggggtctaatgcctgtaatcccaaacactttgggcaggctgaggcaggtggatccctgtgagaatcaggagtttcaagaccagccgtggccatgtgtgtggttgaacccgcattgtcgtactaattaatagaaaaaattataggaccgggacgcgggtggactcacagccgtgtaaatctacagaactttgtggaaggccaagcgcggggttggattcaccaagaggtcaggggatgttagaacagaccacgccttgggccagggcttggggtagaacaccccgaatcgtctaagtaaaagaattaccgaaaaaagcgctttaacagcacggcgcgtgtggcagtcgcgcaggagcagccttcgcaagtcccccagagctgtacctttggccgagacggcttaaacggcgcacggcgaagacaacttgcgttcttttgaacacccccatgggctaggggacgacgaagtgtcttgggcccaggtggagagactgtgagagcgcattctgttgcccgactcgtgtgcgagacctcccagaagngctgttggtgtcttgcacccggcacagttagaggaaactccccgagtcgttgcgggatcgacgaacgacacataaccagtagaggaaccaagcgacagaacacagaaaacaactcgtcctggaggtgtccccggagcacctgggagagccgaccacctgacagaataagagcatgcattgag

SEQ ID NO: 619435 - DNA, 499 bp, Homo sapiens
  misc_feature (282)..(282): n is a, c, g, or t
  misc_feature (300)..(300): n is a, c, g, or t
  misc_feature (311)..(311): n is a, c, g, or t
tgaagataaaagatattttataattagaaaaaaatatatgtaaggttataaaaaaaattttattttatagaaggagctggtgttatttcagagataggctggctagctgtatagtaggtgtttaggtggaggtattatagttggtatcctgtgtttaattctgtagatttagagatttaatgtattagtttatttagagtaaattaggtggaattttcatgataaagccccatgagcttttttatatctgttcagtctgagcagtgttacaagtgaagggantgaagtattttgataaanttaggccaagntgaatgttgttcattttttgtccagtttgggtcgtggacacttgattgttccaccttgttgggggtatcacatggaaccaggaaattttcaagtggcttaaggatctctgaaatgccagtaactcagatcttgtggtatttgacatgttaaacttggaatctgaatatgccgttgccaagattggaca

SEQ ID NO: 619436 - DNA, 312 bp, Homo sapiens
aaaaggggtccccccctttaaaaaaaaggaaaaaaccttttggggccccagggtagggctatctttttaaaaaatggcccccaaggggaaataaaccatccgcttggatgggcccttgaataaaaaatggttatacccaggggtattggtaaaatttttttcccctttgggtgggttgcatcttttttcccaattgttaattttaaacccaaatgttaaaaatttggattacctgaattttgctcttggatggccaaaaaattagtgggtttaaaaaaaatctatagtttcccataaacccctgaaaaatta

SEQ ID NO: 619437 - DNA, 208 bp, Homo sapiens
agaggttcccgcgaaggactctgtgggctacgagtaagcacatgctatgaacatcacccagcgcggcaacgtcgccctgacctcggagtaaatgccccctaagagaaggcgtctgatagaccctggttattggctctcttcatttttgttgtctgtggttctgcaagttttccagaattattccaagttatcagcgatggcgcatgct

SEQ ID NO: 619438 - DNA, 265 bp, Homo sapiens
  misc_feature (65)..(65): n is a, c, g, or t
  misc_feature (153)..(153): n is a, c, g, or t
  misc_feature (161)..(161): n is a, c, g, or t
  misc_feature (198)..(198): n is a, c, g, or t
  misc_feature (220)..(220): n is a, c, g, or t
  misc_feature (262)..(262): n is a, c, g, or t
ttattgattccaaaaatccggactccgtggagctggggcagcttggggataagcacgctcatcanggacaccgtgttgggcacaaaatggatctggtcgtacttagtgtagaagctggtgaaggaaagtacagcacgatgggtgtgatggtcnagaacttncgagaggcccgtgaactggaccccataatccatctgntccagtggggttaacaaccttngctttgcctggtcccggggtctcaaaagggtggtcccctttnccc

SEQ ID NO: 619439 - DNA, 382 bp, Homo sapiens
catctacgatccctctggatgacgagcagactccatctcagtaaaaaaaaaaaataaacaaacaaacaaaaagacttggactccaaaagggaggtgggaaaatggttaagtgagcttggttctcatttgccatcacagggcttaaatgaaagttgataaaacaagaaatagcagtataagaaagctacccaggctgggcatggtggcttatgcctgtaatcccagcacttgggaaggccgaggcgggtggagcctctgaggtcaggagtttgagaccggctggccagcatggtgaagccccgtctccgctaataatacaaaaattagccgggcatggtggtgcacgcctgtacgtcccagctactctggaggctgaagtgaa

SEQ ID NO: 619440 - DNA, 264 bp, Homo sapiens
  misc_feature (216)..(216): n is a, c, g, or t
caggtgcagtggctcacatctgtaaaccccccactttgggaggcaggaggattgcttgagtccagaaactcaagaccagattgggtaacatagagagaccctctctctacaaagaattagttgggtgtggtggcacacacctgtagtcctagctacttaggaggctgagtgggaggatcgattgaacacaggaattagaggctgcagtgcacctantgattgcaccactgtcctccaagccctgggtgacagaagaaagactgt

SEQ ID NO: 619441 - DNA, 141 bp, Homo sapiens
gcaggtgactatgaccatctcccagaacaggccttctatatcgtgggaccattgaatgaagctgtggcgaaagctgataagctggctgaagagcattgattgtgaagggtctttgtcctcgggtctgtttctctccttgtg

SEQ ID NO: 619442 - DNA, 326 bp, Homo sapiens
ctaaatatagtataactaggccgtaattataacataaaggcagacagcgaacataatctatattctatatcctagtgcgaagctaaactagtaggcaaacgtaatcatcatcacacgcgtgaggaaaccgagaagcagaacgactcaatgcaggactttatttcctattctacaccctagacaggatccctaccactgctagtagcactagtttatatccaaaacaccacaggctcactaaacttcttaattatccattactgatcccacccattatccaactcttgatcaaaaatttaaaagaaaacttgtctccttagcattta

SEQ ID NO: 619443 - DNA, 743 bp, Homo sapiens
gttaagtctgtgtgatttgtaaactcatgatcatttcaggtttgtcagtgttctagactggatgaagatgacaggctagggagtggagtactggctagtgtgagttactgtcctgcatgaaggctgaggcttggaatagtgtagtttgtctctttgaagctgcatgtgggcctgggcattccaggtagaaattatattattgctgtaagtagccccctgggatttccttcccccctggtaggaaatttttttaaaaaggtttttttccttccaaaaaataaaaaaaaaaaaaaaaaaaaaaaaaaaaaaaaagaaaaaaaagaagagaaggagaaaaagaaaagagaaagaagaaaaagaagagaagagagaggggaaaagagagaggagaggaagaggaaagggcgggggcgaggagggagaggaaaagggggcacgagaaagggcggggggggggaacgacgcacccccagaaagggccacggaacgggagagaaagaggaggtgcaggggcggagaggccgcaaacgccaggagcggggcgaccggaggcgacgagctggagaggaagggaataagaagaagtggcaaaggaggcggaagtcaaagctgcgagggagagagatagaacggtacgagacgagaacgaccggcgcacgtaccgagcaaaacgaccacggggagagagagcgacgagaacgacaagagggcacgcggcgcggaggaccaccacacgaacacct

SEQ ID NO: 619444 - DNA, 107 bp, Homo sapiens
ggctcacagcttctccggcgcacagcttctccagtcctgggtgacagagcgagactccgtctcggaaaaaaaaaagaaagttttaattttttccctgaaatatctca

SEQ ID NO: 619445 - DNA, 178 bp, Homo sapiens
tgtgccagctctttagtatcttcaagatgagtcataatgaggatcatgctgttcagcaatgaagagcaagccccgtatggcaatgacagtgccaaatgccagccgggccaggaccaaaggccggtgatctccgagatacaggcatcttccttagacttgaatgcacctagaatgaaac

SEQ ID NO: 619446 - DNA, 372 bp, Homo sapiens
tggtgatggatgacgggatgactgctgccgactgactccggcgagctggagtgaggagctgctccctggagtgaccactgctccccagtcagctggccaggccaggtccagtcatgacccccagaccacccagtcctccgaggccggctggtccagactgagctgcatgagctggctgtggatcatgtttcccacgcaggctctgcaggccaccctcaacgactaaagcacgacgagttctgtggacgctgattccgctggcccccagtgccccaggcatcggggcggtcgtccaagactaactcgtcgacttcccggacatgctcctcatcctcgagtctgtctcgggttcctgcatcccgaacacaaccc

SEQ ID NO: 619447 - DNA, 871 bp, Homo sapiens
  misc_feature (16)..(16): n is a, c, g, or t
  misc_feature (75)..(75): n is a, c, g, or t
  misc_feature (84)..(84): n is a, c, g, or t
  misc_feature (98)..(98): n is a, c, g, or t
  misc_feature (104)..(104): n is a, c, g, or t
  misc_feature (122)..(122): n is a, c, g, or t
  misc_feature (125)..(125): n is a, c, g, or t
  misc_feature (130)..(130): n is a, c, g, or t
  misc_feature (139)..(139): n is a, c, g, or t
  misc_feature (215)..(215): n is a, c, g, or t
  misc_feature (247)..(247): n is a, c, g, or t
  misc_feature (253)..(254): n is a, c, g, or t
  misc_feature (274)..(274): n is a, c, g, or t
  misc_feature (293)..(293): n is a, c, g, or t
  misc_feature (346)..(347): n is a, c, g, or t
  misc_feature (454)..(454): n is a, c, g, or t
  misc_feature (459)..(459): n is a, c, g, or t
  misc_feature (461)..(461): n is a, c, g, or t
  misc_feature (464)..(464): n is a, c, g, or t
  misc_feature (466)..(467): n is a, c, g, or t
  misc_feature (592)..(592): n is a, c, g, or t
gccccacacttcggcnacctcacatcccttacctgccagtcacctgcggttattactgctgcgcatcttggcgcntgtggggcnggggggggggctgntggtanggggttgggttatgtgtnggnggggntgcgggggngcctttttggggctttttcttcctcctcccatccaatggctttgctttgggggagtcacattacttggggctagtntgggtggcggcggcgcccggggggcgtcggtncttgtnngggggcgatgcctgtgtggngcacttttgcaccacaggngaaggggggggccactctcgtgtgagactcctgcggggtcccttaataggggnngggggcgttccatcaagttcttctgggtggtgttattgctgtgcatttgttggtgagtcattttctgtgctgtgtttgctttgagggggtcttccaatgtatctccnatgtngnggngnngtggtgtccttttctttggctggggtttcacataactctaatgctttattaagaatgtcttccttattgtcacactgattttctagcatgtcttcatagatatccacaagaaaggcaattaggtngggggaactatgacttggttgtaaatcaagtaattgatttaacagattaggatatttggaaagaccacgatcctgcaaaatccctttcaaatagttccatgcactttcattatgtggtactagtttaatcatttccagagtgtattggacttctctctccaatacagcacgatcattgtagccagtggtgttagaaataacgaagtatctttggttccagacagagttatttctcacatcctctttcagaagttggtccacatactgcagctcattatc

SEQ ID NO: 619448 - DNA, 313 bp, Homo sapiens
tgatctagaggatcccttgagcagacgtgatggcaatgaactctgagagtaggctattcaggtaggacagtcccatgcctcagatcgaattcttatatgcttttcacttgcagtcttacccttcgtgatagcagacctagcagacactccacctcctattctgtgcaggagacgcggatcaaacatccccctaggaatcacctcccacttgccgataaaatcaccttccacccttactacacaatcaaagacgccctcggctttcttctcttccttctctccttaatgatcatgccacacggtctctcaggga

SEQ ID NO: 619449 - DNA, 378 bp, Homo sapiens
ccacttccaggcatgcatgagaggacgaaaatacggcttaggacaagaataaaaatcagtcaagagctgcctcttattagcaaccatggaggccaaaagaaagtggaccaacatccttaaagtgctggaagaaaaataatgtcaactccaaatactatatccagtgaaactatcatttaagaatggaggtaaaataaagacattttaagatataagataactaaaagaactcatcactacaagaaatgttgatgatggttcctggggaagaataatagtgacaccagaaggaagctcagaacataagggacaaacaaagagtatcagaaatggtaaatatctgaataaattcaaaatactatttttcttttttgcctt

SEQ ID NO: 619450 - DNA, 258 bp, Homo sapiens
atccctttgggattttttaaaaaaaaaattgggggttttttaaggtgaattttttgggttttttgaccccgttttgtttgggcccaaaacccggtttgggccaaggatttagccaattttttttttttttttaaaatggggggggggggctttgggtaataagggaaagttttttttttaaccccttttttttcccggataatttacatgtttacccctggggtaaaacccccccataaaaaatttttccaattttta

SEQ ID NO: 619451 - DNA, 986 bp, Homo sapiens
agacactattatggcgagcaattacatttgtggcaatatgctaggttcagcaggccagactagcgatcccttgaacaatagctgatggacgaccacacttcaggataccggagatgagcgtggactcaaagcccagctttgtcatttactcatgtgcagcctcagtaaagttgcttcagtaccgccctaactgaaaataatagtcacgctgctgtccccatacagaggggctctgcggatgacaggagctgatgtgagcagagcctggcaccacagagccaggcatgaagtcaagcacatccataaatagtggacaacagtgaccacttgctgaccaggcgctctccaggtgggataagagtagtatagggcatgaatactctgaacttctctggataaggggctcactgacctcatctatgcctgggttgcacattataactctaatcttaacaatccaccaaatcaagaaaagatctcacaggttggagttttgccaatcatcactggcctggacctgaaaatagacgttctaccagagagggttagttcaagcattctgccatgtgatctgggagacacagatcctgaaaataccttggggatctgctgcatggtgtgaccccaagtgtgaaacccagctatggtctactgatcagagcaggggactttcccctataatccccttacctcgacagggcaagaaataaaccctgaagactacctgcaggaccaccaacatgggagaggaacataagctaataccaggaaaggaaagaaaagcctaaaaataacggccaaccacacaaacgacaacaacacaagaccacaaaaactacagcgagaatacgagaaaaacagagatcagacaacaagagacgaacaaacagacaaactataaaaagcagaagaaagaagagacaacacagagcaggaaagagaaaaagaacaagaggaagccgagcgagcacggagaaaacaaaaac

SEQ ID NO: 619452 - DNA, 510 bp, Homo sapiens
  misc_feature (66)..(66): n is a, c, g, or t
  misc_feature (96)..(96): n is a, c, g, or t
ccgcaacaactacgcgctggtcaagcagtccgagcaggagcgcgagaatgctgcagccgaccaggnctggcagctcttgcccaaggcaagcgcatncccgaggcgatcctcgcgcagatgcccgggcgcgagcgcgtgcagctgcaggagtcgatgcgcgcgcgggccgagcggttggccaagggcggcaaggtcgaaacggactgggatctgtacctgcagttgcgcgagcaactggccgcgggcgacccggtgaacctgcgcgcgtacaccgagcgcatcgcgccggcccagctcgagcaactggtcgacatccagaccaaagcacgcagccccggcaagcaacccgaggtggccaccagcgagcagcaattgtcggcctacacgtcgcggctggagttaaagggcgaacgcctgggacattcaagtcggcggcctacgacgcgttcaacgaacactgcgccgtaccggccaaggagccgacgttcgaggcgccagaagattctgtac

SEQ ID NO: 619453 - DNA, 605 bp, Homo sapiens
acctcgggatacttgatagaacgcaagacgttgggcgcgcggagtccagctcatggtaagtggacatggtcatagcatgtatccaaagagatcctggtgcttgacctatgtgcctataggcatttacattgacccaagtacatgtaatcgtcccgcgtagggttattcgaatacgtgacattgatgcaaatttctcacgatatgcagtatcgcgagagtacctatacgtcatctatcacaaggagtccacgatgagactcgtctactctaagttacgacctgtatacatgtaaggccccgtgctgtggtggcacatgcctgtaatcccagctactagggaggtggaggcaggagaatcacccgaacctgggaggcggaggctgcggtgagccgagattgcgccactgcactccagcctgggcaacaagagcaaaactccgtctcaaaaaaaaaaaaatttaagggcccgtgtgcagaggctcaccaactggtaatcccacagctctgggaggccaaggtgggaggtcacttgaggccagggagttcaagaacaacctggggccaaccttaaaaaaggccccatctctacaaaaatatatatatat

SEQ ID NO: 619454 - DNA, 167 bp, Homo sapiens
ttatactatgctgtactactggctgtactaaatggctgtactaaatggctgaacctaaatggctgtacctaaatggctgtacctaaatggctgtacctaaatggctgttacctaaatggctgtacctaaatggctgctacctaaatggcaactcgtgatcgccaaat

SEQ ID NO: 619455 - DNA, 798 bp, Homo sapiens
ggaggggcgtggtgtgatgtcacacggctcatcatgggccaagccaagtctgtggccacgtatcataccagtgtttctcccttgtgcctgcctaaagcctttctgggcctcacactttcagacccaaaggccaggagaacaggtctgagctcagcccccatacccatcgcccacgggataagctgtccaggccgtcccatggtctgaggatttacagggttgtgctaggtccactgtgcactctgaacagttggtgcctactgctaccatactcacgtgtatacaatagcatgaatggtgcgcgatgggacctgatagagggaagacgggcaaccgccgggtccacatggctcggtcacggatgtgacgccggtctttctcggagcgcagcgtatggcgtatagcagtgacggtcaacggagcctcccccaggtacctccaacctacttagatgattcaggactcatagcaccacccacgaagagctacgactttggccacaatggcgaacacttcggtgcttatgttgtcttcaacgattgcgttggtgggctatgggcccgtgggggggagcctcgttgtcaggagctcagcgtgacttggcatttgtacttgttggtatagacacggtgtcttctgattgccggcttcctcatgttcgcgtggggattgctcttggtaatccacgctagggcctggacggctccttaacgtgcccggcacgcgtcgccctggctcccttgcgggcgctccttgccccgttcgcagaccgtgcggagcccctctcgctacccctcc

SEQ ID NO: 619456 - DNA, 366 bp, Homo sapiens
gagcttagatgacgtggcatgtgactactgctgggaatgagaagggaagaacgactgtaactataacagaaaggtggcaaccatgaagaactggagaaagagcagagccagaaccaatctccttggttccagtccagttctttttcctccaatgatacacacttttccattacagcctagatttctgattgggcagcgatatggggacactgagggaggcaacagatttggggcagggcattgaattaagcagttctctttatagctatgtgaagtttgcagcatgcctcattagcatcatcaaagcagaccatggctaagtcaaaccagctcagcatcagttcccaggcacagcagttcagcagt

SEQ ID NO: 619457 - DNA, 470 bp, Homo sapiens
ttaggcgcgttctgcgtgaggttaggtgtaaaataggcggtctggattcccacccttctgttctgagatgggggtggagggcagtatctcatctattgggttccacaactgctcacgatggatcaggcaggaggcttctatagtggccaatacttaccatgttggtgtcccatgggacagacatgatacttcaccattagatgcccatgcacaccactgtctagagcaacacgatggcgcacagacagtgtcaaccgtatgtagttaacacgggtctccgcttgtgggatcatcagtgccataccacaaacttcatgcgatttatgccctctgtcctctggagtttcccatgacaccaaaaaactcgcagccctttggtccccactctccactgatgaaccgcagcacaccatagcaggccctccgcacagcaagccctcctaggagtttgtaacgcagaacgcgcctaa

SEQ ID NO: 619458 - DNA, 109 bp, Homo sapiens
cagtccacactgctgcgtaccctgacaacctgtaaaagcaggttcataaataaagccgtgggcagctccctggggggaccccaagaatcacattttattgctatgacac

SEQ ID NO: 619459 - DNA, 331 bp, Homo sapiens
tttttcccccccccccaagggggggttggggtgtttttttttaaaaaaccccgggggaaaaaccctccggctctttgtgttaaccccgggggggggggcccacccccttccttcggaggggggggtaagggggggggggggggggtttttaaaaaaacgggggtccccccccgggcctcggggtaaacccccccggggggggggggggtttttccccccttttttttttttttaaaccctaagggggcccccccaatggggccccccgggggcccccaagggggggggggccctttttttttccccctttccccttaacggggttttttta

SEQ ID NO: 619460 - DNA, 517 bp, Homo sapiens
gggacgtgatagggtattcattcagaagacaaactcttgagttcgagagagtaagagtgcgtgagctctgctcctggcttagatgacggcatgtctctccgctcagaacatgagacgtgcacatcttcaaactcgagactgtaaagaaaaaccccagaggagccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgagtgccccttagtcactcagacatacggcgcagctgcaggaaa

SEQ ID NO: 619461 - DNA, 770 bp, Homo sapiens
  misc_feature (14)..(14): n is a, c, g, or t
  misc_feature (32)..(32): n is a, c, g, or t
  misc_feature (79)..(79): n is a, c, g, or t
  misc_feature (89)..(89): n is a, c, g, or t
  misc_feature (92)..(92): n is a, c, g, or t
  misc_feature (97)..(98): n is a, c, g, or t
  misc_feature (122)..(122): n is a, c, g, or t
  misc_feature (129)..(129): n is a, c, g, or t
  misc_feature (138)..(141): n is a, c, g, or t
  misc_feature (149)..(149): n is a, c, g, or t
  misc_feature (158)..(158): n is a, c, g, or t
  misc_feature (160)..(161): n is a, c, g, or t
  misc_feature (164)..(165): n is a, c, g, or t
  misc_feature (167)..(167): n is a, c, g, or t
  misc_feature (170)..(171): n is a, c, g, or t
  misc_feature (173)..(175): n is a, c, g, or t
  misc_feature (183)..(183): n is a, c, g, or t
  misc_feature (201)..(201): n is a, c, g, or t
  misc_feature (205)..(205): n is a, c, g, or t
  misc_feature (222)..(222): n is a, c, g, or t
  misc_feature (231)..(231): n is a, c, g, or t
  misc_feature (234)..(234): n is a, c, g, or t
  misc_feature (264)..(264): n is a, c, g, or t
  misc_feature (269)..(269): n is a, c, g, or t
  misc_feature (275)..(275): n is a, c, g, or t
  misc_feature (278)..(278): n is a, c, g, or t
  misc_feature (283)..(283): n is a, c, g, or t
  misc_feature (288)..(288): n is a, c, g, or t
  misc_feature (297)..(297): n is a, c, g, or t
  misc_feature (309)..(309): n is a, c, g, or t
  misc_feature (315)..(315): n is a, c, g, or t
  misc_feature (317)..(318): n is a, c, g, or t
  misc_feature (344)..(344): n is a, c, g, or t
  misc_feature (346)..(346): n is a, c, g, or t
  misc_feature (350)..(350): n is a, c, g, or t
  misc_feature (399)..(399): n is a, c, g, or t
  misc_feature (408)..(408): n is a, c, g, or t
  misc_feature (414)..(414): n is a, c, g, or t
  misc_feature (427)..(427): n is a, c, g, or t
  misc_feature (436)..(436): n is a, c, g, or t
  misc_feature (445)..(445): n is a, c, g, or t
  misc_feature (500)..(500): n is a, c, g, or t
  misc_feature (513)..(513): n is a, c, g, or t
  misc_feature (528)..(528): n is a, c, g, or t
  misc_feature (541)..(542): n is a, c, g, or t
  misc_feature (549)..(549): n is a, c, g, or t
  misc_feature (551)..(551): n is a, c, g, or t
  misc_feature (555)..(555): n is a, c, g, or t
  misc_feature (561)..(561): n is a, c, g, or t
  misc_feature (678)..(678): n is a, c, g, or t
ggctcatagatggngccttctcactgtgtggnggaaggggcaagtgagccctctgggttctcgtttttgaaatggagtntcgctctgtngcncaggnnggagtacagcagcacgatctcggntcactgnaatctctgnnnnctgggttnaagtgattntnntgnntnagnntnnnaagtaggngggagtatagggatgtgngatnagaggtagggaattttngtagttttntgnagaaagagggttgaggatgttggggagggnggtgnggaagnggngaggngaggngatgggggngggttggggggngaaagngnngggattagaggtgtgagggaatgtgngnaggntgggttgtgttttgtaaggggagttagtggaatgttgagggttgtgggntggtgatgnaataanttgggaaagaggnggaggtggnaatatgagnttgggggttgggattttaagatagaaatttaggggaaagagatggagaggagagnagatggggaatgnttagaggtggttggnagatgtaaaatgnnaagctananttgnatttgntttttttaagattatgaaacttcaaaatatatgaactacagcccatattgaaaaataaaatagattgagccatatgcctaaaaaagacctcaagaaaagtttgaggcaaagcatgtnagtgttacaggaaatggtccaatagagggggaagaaaaaaagcatgctactagccccttttcttgtaccgagaataaaaccatgcagatctc

SEQ ID NO: 619462 - DNA, 831 bp, Homo sapiens
cttaaagccaagaggtggttctaacgccggcggcaccctttaggggacagaaaaccagttggaaagaacgacacggcagatactagcaatgcccctggtcccccgtctccttcatattgtggggtgccacgccctactacccccctttggggcgaacaagcctcattcgtgatcataagtccgtcagtcaaccacgcatcccccgacaaacacgggtcttcctgtcatcgcaaacaagaggttcttactaccgtcaacaagaatgtcccccacacacaatgcttcgcacgatagtctgtcgctgtataaatatagccccgtcccacccacctttgagaaaattatttttgcgccccccccggcccccgccagctaaaagtatattctttggtgcccacaaaaaaatcggggaaccaaaatttgaccacgcgtctcaatgttgaggtgaatctttccataacccttcttgggccgccacaacctcacacactcggggtgccacacacgatgctcttgcccaacacccctgcttctaagaagcggggtgatttattctcctcactcactcatgcgaatacttcggcccccccagtttgcttaggatacaacaagatgcggaggttcttcgcggaaggtccttgaagcacttgcagcaaacattgtcgggccgaggatctctccgaacagcaacttctatccgtgcacggtgatctccgtatctgatttatggaaaaacgtggtacaccggcgcttttttcaaccaacaaaagggaccagaatgacaattccgtccccccaagcttaaaaaacaacacttcgccccacaaaaca

SEQ ID NO: 619463 - DNA, 181 bp, Homo sapiens
agtgctacctccacaacgtgtattgccgtggaatgtggtgaggtgtgtgtgtggtgtgtgtgttgtgttgttgtagtgtgtgtgcagtttggtgtgtgctgtgtggtgtgtggtgtgccgtgtgcgtgtatagtgtgcagtgcgcagtgtgtggtggtgctggtttgtggaggtagcaggt

SEQ ID NO: 619464 - DNA, 734 bp, Homo sapiens
tgttgttctctttcttctggtttcctcctggatatgtcttcattgggtctgtggtgtccgtggtatttcctatttcggggctgtttggtcttttttgattggtgatcttttcgctggctgtcttgttacagtggtctacatgccaattctctgtacccctgtttgtggctttggtagccggtttctgggctttctttcgtcgtggccttttccgcatgcccatcggttggtgctcatcgtgctgtgtccggccccagtttccgggctgttttggtctgtgtgtatactttgtgatgtaattttgtcaccagtttgatgcttttatagtttttcagtgaccctatccttttttatgtcacatcacggttagagttgtggttcacgggaagagaagcatgaagccccaggttgagctgaagtaggtagtaaataggcggtctgccccttgtctcctgtatgaggagtatcggatgatatgtgagctaggcgtcttgtctttctgagccctaagtcccatggtaccccttcgctcacctgctccaagagtacctttgtgttggatgaatttaagcgcaagtactccttatgaggacacatctctctgtggcactgccatatttctgggagctactttgataaggacggctggtccctgtggtactctagagtatcgcttccctgaagaactcactcagaccttctatgagctgcaatctctatcactggaatgttca

SEQ ID NO: 619465 - DNA, 1401 bp, Homo sapiens
agcggatctcgttggcacagcagaagtccatgcatggcgcaaccttgcacttccagcggcctagcacctgtaactctttctatccggcaagtcctacaggattgcggcccggtgcctatctgccgtcttgtgttgcgtggagtattatgcatgcgatcaagctataccctatagtcattgaaaaggagtaatacgatctaacgccacattgtaggccaaaactgtccacttcacctgatcgcactcgcttgatgtatctactcccgatccaattctgcatgaagcatttatgcaatcccacttctacacaggttccctgtcttccactgggcagacaagttgaattagataacactatccactgagtcacccaacattcacatgcgaagggatctcgggtgagaccaggagaccacgtctgtcttgtgaaccctgcaatgtattccccaatgtgagaagttaccggtaaaccatcgtatagcatatgtaggacgaattgatatcgtgtgcttcaatgtccctagtccccgtagtcattctgttcccacgttttttcctttatattggtacttctcccagtaccccagtgcatctcccacttatttttggttgattccgtctggttttattcctaggcttgtgcctagggtcatccctttgcattcttcgcgaagatcattcctttgtgatagagtaccgagaaaggcattcccattctccattagtaccttacctttattttctttccttggggggcttgttccttttgtttcctctggttcagttcccatggttcccttgtcaggataaatattttccagaggttataccaatctgtggggggccccgtccatttttttggcgagtggggcctgctaattccacttgattcttcttcgaaccaaactagctcgtatggttggggctcggtgatatatttaaaaaagtaccctttgtcgtttttgttcccactccaagctcttctttcggttatggtggttagccctgtatgttttaaacctcttcctatgatttacttcctgtggcaccgggcgctgttttttaacgttgttaccattaaccctggtgtgcctgttgagcatagaaaggtttttggccggcagtccttttaggaacctggttttcacgtgtgaacttggcattggaacggcctgagggcctataatattttttttttgaagcgggtaaaacaacaaactgggtgtccccccttggttgcaatttgtgatgtgtgtacaagaaacaacgtctcatggtcttaagagaaaaacgcgaggcatgttctccacacttctttgtgtgtgtatgcccactcacaagcgcccatggaagatatagagtagataaacgctcggagagagcacattactccgcagaaca

SEQ ID NO: 619466 - DNA, 356 bp, Homo sapiens
cgccttccaaacgtaatacccaatatgtgtagaataatgttctgaacaatgtatacatgcttatttatgtaagagatgtgtacttcattgcttcctccgtgtgatttccgaagcaaagcaatgggaccctacgcttcagagtcttattggggtggggcagtgtccattgaggtgtcctgtcgggactgagaaatccctggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgctttggca

SEQ ID NO: 619467 - DNA, 412 bp, Homo sapiens
gtcacaggtacatcactgttacagcatgtgtgagaatttgttgctttttagagagtgaaaaatattccatcctgtgttgtattagtcaggtttcgctagagggacagaattaataggatggatgtatatataatggggagtttattaaggagtattgactcacatggtcacaaggtgaagtcccacaataggccatctgcaagctgaggagcaaggaagccagtccgattcctaaaacctcaaaagtagggaagccaacagtgcagccttcagtctgtggctgaaggcctgagagcccctagcaagtcactggtgtaagaccaaaagtccaaaagctgaagaacttggggtctgatgttcgagggcaggaagcatccagctcaggagaaagatgaaggccggaagactcagc

SEQ ID NO: 619468 - DNA, 106 bp, Homo sapiens
tctagaggtccctgatatgctgctcatttacacatcgggaaactgagggtcaaggggttagcactggccaatgttaccagctactgagtaggataggtctttttac

SEQ ID NO: 619469 - DNA, 302 bp, Homo sapiens
gtcgacgaggaaggaaggaaggaaggaaggaaggaaggaaggaaggaagggaaggaagggagggaggaaggaaggaaggaaggaaggaaacgaaacagaggcacataattaacttgaccatggcaacagggcaaataagcagcagagccaggattcaatgcaggtagtctggctccagaccactccaccatatgcaactaaaggtaaggagcacatagaaactccatttctccccactgttccagttcccttttgctatttcattcttttgactgcttttactgagtactcactaaatgcag

SEQ ID NO: 619470 - DNA, 175 bp, Homo sapiens
tggatttatttccagggcttatattaaagaataaattagttcttcataagaaggagaaagtaaagtgtgtgtttgtgcgaggccaacagaagaagtctccagtgttttttgagaaaagagaagtgcgtgtgaggctcccgtaactcgtggtgcctcgtggaggggggtggctcag

SEQ ID NO: 619471 - DNA, 790 bp, Homo sapiens
tttttttttggggggggcacattctttaataacttcctgaggaaaaaaacttgggaagtaaatatggtggtaaatatttggaaattttggcatgattaagatgttctgtatttctggccctttaacagaaaatgggtggcttgagcattagaatgtgacggggtggaaaaataaataccctcccttagcccctcccaagcgtgcgggtggagatttcttgatgccattcttgatcccgtacctttatatgtgacttaggttttttatatccacccttccgggaaacattttaagatctcttaatctggggtgtctgacactgggtcagtgagggctgtggtattcccgggttgtcaaacacctggtgcggggcctttcaggggaaatttctataaattttctgggtgattattcacattctttcttccgggaccacctattttttcattgtgggaccctccccttaacccaggcttgagtgctcataatattttaatcttccatataaccgcctagtgtcggatcgcttcaggaagaattaatccatctttatcttcccaatctgaatgtggaatggaaatcttatctgccaaggtaataaaccctgggcttttagcaaacacaacacacacacagaacaaacacaagtgggggccgcgcgcccggaaagttacaacacacctgggggccggccaggggagcaatgggactaaagggtcacaacccgccaaaggggcgtcccaaaaaccggggaccgcgtgacaccagggccggtcaggcaaggcgcgaa

SEQ ID NO: 619472 - DNA, 592 bp, Homo sapiens
  misc_feature (102)..(102): n is a, c, g, or t
gagcgagtcagggagtgattccaatggaagcaactgcagaggtggtgtggccgtgccgggacttgcagagcttttctgcttattttcaagtgacgcccgtgntggcaccttagctccaggtgagtgggtctgagaaggcggctctgtctggcagtctcccaaacagggttggacttcctatgcaccttcacctttgcctggggaaagctgggttttacccgagaatgctggggaacataggctgggctaagtgtgttccctagggctatataggggtttcccccgctggcctggagttgtcaataatatttacaaagacaaatcccaggttccttgatcttgataacggtagatggaaaaagtttatggtgttattctgtgttgctttaacatgagatcaacaatgagttgccttccgtctcaagatgataagggatatttggaaacattttgagaacaattttttagcctttaccatctggttgacttctccctttaaggctatcttcttggcctggtgcagtggctcatgcttgtgatcccagcactttgggaggccgagcgggtggatcgttgaggtcaggagttcgag

SEQ ID NO: 619473 - DNA, 1406 bp, Homo sapiens
taaaggaaaaaaaaaaactacttaatttctaccagggccatattagcagtagaaacattttaaactggcaagaaattggtgggttttgggtctcaagaacacaatgttggtcatattttctcaccccctgattatggggaaaaaaatcagttctggtcttggtgggtgttgctctactatatgggaagatcacacaagttacactggtcgactggcatgtccggcccctattcttggttatcaaacacatatctatatttcataacatggctttcacgtacattggacacaacacaaacaacaacaaaaaacaaacacaaacaacacaacaaaacaaaacaaaagaaacaacacacaacaaaacaaaatagaagagagaagccgtggagacgacatgcgatattacaacacacaggaaagaacagaacacagcacgcgcagcagagccgcgccgcgccgccaagaccaccagaccccgagaccgcgcaagtagcagccgacccaccgcgcgcggccgactcctaaaacagagcacagaggaggagagtccgtggagtgtaaaacaacccgaaacgagattccctatagggacgacataggaggaaaaagtgagcgaacccatagtcacatcacaccacccagacaaacacatagcccagggtggccacatcaaaaacgaccagacggactaagacagctactgtattagaacacacgaagtcgcaaacaagcgtatagacagaacacacacatcacccacgaatcaccatatagcaacaaacagaaaagagaaatcaatactccacatatattcctttctacctaagaagccaggccatacaagcaacactacttgcactaaacaaggacggacgcacggcaccacgcgctcagaagaggactcgcccccccagacgcccccggaccgggcgaggtcggcaagacgcgcaaggaagagaaaaggggaggacacacggcgccaaccgcacccgtaaccggcagcaaggcccctgacagccagccgaacgacagaagcggccgagccacgcgcgcgacggccagcgcggccagcacacagggcgaaggcggcccgacgcacagcacgcaacgggggaagcaaaggcaagcaccggagcagcaagcgaggccggagggaggcacgacgggggcgggaagcagagagcgcgagaccgagcgcgcgcagatacgcacgggcacagcagggcacgcgacagcctcggcagacaactaggcgcattgcggagcgccgaggacggagcgggatggcagatagagagacaggcggagagacaccgacaggaagccggatcgagcgggacaaggaagagcggacggggcgcgagcagcgcaggagcgcgcagggagacaagcgaaaggaagacaga

SEQ ID NO: 619474 - DNA, 138 bp, Homo sapiens
ggacgacacctattgcctccatcgtcacgggggtggaggagggccgcctgatcttcgacaacctacaagaagtcctattgccagaaccccatttggccagacacccggggtactcctctagtagatcgaccatgcagg

SEQ ID NO: 619475 - DNA, 378 bp, Homo sapiens
  misc_feature (343)..(343): n is a, c, g, or t
  misc_feature (371)..(371): n is a, c, g, or t
gttaaaggaaaaataaggctggaaataataaatgctggcatggatatacagcaactggaactctcattgctgattgaaaagcaaacaaatgctttggaaaacattttgacaatttcatataaagttaaacatacactattaatataactctgaaattcaattcctaggtctttacccaagagataaaaacatagccaggtgtggtggcttacgcctataatcccagcatgcctgggaggctgaggcaggcagatcacttgagctcaggatttcgagaccagcctgcgcaacatggtaaaaccctgtctctaccagaaatacaaaaaatttatttggtatgttngtacatgtctgtagtcccagcttacttngggagac

SEQ ID NO: 619476 - DNA, 408 bp, Homo sapiens
  misc_feature (408)..(408): n is a, c, g, or t
caaggaccgcgcgtgtgtactgtattgtgtgttggtctagtattagctataaaaaaatcatactgtgcctccctggtagagcaactacataagttcacactgcacagatgctaaatgttcttccttttgtcactgttctttcatctcatcctcatgtctatacatcctcgggaatttccatgagctagtatagatctatcttagcaatctgttttcttacagtatctatctgaatttataactgtcacttttctggggcttcgtcttttagtacattttaagttaaacgaaggcagaggtttttgcttttttctgtttaatctgcagagcttagtataatgccttccacggggtaggcaaacaatatatatttgttcagtgtatgaattagtgatttttaaaatatgn

SEQ ID NO: 619477 - DNA, 426 bp, Homo sapiens
  misc_feature (13)..(13): n is a, c, g, or t
  misc_feature (33)..(33): n is a, c, g, or t
  misc_feature (39)..(39): n is a, c, g, or t
  misc_feature (158)..(158): n is a, c, g, or t
ttttaactgtatntccccaccctcccgaacaangataancccagtgataacagtgttaaatatccagccacatttttcattgccaatgggtgccttcctgtggccccaccatgaaggatgagctgccacttttagtttaatgtaacctatttccttantcttttacttcccattgttttttgttccctgatatataaattagtatctttaagtcccaccaacaccactatgcattttgtgcaatttagaaattacttcaggcatgtgactagtaagcatgttagtgctaatactatctatgcagaggagcaagtacagtgtgaaataaaggaatgcgaacatttatgtgaaatgtgtattcatgctaaatctgtctttaggcttaactctattaaaaaggaattgtcaaactgccaaaaaaaaaaa

SEQ ID NO: 619478 - DNA, 475 bp, Homo sapiens
  misc_feature (32)..(32): n is a, c, g, or t
  misc_feature (131)..(132): n is a, c, g, or t
  misc_feature (138)..(138): n is a, c, g, or t
  misc_feature (162)..(162): n is a, c, g, or t
  misc_feature (271)..(272): n is a, c, g, or t
  misc_feature (275)..(275): n is a, c, g, or t
  misc_feature (289)..(289): n is a, c, g, or t
  misc_feature (333)..(333): n is a, c, g, or t
  misc_feature (416)..(416): n is a, c, g, or t
  misc_feature (427)..(431): n is a, c, g, or t
actggcactgacggacaaggcgaaacagcggnccctctcaactgggagggcacccaatggcccctgtagccagaggttgcccggcttttgggccccaggtcctaggcatgactggtggtcaccaatttggnncttgtncccaaccagtgctggggggccatntttaggcagaactcaggaagctggtagagagttcccaacacttatactggggctaaggaggcttgggaataaaagggcaagggagaaactggagtttgaaacctccctnnctncccacctggggtgncataggagagaaaaaataagttgctttttggctccaggcccgtncagacccacagcaaccaataacgtataattattgggattagttatagccactggaggtggaggtttaaaaaaaaaaaaaaganaaaaaggtttnnnnnttttacaagcacagagtttaagtttcaagacgttaaaaaaaatc

SEQ ID NO: 619479 - DNA, 310 bp, Homo sapiens
tctcgcttcctgcacttcaggaggccgaggtgtgtggattgcttgagtccaggagttcgagaccagcctgggcgacacaggagaaccctgtctctacaaaaaatacaaagattagcggggcatggtggggcgtgcttgtcatcccagctattcgggagactgagctcgggaggacggcttgggcccaggaggtggaggttgtagtgagtcctgaccacaccactacattccgtcctggtggtgaaggttgcagtgagctatgattgtgccactgcacttcaccctgggtgacagagtgagaccctgtttc

SEQ ID NO: 619480 - DNA, 1484 bp, Homo sapiens
  misc_feature (253)..(253): n is a, c, g, or t
  misc_feature (396)..(396): n is a, c, g, or t
tggaaacagagtttggctcttgttgcccaggtgggagtgtgagggctcgatctgggtctcaccacaaccttctgtgccttcctggggtttcaagcaatttctcctgtgcctcagccttctttgagttagctgtggttatataggcgcatgtgccaccagtgccgtggcataatttgggtgttttatagtagaagacagggttttcctccatgtgtgtgtggctcgaggcgtggctctctcaaactctcccaanccctcgagggtgatctctgtgccctctccttgtggccttccccgaggagtgtgcgtgggaatttacaggggtgtgtgagccagtgtgtgtgcgcggggccgcgggtccccctctctcttatttatataagaggcgcgtgttanatttatccacagaggttagagaagggaattccactttttttcccctttctcacgtgtgggcgctgtgagagacaattgttctatagaatatcttataagagggttttcttttaacctctctttcttctttctacctcttgtgtgtgtatatctctcgagtgtgtgtgtacaccccgaggacagcgtggcgaggaagaggggaggaacatcgtgggtgggctcacaccgtgggtatgagggatcaccggtggtgggccccgagggaagagggggcgtgggggcgtgacaaagttgtgtcacccattcttttaaacatgtgtgggcgagcgccaaggtgcgggggtgcaacacacattttatatttcccgcgccaatttctgtgttgctccctataaaagggtggggggagctttattaacgcctcttccctctcctttgtgtggtccccccctatgtggtgggaaacctcttccaccttttctccaaaggaggaaactcctatgaggggcctcatccaacttcctgttattcacccaaggggggctcccctattaaaaattttccaaccctccaatctcttgagggggcgccctgtgggggatcttaaaaccttctctcacaccatctgtgggcccccttgtggtggccggcacctaattttttccgccccaaatttttttgtggtgccgcccgggggggggggggggggtatactcccccgtggggggggtttctcctcccgttgttggtgtcccctgtggggggggtactacgggaagagacaggactaagcatgcacggcatagaatagaacatgaatagacctgagatagcaagcgcaatgacatcgacgaccaacgggcagcgtaaggagatacagacagcaggagacacgatgagagtcacaaaacacgaggaggagaggcaccctcgcgggggaggcaccaccacaaccagagggctcttccacataaaaaggagacagcacagagaccaaagagaaaatcttaccacaacaaacaacccacaagggcgaggcaccccacctgtggcgggtgacacaactattccacacccctataaaggat

SEQ ID NO: 619481 - DNA, 337 bp, Homo sapiens
  misc_feature (92)..(92): n is a, c, g, or t
gtatctaagatcttgcgatggtgttcgtagtcagtacatggtgcatgattgatggtaggagggatgttgactgttgtatgtaaggatgcganggatggagggcgataggactagatgatggcgggcaggatagttcagacggtttctatttcctgagcgtctgagatgttagtataagttagttttgttgtgagtgttaaagttgaggcctcccaggataagctttccatcttaacaggatgtggcacgacaagtgctggaaattaaaacgtacacgaatccggacgaacagcgatctcggaggaccacaaaaaacagggactggcgctacctgccg

SEQ ID NO: 619482 - DNA, 315 bp, Homo sapiens
aggggccccttttttaaaaaaacccccccgggggggggggtgggccaagggaattaaatttttgttttgttggggggggtaggtcccaaggtttttaggggggccaaaggttaaaacccggatattattggtttttttaaaaaagccgagggggggttttttaggggtttcccccccaaaaaataaacccttggggggggaaaggggtgtttatttggcccattttgcccctcccccgggggtaccattttttaaacccccttttttacctggtaaaaaaaaaccattttggcccttttaaaaaaaaaatgttta

SEQ ID NO: 619483 - DNA, 297 bp, Homo sapiens
ctttccccttctcaagtttccagggcctttgggtgttctttttatgttgatttaaattcatagggttttccccaaatcccttctttgggtacattgtccccttattcaatggattacccctttgtgggggctgcttattttaaagatgttgggggggaaccaaacccaaatttacgagcagtagttgcacatagttgccagttttccctttttagtcattagatttccaacccatgttgcagttttttggtccagaaaaagtatttctttctaataaagttttaggttgctgctcta

SEQ ID NO: 619484 - DNA, 259 bp, Homo sapiens
  misc_feature (218)..(218): n is a, c, g, or t
gaaaaacatgttctgcgataaagacgatggcaatgtgtgcgctcttttttgtagcggtcagggggcgggggggggttcatgctaaaatgtttgtgtatggtaatttgtgagaggcggtctcaggaccgtgtctttagccaagccgctaagctaagtggaaccactccagaaatgatccatacggatcgtggagcggcatatacgtccaccaattacancgaagctctccgtcagaaagggtaaggcatagcacttccgc

SEQ ID NO: 619485 - DNA, 100 bp, Homo sapiens
tgagctggtacttattaatgttggcaggcccgaggcttcttcaagaagggagatgtggtcattgtgctgaccggatggcgcccaactgccctgtcttaat

SEQ ID NO: 619486 - DNA, 168 bp, Homo sapiens
ttgtagatttcacttgatctggcccgttcatatatgtgagccctagcagcgaggtccagctcctatactgggcgacgaaagggatcgaaacaaccccctaggaatcagctcccagtccgataaaatcaacttccacccttactacacaatcaaagacgccctcggctt

SEQ ID NO: 619487 - DNA, 112 bp, Homo sapiens
gcaacgtgggattcactggtctgatgaagtgggaacaagtctccatgattttccagcgcacaggctcttctcctccagagaaaactgcccctcatagtgctggatagaaggg

SEQ ID NO: 619488 - DNA, 828 bp, Homo sapiens
tggcccgcccttcttggacttgggttgcagggaccccgggcaccctctacggatttgggcctcgatgtagcacgcccagtttgccccatgttttgtgtggtgatgtctcctcgccccttaagaattcccacgggggaggaggggtcctgtacaaggcccaggactggccccacaaaccattttgttgggccacctgggtgtggcttggggcaagcttttttgggggtagatttttacctagcccagatttaaattgggggcttggagttggggaatccaagcagccctgggcaacagggccagactccatctctaccaaaaagattttgaaattaggctggcaacggtggctcacgcccgtgatcccagcaactttgcgggggttcaaaggcaaggtggagtcaccttgaggtcacaggagagtttgagagccagcctggcccaacaatggtggaaaccccgtctctacttaaaataccacaaaattagccacggtgttgtggtgcacaccctggaatccccgctatcttgggagggctgaggcccgagggatcacttggaactcgggagggcggaggttgcacgtgggctgagatcatgccacctgcaactcccacaccctgggggacacatagcgagaaacttcgtctcagaaaaaaaaaaaatttaaaatagactgggtgtggtggcatgcgcctgtagtcccagactacttgggaggctgaggtcagaggatcacttgaagccaggaaggtcaatgctgcagtaagctatgatggcatcagtgcattccagcctgacccatggaacaggacctgccaagaaaga

SEQ ID NO: 619489 - DNA, 181 bp, Homo sapiens
acgcgcaccggtgttcaaaatagacgccactctcctacgtaaaaatggctcgccgcgatcagcggatagctgaacatgcaccccaccaggaaacgcgcgacggttaacagaatcggctcgcggtagattggaaacacatacatcaggaatccggtgctcatggcgagcggcggaatgagga

SEQ ID NO: 619490 - DNA, 370 bp, Homo sapiens
caaatttcttcactggtctttattgggagttctggaggcttcttgtatgttcatggacttctttctttaggttagggaagttttcttctataattttgttgaagatatttactggccctttaagttgggactcttctctctcttctatacatattatccttaagtttggtcttctcattatgtcctgatttcctggatgttttgggttaggagctttttgcattttgcattttctctgactgttgtttcaatgttttctatggtatcttctgccccacaagattctctcttctatctcttgtattctgttggtgatgcttgcatctatgactcctggtctctttcctatgttttctaactccagggttgt

SEQ ID NO: 619491 - DNA, 555 bp, Homo sapiens
tagcaggaccccgagattgaaatgtgtgtgtgcctgtatcatagaagtgtcatgtgtagaagaaatcaaagcagtcttgaataattggaacccaccatgctggatagtctaagtgtcagttagttgtctgggcactgcttcttactgtcttctacctcactgtctaacactggttcagaaacactcatctccatcaagtaggcttcaattgatttcctcaggtgtggtgtctgttcgctcttgagtacctgcaacatccatagtgtagaaactttttgccctctaccgtttttttcctgtatatccagcatctctctgatgattgcctcaactggctatctagatacatctgtgaagtcatgcacaacatgtggacatagcaggaatttatagtatggagcttgatttctttcacagctttgtctgtacttaataatggcatcgtaatactagactttcatgatgttttctctgtcagaattgtcttccacagagataacaatcttatccgtaaattggctgtgtgtaatgagccttaaaggattaatgaccctc

SEQ ID NO: 619492 - DNA, 150 bp, Homo sapiens
tctcacagcaggacggcagcggagtgacacgcagcgcgagtccaaaccatgcacggcaacgagggtgcagtagccgtgcgtaaccaaaacttgcccttgtccatcagtctgacatatcttttttaaatttgccattgccttcccgtcagc

SEQ ID NO: 619493 - DNA, 196 bp, Homo sapiens
ctcagagtgtgcagagccagccagaggaggaggacgaggctgaggaggaggaggcggaggagctggggcacacaggagacctacgccgactacgtgccgtccaagtccaagatcgggaagcagacccagaccggtggtgacgacagcacatgccagcgtccaccccagaatcactacacctggcctgcctcggaca

SEQ ID NO: 619494 - DNA, 263 bp, Homo sapiens
aaaggatttttccctatgggcccagcttggggtcccttcagctaaaatttaaaaaaaaaaaggggcctgaagagtttaaaatccaaggatatggagagatggcttttttttattacatgaccccatccgggttttttttttcccccctttttgaaaggatttataaaactagttgagggcagctgtatttttttgttgaactatttagtaaaattgggcctttttgtttggatgggaataaatgcgggcccttttgcaatcca

SEQ ID NO: 619495 - DNA, 608 bp, Homo sapiens
ctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgacaacaagccgaccaggccctcccaaaacccgacgaaggggtctccaatcccaaatagacttgctctccaattccaaaagacttctttaagcaacagtgacacttcaaaaccatcgaggtttagatctcctcactgtcgataaaggcggcttgtgtatcttattagaagagggatgctgtttctatacttacccgtcatgaactagttcaagatgctgctggacg

SEQ ID NO: 619496 - DNA, 527 bp, Homo sapiens
accccattgacatgaaagcaaagcaggcccagatggaccagcaacttgcagccgagctctcagcagccattccaggctgattcagttccacgctcctcggtttgctgtgctaggactccgggcggggagtcctccctaatgtctaaccccatttcccttgcctcctgcaaggcagtgacaggaaggcctctctgatcaggaacactttcaggtctagaatctaaaggcaaattgtaaggtttgctccagggactgggggaaacaaatttcatgcccacctaactcctgtataacctcaggctcatccctaccagccctcggtttccccatctgtgtgcagggagaggagggtgcctcggggagctactcaccttctgcatgcgaaagatgagattgggatcatacatttagaacaaagatgcattcaatgcattgtagcagtgccccctccctggttcctcacagaacagaggtcatgggtcattctaatccacaaacgatcaatgcacaatgtttggtcaatagag

SEQ ID NO: 619497 - DNA, 175 bp, Homo sapiens
  misc_feature (146)..(146): n is a, c, g, or t
cctattagggtcaaggaagccctctgttgcaacagatatgttttgaacccagttcattcagaaagcatggttggtggtcatcatctacttgtatttgtgaaaaaccatgaaattccataattcatgcttcttcatgttattggtancttttcatatgtggtacctgagctctgaa

SEQ ID NO: 619498 - DNA, 249 bp, Homo sapiens
tacggagatttgctccgtgccgagcttgacggcatgtcgccgccggagttttccaacatggtgcgcagcgaagtcaacaagctgatggccgccgctaagtaaagctggccacaatcgcttcacgcactttgagtaacagcggatccaactgcgcctgggtacgccaacccagctccaccgggtagcgtggcaacgccagtgggcaggtcagtacgcgcaggccggtcatctgcgcaatcgcttcggcag

SEQ ID NO: 619499 - DNA, 599 bp, Homo sapiens
catcatcaatcttgaggttagtgcaaggcctgcatgcagcaagtcaagcacagggtccatggattcagcatgtatatacacacaattatcaatcataacaggaagaactctctcagggccacattcctaagggtgcaccaagggccaatcatggttccttgggagagagcaaggagtaagccaccagaccggctgtgttcactcttacctctcaagtagcctctctcaaagccttcattctcacctaaacaggggcaagcatcaagggtgctttttaccatggggtggtggtgcagcaagtgcagcattcatcgggtcaacagcttcagcatacattttgggttcatcagttatggctcaataactcattcactcatctcaatatcatgcataatcctcctcggtgccataaggcataatagtacctgtttcatgggttaatgccaagcaatcaaacatatcagtacgggtatatagaaagttggatcaaggctcaggcccacaacaaggagctaaaatcccagtaatttgctgcccctataacctattatctagaagaaaaaaggataaatattatgttaatatgctaccatcaagat

SEQ ID NO: 619500 - DNA, 220 bp, Homo sapiens
ttgaggatccccacgcgcaccgcgggttcaaatgcaggcgattcctgtaggaacgccatcccttaggagagtggcgatgaggacgaagacgacccctacaaggggcatctcgatctgctcctcttacaaacgaattgcctgttaggaagagttctccgatatctttaagaggagggagaggggggccgccaagaaactcttccaacttcaaaaaaggccc

SEQ ID NO: 619501 - DNA, 1271 bp, Homo sapiens
gattcgatggtgtgatgtcatcacagaagagttctccggttcccagactgtgggctacccgtcggtattcctgacctacgggaagctgcaacatccaggcatcgctgggaaggtgaagagcttgcctaaggatgacccatcctaagacggtcctagacttcacagccgcttcctgggcgtatacaagggcctgtggcatgacatcacagtcgtgacgagggaacgttcgacacgtgccggagatccgaaggttgccatagcaataatgcgcaccagtggcttgtgaggactgtgaaacaatttagtggagacacacgaagacaagggtgtgctctgtgcgggcaggtgcgtgcgcgcatagccgatggagagacccacgtcgaaggtccatccaggaacttcaatgagatggtcgtgttggcttgagcacgatctcgctgatgaattggccatgaggcagttgcatatcagaagttggcataaatcttcggaccgaagggctgcttgatgcaatggtacttccacataaacatggccatggcagtgacgggagtggacaaatcatagcagacaggcgaaaggggacctatgagagagatagtgagaaaagttacttgtactcagctctaatccggagtgtgaataggagcataatggcaggatgtggcggcaatgtcttgtccgatcatgtctgcccaggaaggaaggaccgcactcttgcatgagcaggatcccagggtgaataactgtgagggcgacttgttgagttccggaagaaacgcttggacttgcgggtccccggcgggagagggcttggagcagcctagtgtaccctgttggaacccaagaggtgtttagggggcagggatgaggatggattcggacggtccaatccgaggggtggaacccacagggggcaacatggagctaacagaaaggggggtccagccaagagcggttggggagacaaccaaaggaaagccgtggccacaggcacaagaaacccactccggaagggccctttgggccaatgtgttgggccatggtaattgggggggcatggggaataccgatgactcagtgctaagactttcttcttgtgggccaaggccgctgggcacgagacaggggtaaccaatacgcggacacggaaaatcaccctagtgaacgaattatgtaaccacatgggcagggtacccttcattaatgggacgggacaagttgactcaggaaaaaatgtgggtcccactggactattacccattttagac

SEQ ID NO: 619502 - DNA, 466 bp, Homo sapiens
gcggtaccataagcacgtaatggtgtggcagacagtaactggagtcccattcctgtatcttctcactaggcaagtcttgcaggcctgggcctctacctaacccccctgccagagctgtcgagccagtagcaactcagccactccctggacagagcctccaggagcaactgaaagcctctctgccactgcttctgcagtggaactgtccttgctaccctcagactgatgaaggagctaacacccttatctacaccttcaacaagctgtaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactagggga

SEQ ID NO: 619503 - DNA, 249 bp, Homo sapiens
  misc_feature (7)..(7): n is a, c, g, or t
  misc_feature (20)..(20): n is a, c, g, or t
  misc_feature (106)..(106): n is a, c, g, or t
  misc_feature (145)..(145): n is a, c, g, or t
  misc_feature (170)..(170): n is a, c, g, or t
  misc_feature (239)..(239): n is a, c, g, or t
gcagggntcggaagccgttngggtgtgaaagttttctcgctctaaggagattcttcaagcaatcactatgtcaacagacacagtgttttcccttccttcatatgangaagatcaaggatcaaaactcattcgaaaagctaaagangcaccattcgtacccgttggaatancgggttttgcagcaatgttgcatatggattatataaactggagcagggtacttgtccattcatctgatncactgcgtgt

SEQ ID NO: 619504 - DNA, 501 bp, Homo sapiens
  misc_feature (106)..(106): n is a, c, g, or t
ccagcctgcctttcccaggaccagccagggctattattagggagacccctgtctcaaaaaataaatccaaaaaataaaaaattaacttaaaaataaatttaaaaancccttgatatgttgctggtatagtctctgaagcttgcctctgaaaacgttgagctttgagaccaggagttcgagactgaacaggctctttctattatatcattagctcatgagatgccttttgaatacaaatatcttacatatcaaaaatggatctcatgttaaatggatttggaagtactataccccttctttctacttctgcacttaaacatagcttaatgtgctctgctttgttctgttatatcttcctgctaaagtaagaattgagcagagctaatgtcatctttaatattaggaaataagtggactaagacattatagaattaaataattttcaaatgttaaataattgtattgactgataaatttatagcctctgaaaaatgggaaaaa

SEQ ID NO: 619505 - DNA, 161 bp, Homo sapiens
  misc_feature (73)..(73): n is a, c, g, or t
  misc_feature (134)..(134): n is a, c, g, or t
cacgcgtccgacaacgttccaatggtcctgtaaagaatccatgcgtgagaaggctgttgagagaaggagtgtncaataaagagcacaacagtaactttaaagctggatacattccgattgtgaaatcgctcacnaacagggtgagaggaagaaagggcaat

SEQ ID NO: 619506 - DNA, 316 bp, Homo sapiens
gtcgaccttattgacatgactaatatgtcttaataaactggactctgcacactgtgaggcattggccttctatattcatgctgacccttccccccgcccccgctccaaacacacagacatatatagcagatgtgcagcttggtcttcatgtgggtcccccaacaactagagcaggggaaaggctgtccctgactctgttgcctgtctgtctgtgggctgccttgtctggcctcagtgggaaaggatatgcctaatcctgtagtgacttgatgggacaggttggggataggatagtggaggggatagatatgggggg

SEQ ID NO: 619507 - DNA, 166 bp, Homo sapiens
ctgtagcattcttgaggtggtgcatgtgctgctggggaagcctgaccagctgcttgcctgttgtccagcacctgaatatggtcgaggcgcagggtgctgacgatgacgatgtcgcgatcatagtcgttgccgctgggggtcgatccttcggtcaggccggtattgg

SEQ ID NO: 619508 - DNA, 163 bp, Homo sapiens
atctcggggagtataaaagaagtctgcttcgagtgtgaactatctcatggaatatagcacatggcctcttcatgaagacactactgtgatagaagtagacgagctgtccaaggccagggaaaggaggttagtacaaagcacaatgaggctgaactaaagttgg

SEQ ID NO: 619509 - DNA, 319 bp, Homo sapiens
taatttatagcaagttaggaataaaaagagtaaatatgttcagctgggtgcgggtggctcatgcctgtattcccagcactttgggaggccaaggtgggaggatcacccgagcccaggagtttgggatgagaccagcctgggcaacatagggagaccctgtctccacaaaataaaaaaattagccaggcatggtggtcccagctacttcgggggttgaactgggaggatcgcccgagtctgggaggttgaggctgtagtgagctatgtattactgcacttcagcccccgcaacagaacaagaccctggaccccgtctcaa

SEQ ID NO: 619510 - DNA, 543 bp, Homo sapiens
cactagtcaggtatgcctgtgtacccaacttcataatacattttcacagcacattcttctgtcctaccaatcatgtgctctgcgccaagtaggaactgactgcgtgtcagtccattgtgtgacaataatgttagataaatgtatgaatgtggctaccacctgcaaagaggagagatccttccagttccttccccagtaagtgtgcgtaggagaagggtattgagtcctcttatttcacgcaaatattaactgagagtccatgacctggttcacaagatccgaaactctggggcatggggctatgaaccaccaatatgacacatgggtcgagaatgtgggtcacaggaaacacacgggtatatacatgatgccactgaagatctctggaaatatccgagacatggaaaggtcgtcgtgggcgacgcctgtttgcagccactcagggggttcccagagagttcacacaggatatcctctctgggggcgatatgggtgaagcatatgcactaagggtttagaccctcttgattcaccattctgaat

SEQ ID NO: 619511 - DNA, 1273 bp, Homo sapiens
ggcccagccccgcgttcaggctgctcatcgaggaggccgtgagacccccggagacgatgcgccccgtgcagacgcactgtcgcctgcgggagccggctgcccttgagatggagttgctcgcctctttgtgctctgcctgggattttcacttcctgacctgtgggctggaggaacagaagcggaacagacacagcaagactcccaaggagtctgccaagttggttgggtgagagccgcatgactgcacgagggcagagacatcggctatacggtgccccatggcagacacatccacgagcaccacaggcgccggattgcgtcgaccacttggaattgacaaaggcacttctcaaggacacctgttggaaatcgacttcccatcacaggactttaccccttctcactgggaagaagccctcagacactgcacgaggtgtggacccaaccattgggaagaccgcaattcaagaccggcaggacagaacatttcgcagggcacgcaaaggattcaacccattgaaggcacgaacttggataccattgaggagggaaacacagattggcctactacaagaagaaacttacagaaagacgacacgggcgagaccagcaccgtcccacggaccaattggacgagaggcccctgccggggaagggcatggacactttggatgcaggtgaaatagtcccccttgaacaggagagagtacaattggacacagggacatccaattacattccagagaaccatactttgcttccgcatgtcgggatcacgatgttccctgtgatggagtggtacacgacgccacttcatgcgggcagtggcaacagaacgttccgttactttcagagaggcacctgctactgcgtagtcccgagtgcagccttgagacttcttgacggaggtgcaaactatacaatcgtttcgaaagaatcgaaggtgcgggaggcctattacgaaacgagacccatgtggacgtggaagcagttgacgaggaacccagatcaaaccacttggtcactataaaaagaagacgtcccaccttgcaaatagagggggaacctatacggggaatcaacagcggaaatcgtcggggttcccctaacacaatcaaggcgacacaaacggtatcgtggaaacgtggaactcctcagcagaacccggggataaaaaggatgaagatcaaagacactggagaagaaagactgacaccaggaaatacacaaaagagatggaatatattaaccggggttgcatacccacaatacg

SEQ ID NO: 619512 - DNA, 141 bp, Homo sapiens
tagaggatccctttggtagtacattggtagcggggtaacatggcttcgtgtaaataaggaaaaacaagtgagcatcgggctctgaaatcagtcggtgtcccattctaaattatagaagtacaagatgggtgagtagcaacc

SEQ ID NO: 619513 - DNA, 515 bp, Homo sapiens
  misc_feature (14)..(14): n is a, c, g, or t
  misc_feature (285)..(285): n is a, c, g, or t
  misc_feature (316)..(316): n is a, c, g, or t
  misc_feature (340)..(340): n is a, c, g, or t
  misc_feature (357)..(357): n is a, c, g, or t
  misc_feature (502)..(502): n is a, c, g, or t
  misc_feature (504)..(504): n is a, c, g, or t
gtgggcccaagcanaatcactggatcaagagagagtaagaagatgcctctttgctggctttgaagatggaggaaggggctatgaagtgaaggagtaagggcagcctgcagaagctaagaaaaggcaaaagcaacgcctttctccccctggagcctcccagagtgaacgcagccctgctaacaccctggatttcaggactcctgacttccagagctgtaagataataaatgtgtgttctgggccaggcgcggtggctcaggcctgtgatcccagcacttcgggagnccaaggcaggcggatcacaggtcaggagttnaagaccagcctggccaacatagtnaaactccctctctactnaaaatacaaaaattagccaggcatggtgcgcacgcctgtaatgccagctactcaggaggctgaagtgggagaatcgcgtgaacctgggaggtggaggttgcagtgaaccgagattgcgccactgcactccagcctggcgacagcncnatactctgtct

SEQ ID NO: 619514 - DNA, 651 bp, Homo sapiens
aggaaatttagaccagctgtttgttaatcttaactttagccaagacaaacaccaattcagttacttacctagggatgggtctcaggctgaggactgctctctaccaacctagaagcaggaaaaagtaaactgatcttccctgttggatgcgcgctcaaattccataaaggaggtatttgtcttacatcgtcatggaggcaggaaaaacttgccttccttgtgttggaagcaagtaaaactccaaaaaaaaaagatcagggactttctggagggcgtgctctcagacctcagcaaattgtcctattggtttgagacataaagttagctcatgctggtaccaggcaccgatcggagatttgtcacaggcaggggcatctctactcagaatccctttggggttaccaaaatgtgaacgctgtttgagacaggtctcagttaatttagaccatttattttgccaaggttaaggatgcatgcctgtgacacagcctcaggaagtcctgacaacatgtccccaaggcgttcagggcacagcttggtttatacattttagggagacatgagacatcaatcaatatatgtaagatggacaatgggttcatccaggccagggacactttcgagcagggagggggtttcggcacggtggtg

SEQ ID NO: 619515 - DNA, 384 bp, Homo sapiens
aatcattggaaggggaaaaggatgtcttaggattattttctttcttgtagtagttgagacagagctcttatttactgtaatgctaaatgaaacagtggcttaaatattttaatgggaaaagagaacacagtgcgttccatattgtgataaggtaacgtgaggtttttttgttttgttttgttttcttttttttttttctgagctagcctttagaacactgttgtggtatgtatgctaccttgattataggaccccctaaatgtgactatagtcatcttaatgggcatcttgtccactgtgcttcttatgtattatgaaagtgataagaagacaaattaagtgggtatattttataaaataaattcatgaagagaaaaaaaaaaa

SEQ ID NO: 619516 - DNA, 375 bp, Homo sapiens
cacgaggccggtgcaaagccccacgttcgcgctcgtcaacgagtacgaaactaccaccggcgacgtggtgtaccattttgatttttaccgaattaagtctgaaatcgaagccctcgatctgggcgtggaagaatacttcgattcggggcatttttgtttcgtggaatggccctcgaaaattccgaacctctggcctgagaagcatttgaaattcactctggcaacccaacccgacggcagccgggtcgtgactgcgggaatcagcggcatttcaattcgtaatggactccgttgaatccgcgcggcgttcgctttgatttcctaattcctaattcctcattgaattgagcacgccccaactccagcaaaccggct

SEQ ID NO: 619517 - DNA, 852 bp, Homo sapiens
agatttttagggctctgtactcctaattaagggacatgtatgtggccttgcctagccctttggtgataagtactgtcctctaggaaatgtacgataggtagaattgtggttccctatggacaagtacataaagggtgatcttgatggaaatctttgagagattctggaatttaactggcctaataagtgtcttctgcctgtagatgtgcagatgagacagagagaatcagtgaaaaattaattctctatgggggagagggctttgaatttgaagcttttatctgttagaataatttgagactcactggttgttgtaaaattgtgttccaatttagtatgataccttgggtgtaaatcatctgatggggaaggggttagaaaaacttctagtggtaaatatcaccgtgaacattttaagacagtcggcattgttcttagacctctgttcatgctgattgttgtagttgttgtctatggaattccgtacacatggttattccccgcctactgtggagataaatctaaatataaagacagctactgtgatgtcactggagaatttgtggtggatgttttatttgaacaccaattgggtcatcttggaagtacacgaaactgaaggagttacctccgaaaaagagaccatttgggtgatcattattttaagcaggaaggttgtgggacttaacatttttctaagcattaaaccggtagttcgcttggacactgacccttggtggacggaatttattgactccccggtgggaactggtatcaaataacgcagggatatttgtggggcacaggggctttgtaaacattgtgccgcggcgaattttgcacagccttatc

SEQ ID NO: 619518 - DNA, 276 bp, Homo sapiens
tatatctcagctagcacgccgcatacgtggagacgtgttagaatccactatgatgagacacatttcatactcatataaataaaaaaacatattttctcttcgtcctgtataatggtgcaatccagacctttaaatatttttctcccatgagattcacaaagttccctaagttttttaattgcaagttagtaaaaatagggagatcaaaaatcagtattggtcattattcctcaatttccatatgctcgttgtgaactttttcactataattgtcgg

SEQ ID NO: 619519 - DNA, 253 bp, Homo sapiens
tgtttgttttaagttgccctggggggtttttgactttgggcccctctttccccccccccccccccttttttgtaattttaagtccccttagctggaatggggaagggggcccagggtccttttgtcgggggggggccgaaatccaatccgccccaggatttagtttgggtttttttcttaataaagaaatccctcctttttccccccaaggggtccccctttaaatgtaataaaatttttgttttgaagttta

SEQ ID NO: 619520 - DNA, 364 bp, Homo sapiens
  misc_feature (364)..(364): n is a, c, g, or t
aggattcggcacgaggggcccttttctatatcctacacttttgtgacagtaagagtttgcccattccacggacaggggacgccctctaaaaatttcaacagcgttattgagatataattgagataatttaaaaaatactgcacatgtgtcatgctggagccctattgagttcaacacggatggcgccttgtgccagaagagacccacagcccgtggatgggacatatgggttatttaagactttacagatgtggtgcacaggcagtgggctggacaagaccgcttctatttgtgaagagagtgtgggttatataacaattctacttatcactctccacttatcaacctccatttaccctgtgtn

SEQ ID NO: 619521 - DNA, 495 bp, Homo sapiens
tctgaaggcagtgacaatggtgaggaagtgactgatttaagaaccatttgagtgaaactggcaggacatgaggggaaaagaggcaagaccacgagtcccctgaccttcatgaagcacctactgtgtgctggccgctctgctgggggtgcacccttgtgtgctggcctctctgctgggggtgaacctactgtgtgctggccgctctgttgggggcacgcccactgtgtgctggccgctctgctgcgggtgcacagggttgagagtcttccaggtcttcatggcagccagctccagcctctggttgcttgttccaagacctgtggctcccttagctgaaaggtgacagaggctggagccatgaaggcttttccagaagcctctggatctacatggcagctaccgtttcctcatcccagtgcccatggtggattttcataactgaccaggcacttcctcccactaagcttcagtgcggtctctgaattcttccctaca

SEQ ID NO: 619522 - DNA, 757 bp, Homo sapiens
ttttgtttttttttacctttgaagcatccagttctagtttaatactgggagttccctggttacctgtccagtcactggacacaaaagtaaatgcacggtccttttaatcaggctcgacggacaaagggggtgatatcttgaggggctacccctccgtgttaagagccggtggttaaaatttattatgccgtttcgtgtcaagtgagctattgaaaagagggacaaaaacctctcctgtgaagagtcagcgagaggcagagtgtggaaggtgccgtggtgcaagacaggacactcattgtgcagctggtggtctatttatcagcaattgagccgtaaactggctggtgcccggcagttggttggtcaaaatgctggcactaacgtttggtggactgggtattggacgatgtcattacctggtggctccatctggaaatgtctggtcattggtttatggcaagaagccctggaataccagaggtttgtgccatccactaagacgctggtggctcagaatggagatcattggcattctacaatattgggggcaacctctttgggaatctttgggacatcagacttatggcggggtcggtgatattagaatcgcgctaggggcgaatcctggtgagcccatcggcctgaggcctgggggacctggcatgagaagccaggggatttgggggcctcatcatacccggtaagcctgacgggatgtgcgaaaagacggtcaatataaggggctatggctgcacgg

SEQ ID NO: 619523 - DNA, 300 bp, Homo sapiens
  misc_feature (8)..(8): n is a, c, g, or t
  misc_feature (43)..(43): n is a, c, g, or t
  misc_feature (70)..(70): n is a, c, g, or t
  misc_feature (106)..(106): n is a, c, g, or t
  misc_feature (146)..(146): n is a, c, g, or t
  misc_feature (157)..(157): n is a, c, g, or t
  misc_feature (173)..(173): n is a, c, g, or t
  misc_feature (194)..(195): n is a, c, g, or t
  misc_feature (223)..(223): n is a, c, g, or t
  misc_feature (247)..(247): n is a, c, g, or t
  misc_feature (254)..(254): n is a, c, g, or t
  misc_feature (257)..(257): n is a, c, g, or t
  misc_feature (263)..(263): n is a, c, g, or t
  misc_feature (267)..(267): n is a, c, g, or t
  misc_feature (295)..(295): n is a, c, g, or t
  misc_feature (297)..(297): n is a, c, g, or t
cggcacgngggggaatgtgggcgcccttttcctggccctctgncccatgtgggtgggggggcctcgtggnccggccgggcgccccgtccccttctgcatgtctgangccaccggcaaccggcgccccactccagatttgcccccgncctgttttganaggcccttatttatancttttatactttgtggagggnngggggggttcctgcctcatcctgggtgnatgggggggggggctgtttttaangggcccnttntactgnatgnatggacttggtcaataaacacaattggntngtt

SEQ ID NO: 619524 - DNA, 343 bp, Homo sapiens
agctcgataatcatgtccaactttagtctcccatatttcagatataatagacttagtagatccttgactgaatttacaaagttacttcttatcgatcgatggcgcatccttccaggtacaacttccttctcacaagctaaggttccttttctgcagctttctcgaattcctgatctctagctgatccagccgcctctggtctcccaaagtgctaggataacaagtatgagctaccacatggcctgaatgcatgaattttgtggtgaactcagatccatagtagggataagtctattacgtcttaagcagacagagttctaatattgggtactacgctttggca

SEQ ID NO: 619525 - DNA, 128 bp, Homo sapiens
ggtgatctgaggatccaggcgttgtagtgatgagcagaaaaagagacagcaaaataaagcaaggtcagaacaaatctgtaaggcagagaccaaaacgatatctgcaaaggagtctgaatttaactgga

SEQ ID NO: 619526 - DNA, 390 bp, Homo sapiens
catcggtagatacgtgaaggcacagatgatcctgttgctcctggatggaacaggtatgtgcaggccagcgattcagccacagaccccttagcgtctgtgtttgggaatgaactcattggaggtggatttgctgacttcaacacattgtcaaaggtcttccttgaatatccttttcgttcagccacatcgagcgtctgtcagcaacgtagtgattacaaaaaatgtatttgaggaaacatcggtcaaaagtgaagatgaatcacacaagcactgccaccaaagatcggaactccaacaagaccctgccctctaccacctgggaaaagatccatcaacatattggattctcctgatccctttaaactgaatgatccatttcagccttaccca

SEQ ID NO: 619527 - DNA, 871 bp, Homo sapiens
gactctagcgtgggcatttgatagagcatgatgtctcacagaaacggtactccgaacccagacgtggctccctcggtttacatgccgtctggaacgcagtcacgtggccaggctatctgtcggtgaaggcgttgcaatgcagctctctccgtaagcgcataagccatgaccaaaccctgatccaagactcaacgattgacttcacgtgcgtcatcacttacggcatcggtatcgacatcaggatcagtgcgggaacgtcggaccgtgaccggtatcccagagtgaacgagaggaagggaagtgcatggtgtggatcgctagtgtacctatacgtcagatgactaccatcactcgatgcgagggcgagtcgaggcgaatttgctcgtggcatagctttgacaatgtcccactttcggatgaaactcctcccggagtcgatatcgaaccgacttggtccttttgccttgaaatctctcgttcaagtagaataaacattcgctgcgaacattgcgagttgaacctaatggaggcacatccaggtgtaatgcgcccttctttagactccatggatagcgcactttaccacccgagagtttaacttgcacacgcaaaaagcgaacctctcggcttcccagagaaaacggggcaagaagagcaggttagtggataaagggactttaccggctcaggatgtgaatcgaagaggtacgtggacggacgttcaagtcccgatgtgccccttgtccgcacatccgcaagatatgttcgctcggttacccagcattgttgcgccaaagatgagggcgccgcactttgactcgtgagatgccagcgcggaatcaaggaggcgctctgtggagccgagagaaag

SEQ ID NO: 619528 - DNA, 513 bp, Homo sapiens
aatgttttcatacagcccttgcagtcccctgacttaatacaacactgaaaaaatgatggtagatattaaacatgcgagatgccccaagaagatcttggaaatagaattcatctgaaatgaaaagtgggcaaaaaatcctacagcaataactgaaagacaaagctcaatacaaaagatatttacaagctgtggcaaatacagtatgtcgcaaggctgcgattttgcatttcattgtgtattagtatttattgcactcataatagtttgtcagcaaaagttgtctacaaagcttaaaaactgcaaatacagtaacctgaaaaatattaacagatttttaaagattgctagcattcactgatcaaaaaagatttgccaacttagagtataataatttgtgcaagcagtgaagcaacaagaggtcagtcattataaagtgttagatattaacatgttgagacaaacctttgcccatttttataatgcaacctttggtcaataaaagcagatttatac

SEQ ID NO: 619529 - DNA, 357 bp, Homo sapiens
  misc_feature (317)..(317): n is a, c, g, or t
tgagatggagtcttgctctgtcacccaggctggagtgcagtggcgtgaactcagctcactgcaacctccacctcccgagttcaagcaattctcctgcctcggcctcccgaatagctaggattacagtcacacaccaccacgccacgctaattttcatgtttttagcagagatggggtttcaccatgttggccagcctggtctcgaactcctgacctcaggtgatccgcctgcctcggcctcccaaagtgctgagattaaaggcgtgacagctggcgtccagccgatagacacgtttaagtcttggactatatttttnacactgggggtcttgtttctggggtgcctagaaaaataaa

SEQ ID NO: 619530 - DNA, 320 bp, Homo sapiens
cttaaggatccccggagcttaccttctaggaggagccttccactgtggctctaggcagggctgaaagcagtacaaagagtcacttcccagcatgcggactgatcaagacaagactttaaaggaggttttcaccaaagaagttcctcccctgtcgcagtctccaagctgatcgcctggctcctgcagttctacggctacctgtcctgtactggaacttgcttgcttacccttccactgttcttagtacctgatctcacagggtcctgttccttcttgcacagaggactaccccagcagccccctctttgactacccggaga

SEQ ID NO: 619531 - DNA, 400 bp, Homo sapiens
gggaagggtcccagaattgtgatgtgacaaggcctccaagcgaggttggacttttaaggggatcggacgacaactagatcctgatgtctgaccatggagatgtgagcctcacgtccaaagaccggatgaggcctctctcccagatgagtagagcggtagacgtgaatgaagacattccaactcgagatactttcgctctggagttgagattatcccaatgggatacatttactctgatgaaggcaacattgaacatgccttcatgctttataacaagtatatgacgctctctattgagaaactaccaaaacatcgagattacaaatctgctggcattcctggaaagacacagtcagagaaattaaaggatattgcattttccaaagcagaagagctggcg

SEQ ID NO: 619532 - DNA, 339 bp, Homo sapiens
gctgatgcgattttgacccaggctgctaatttagcttgggccacatgcggcattcgaactcaccccaatgaatagccctagttttcccaaacacgtcgaaggtctgcttctggccgtagtgagccattcgcctccgggtcaagatcagcccagtgaaagcaacttcaggccatctggacgcaactcgccctttggcgagacgtgccggtacaacgtctgtcgagtgacgccgaattcctcacacagatcgccaaccacgggttccggctgccccatcgccgccatggcaatcgcagtttcgctgcggcatcttgaacggccgcccgccgtttctgccgc

SEQ ID NO: 619533 - DNA, 761 bp, Homo sapiens
  misc_feature (13)..(13): n is a, c, g, or t
  misc_feature (55)..(55): n is a, c, g, or t
  misc_feature (83)..(83): n is a, c, g, or t
attaccggatctnattacgcccaaactctattaagaatgatggaggcactgtgtnctaagggacttcaatgctgcagacattntttggggcccttccccagatctgtgcctcgacacaaccctgtctcggaggtctacggacaattctttcgacctcatggcttggtttttgctctgacatgcactgtcaactgtgggaccttgtatagacaggtgtgtgcctctccaaatcatgtcaaatccattgaatgtacaacaggtggactccaatcaagttgtcaaaacatctcaaggatgatcaatggaaacaggatgcacctgagatcaattttgagtctcatagcaaagggtcagaataattatgtaaagaagtttagttttttttatacatttgtaaaaaaaaataaataaaaaaataaaaacctgtccagctgtgtcaatcaattgtgtgtagattgatgaggaaaaacatgaattgaatccaatttcagaataaggctgtaacgtaacaaaatgtggaaaaagtcatgggtctgaatactttccgaatgctctgtatacccagatgaatcaagactatttaatagttaggaaactttttcaaaatgaaggcctctggctttggctctctgatggttttgtgtcatgtaactaatttgtctatttttgatcaaggggaaggatagccgaccacacagctgctcaccatcattccatctcaagtaccccttttgtggtaaaaatgggagctagcccagtta

SEQ ID NO: 619534 - DNA, 752 bp, Homo sapiens
ggtcggggtttcctgtcttcaacagtgccggtggacggaacccggcgctcgttcccgcaccccgtgacggccgcccatagccagccctccgtcacctcttcaccgaaccctcggactagcccaagtgcccccggcgccgctccaccgccgcgcaagacaccgaccagacgcgaccgacatctccttagtcgccgccatgactgaccgcgtcacaaccatcgcagagatgcgccagaaactaccaccaggaactcagaggccgaccatcaaaccgaacagatcaaccttggaggctctacgcctcctaacagtttaccttgtacaatgtcgttactacgttatggaccgcgatgatgtggcctttgaagacactttgccaaatacctttctatcaacaaatctccatgagagcagagggaaccaatgctgagcaacactgaatgaaggcttgcaaaaccaaacgagggtggacggaatcattcacttacagggatatcaaagaaaagcacagacttgtgatgaatgggagaaggcgaggctgaaatgcaattggagatagtgcattacattatggaaaaacacacatgttgacaaatcacagaccacatacatggagaaactgccaacaaaacgtgggccacatgagcaacacaattgacacccccaaattaggtgctgaaataacaaacgaagaacacatttaacctgaaacttaagacaggcgaaaagccactcaaagcaatagggtgacc

SEQ ID NO: 619535 - DNA, 739 bp, Homo sapiens
aaagcttatgtgctagtacgaggctctgtggtgattacttgcccctcaccgcatattgaactcctggcgtcgtgtccagtgtcacgcctgtccccgtggggagtgctgggcccctccccccagccactcccgagacttgagacctctgcctcagtgacgatgtggtgggaacggggcttgcggctgtttgcctcagcatggagggctggtggcctgctggcagccacccccacagcactgccttactacgtggccttctcccagctgcttggtgcctgaccttgtgtggccatgacctggctgcgtggcatcgtggctgtaccgaggctggcattgcctgggagagctgacctgcagttcaactgctgcaccccctctgcatggtcatagtgcctgatcttcctgcatgtggaaatgccctgctggtttacctgtgtcttcagtgaactgaagctaaaactgcaccaccaatggtcctgcacgggctgcttgcacatctattgcgctcgtcatcgccctggttggcttgtgtggctggtgttctgactaccacatggactgcacgtgctacgctgacctgtacagcctacacagctggtgcgggatccttgtataaagtcctgtacttctgtgcacgtggctggtgggcttcagcattctatcctgtaccccggaggcttcatactaccctgctggaagccgctacctgccacaagcacatcttctttggtgcaaccaa

SEQ ID NO: 619536 - DNA, 103 bp, Homo sapiens
  misc_feature (11)..(11): n is a, c, g, or t
cgtaggccacnagtcaggtcacagaggaaaggccagagaggacaggccggaagggaccccctccagccaggaggagcgactgcagaagacacaaccccgccaa

SEQ ID NO: 619537 - DNA, 355 bp, Homo sapiens
  misc_feature (317)..(317): n is a, c, g, or t
aagcatcgtctcgtacttcaggtcgccgacttccgcggtgttcgacaccagcagcagcgcgatatcgaggcgatcgtcgaccagcatctcctcgatggcttcgcgttcgctttcgacgatgctcacgctcaggttgccgaaccgccgcgaaatggcggacatcagcgacggcatcagatacgccgagatggtttcggtcatcccgatacggacatgccccgagatttgctcggggtcctcctgcgcggctgaaacggtgcgatcgatggacatcgtcgcgtgctgcacatgacgcaggaatcgttcgccggccggtntcagacggacgccttttcggatgacgcagaagcagcgt

SEQ ID NO: 619538 - DNA, 322 bp, Homo sapiens
taggcgcctacaaacattatcagagaggcaaatgaggccgtgctcggtggctcatgcctgtaatcccagcacttatggatgctgaggcaggaggattactcgagcccaggaggctgaggctgcaatgagccatgatcgcaacactgcactccagactgggcgacggttgcaaaactccatctcacaaaacaaagcacccaaaaaagttactagagatacagagggacatattataatgataacaaggtgaatccataagcaagatacagcaattatacacatatatgcatctaataccagagccccaaaatacatgcaacgc

SEQ ID NO: 619539 - DNA, 211 bp, Homo sapiens
ggtcacagctcctgatatcatctaaatgatcagaaggccgtaccaacgggaacgcagctacagaaggctgtagcaagatgccttcttggctattgacgccatattgaccactgaagaagtcattaaagagctgggacagattgcaggccgacccaccgtactgatgaagatgctaaagacaaagtagctagatgaagatgatgtggcacga

SEQ ID NO: 619540 - DNA, 152 bp, Homo sapiens
tgtgggaccatcccagaccgactctgatgttcccccggagactgaagagttgcaccctcatcacggccgatgccaatatcgactctgaagacgagatcggaaaccatccccacagacaaaactgtcacgtacaaacgcatggggcccacatt

SEQ ID NO: 619541 - DNA, 615 bp, Homo sapiens
ggatggcggctctgtcgatctgtcccggctggcgctgattaaccgtctctgcagtcggggcaagctcgctgctctgcatccttgtgcctccgaaactggacgcccaacgtgctccgtgctcgcgctgttggctccttgttgccttgtgctcggcgtccgtgcgaaatgcacaagcagtgcaaagtgcaccatccgtgcaaagcaagagcatgcgtgcgtccgtgcatgcccatggtgggcatgtgccaagatgatgcccagggactgcagtctgcaaagggacgtcagaaaagtgcagcatgctgtgccgtgaggccaggacagctgtgcatctcagaatgtaacatagagcaaccgtatataaaccagggactatgggaagacaatgagagaggggccaaccccgctgagccccggagtggggcgcaacatacccaagggtctcgcacatcaagagaaaacgaagaggagaaaagaggcacaaccaacgcctacaaccaacaacgaacaacacaaacacaccaacaagcacagacaacaaacaccccacagcaagcacacaccaacaacagaccaaacaacaaacaagaacacaagaaaaaacacaccacagcg

SEQ ID NO: 619542 - DNA, 1003 bp, Homo sapiens
gccgcgctctgcttctatacgggctcgcgatgtcgtgaccgactatctatgtcgtaggacgtggcgtatccatccttaaactgagttatccattctatagagtgcgatgatggctgcatctatgagcgcatcataaggtcagcattcctatatatccacgctgtaattaaggaccttacagtgggaactgccgggtgctctgttcttcgcgtgtggaagtgaattctactcgtagattgtctgctacgtgctggttgcagagatggcgctacgcttatgctcctcgttgtcctgttgtggcctgttaccgttatcgcggtgaggtgttgccggatagggtgtgtgctgctgggcttgactgtgcgggactttgggtacattgacgcgtctccctgtgcgtgctaggactgtccgcgcgcagtagtaactcttgtcgcgtgggtgggtaattgaatgacgggtagtgattccaactaacaaagggttgatctcgtctgattccggacatcccatgtggaattctgacaagaatccggagggtcgaagccagggaatggtttgaaatatgggtggtgcgggccggtcatttcagtcctgcccacggtcagtctggatggtccatggaaaggtctacggcgaacgggttcccctgggggagacgaacacgggcggccgggaaacgattacaaggattgtgattcatgtcaaaaaatgccggagaattcccatcgacgggggggggtcaccgagaagagttttgattgaaaagtccctaggaagggcgcaagttgatagcggaatcattggtgggcctccgcagggaatagatcttaggggcgtttggaagaattcctgggggaaggaaaaggctctttcccttgggatccaaagaacagacttgatggatttgggacgggtgcaaacccggagcttgtgggaacacccttggtcatcctgtggacgaaagtcaaaattgcctgggggaagccatgaatccaggaag

SEQ ID NO: 619543 - DNA, 117 bp, Homo sapiens
aaattactgataagaatcactgatcatatcacaaaaaatacaggttaaaataccatttgtgcggctgggtgcagtggctcatgcttgtaatcccagcactttgggaggccaaggtgg

SEQ ID NO: 619544 - DNA, 310 bp, Homo sapiens
atgacaactagggtagtttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 619545 - DNA, 277 bp, Homo sapiens
gtgactctagcaggatcccagactatctggctaacactggtgaaaccccgctttctactataaatacaacaaaaaaaattatcccggcatggttgtcgcattgcctttattcccagctactctggaggctgaggcaggagaatcgcttgattctgggacgcggattttgcattgagccacgatggtgatactgcactccagccttgggcgacatatcgagactctgtctcacaagataaaaaaatgtctaagcaatgaacatttttcaaaatcgtta

SEQ ID NO: 619546 - DNA, 940 bp, Homo sapiens
agaaggcggatgatgggcgtcccttcccccaagttatcaaagtccaatgggcggctgttgtgtggcactcacaggtatgacaacgggctgtgtgtccctcctgagcaggtgacaacatggcgatgactacacacccaagggttggatgtggcttgtctgatgcgcatgtgccctagtacgaagaaggacggcagctgcacttcgcctaatgtggcagttgtagtgcatgcaagacttggtggaacagcacctcccatcatgcccgtcgaccgatcagtggtacaaagtgccaactgctatcatgtgccacgattactgctcagctactcgtgaccatgcagcaactgtgcactcatgtgcaccactacgatgagcagccgtgacgactccgtcgccatgactgcggcgaccactgtactctgcaagctgcatgccacgctactgtgtacctgcagacacggtgcatgagctggatgatcgtacacacggcatcctgcagctggactcatccaccactcgtagcctaggcacacggcacccattgccgtgcaatgtcccgaaccgactgagtacatcccccatggtccactgcatatgaccactacagcaacgtttgacatctactgcagcgcagcatctgcacatgcgctgattctgatcaacaccacgcatgctgcactgctaccatgtgcccacctccgccatgctacacctgcgagcatccaccagtatccatgatactgcgagtgcccagcagctggacggacaggcaccgacgctcccactacaacacttccaaatggccaatgagaccaaaggtggacgaccactggccttgacaggaccatgtggtcaccatggaacacataccatccctaacacggaccgaagggcacggcaacggacctactggccccttgcacggcgcctgggcgccgag

SEQ ID NO: 619547 - DNA, 1690 bp, Homo sapiens
  misc_feature (1313)..(1313): n is a, c, g, or t
taaaaaaagttgtttggtgggactccataagtgaatttcaagcagtgaggatttggtgggtgccgtgaaagtggccgagggcacagggagtgtgagcgtgtagtgtgtgtgtgaggaattgtgggtgagcgaaaataaaagttccagcgggtgttcaacccctataaaacagtggggtgaccgatacatttttaattacattcttccacttctatagcgggcctttttacgagggcttattccgaaatttataacgaggcctttctcacaagtttctcacatttcttccttatagaagagagaagaacccgtggtggctctcacaaacgagaaaatctcgagaggagtgtgaaccacacaaaggcctgtgaaaaacacacctttgtgtgcacacccccacagacacaaagacactgtgggcaacaaattgtggttgtgtgggtctctgtgacatgtgtgccacatatgtgtgtcgccagaggtgttcaaacctgtgcagagtgcacacacctctgtgccctgtgtgagcaaaaaccctactacacgcgtgtgggggcctctctgtgagtatgtctcatagtggtggtgagcgtgtgacatactctcacaacatgtgtgtgtgcccccaggaagagctgtgtgtactcttatctcagagggctgtgggcgactcaccacaggggcattgttggaagaccaacccctccgagatggtgctccatctctatgtggatacaaaagaagatgtgtgcccctccaaggaggtgattaacacgaggaggctcttttataaaaggtgcgcgagaatattaaaatcttctccagataataagagctatagagaaaagacgtgtgctgacaagttgtgttctccacaaggaaaacccccgaggagcccttttttccacgaagagcccccacagaagaggttgtttggtgggggcaccaacaagagggtgtccatccccgaagggggatatacccccgccggggtgaagaaacctcccacacacggcgggcgaacacaaaggggtggtggcgctcggaggaggggacggtcgtgcgggcgccccacaaggaagggagcaacactctggtgggcctcccccacgaagggagagcaaagcaacattctcctcgtgggggggtgcccacaaacgagaagcggcgagggagagagaagcattcccccaaattccgaagcaccccccccgaggtcggcgccacgacaaccaggggggagacgacccaagggggggtcaacctttgtggggggcgcccacagacggctggtgatacaacaacagaccggncccaagagcaaaaaacaacagcacgggcacaagcgcaccaggtcggagcgaagaaagggcccacagaatttgccgcatttccaacgccgttgggggcaaacaattcaactcatccgccaccgtgttgtagcaatagtagtaaacgcccacacacacggtggggcccagaaggagggcccccctattatagaagcaagcaaagggcagagaacgacgcaagcgatgtacacaccaccggcggcggggcgtggtggggtccccaccgcgaaacaacgaccataactactccctcgttggatcgcccaccgtggtgacagctgggtggtacacacgccataagtaggtggtgcctctctgaaccgttcagtagagggcac

SEQ ID NO: 619548 - DNA, 286 bp, Homo sapiens
cttgtgctggattacataagacatgagctccaagttgagctttgacgtaagatgaaccatttcaacatacgtatataggaggtggagacgggaatccccagtacgaagacatagtatgagcagaggccaggacccactgaggaagatgtctggatgaaccatgcgctgatccccacaggaatcaggattcagccacagggagtgtaaccttccggttatgccaccaaaagccagtgactacccatcccaaattaacacccctcttgacccccgcccagcacaagaa

SEQ ID NO: 619549 - DNA, 1259 bp, Homo sapiens
  misc_feature (868)..(868): n is a, c, g, or t
cattccttaagtcctaattgggaaaaaaaaaaaaaaaaaattgaattagttggaaaaacctcggggtgttgtaacccaacttgatttgtaccccttacacactatttcaataacgtagtacaagggagcttcacacagatttccagtctaattctgccctttcttgtggcgccataattataacctataccattgtgtgtactgattaacaaagtctcattttttctttcaagagaagaactacgagcctagccgtgccccattgtggtgttagaagccagcctttgctaaattggggtctagaaccttgtggtgtctgtgcacaccgtgtctaccttacttcccttaatttcatgtggagacacacaggtgtgactttttaacacactctcattcttatattccacaactccactagtagagaactcaaccgagggcctatcgagcgcgagcgtagctacgtcgaagacattatggttccgaccagcactcaatgtagagagtatcgtcgcttccacaacttatatttctcatagagggttggcgccccaaatttattaatttcttcgggcgcacaacatctcacaccacgcagacaacggcgacacctcctacacaagagcattggcggcttctccacccattgtggcggaacacctttctcgacagcggtcctctttttcaccaaggggcggcggcgagcaaccagaatttttcaacactgttggggcgtttctcaaataaacccaccttttttgtcgggcgctttgaaaatttttacagagcgctcatttctcccaagttgtttagggcgaacgagaccttttttatatcctcgcagtactttagagattataagcaccgaggnttcacagtatatatttcttttggaaaaccctccaagatatatttccttacagaaattccttccttgccaaaccgggtgaaattacacccgtgaatttagaccatatacattatccttgttagaccacacacattgggttcgtccgcccaattttccgactctaaggacaatcatttttggtgcgccttactttaacatcctttatatcccgctttttattttcacaaagcccttgttgtcgtctggtagcgcaacgtacaaacggggccacaaactgcggtgtagttctacacaaatgttgcgtcgtgcgaaaactttttcatattttcgcttgtgaaccccccaagttgagtaatacacacccagggtgtgggatacactcaccaaggcg

SEQ ID NO: 619550 - DNA, 1001 bp, Homo sapiens
gccggagcctctgagatgaccaagcaacactctagatgattgaagtggtgcgtcaggggacccgaacaagttgtctatcatttcaggctgttatagaacatgtaatggggtgtctgcctgattatagaatcccagtgtccacacttaggctgggagcaggaccgaacacagtcgggcacggttatagcagaatccgcacagaggaaaatgtctgacttttatgccctgaggctgtctgcaggtcatggaggagtgctattgagtagctgtgatactgtataaatgggtcccaatgaggactcgcatgaggaaatcgtttcgaactccgttaaggtgaatgcccagtgcgaaagacggagatatgagcgagcctttggctcggatcaccactgaccagcactggtgacagactaccagttaaactgacgctcgggaggtaccctcaagaaggtggatggaactgaaatctagtctagtgctggaacctcggaggatgatcctctgtagtgaccggagtctacagatgtcatgatgcctgtgaagaaagtccgcagaaaatctgtatacttatacggaacgatgggtgagaaattggcgggcctagatttggcatgtggttgggcattcccttgagtcataagaaatgggaaacctgatcccatgccgattaagatgcggtgccgtggacaaggaagggcccagtgatgccagctttcctgggacctttgcatcggtgtactgggtgagatgaacagtgccgggacaccgcaagaattgtgcgtataggttgcgaagcaggttccgaatcatggttgaatgaattgaaaccaagatggactgggaggacgcattgccagggatcacccccatggagaaggtctgcccaacatctgtgcacgaggacttaaaatacggtgtgggggtaactccccagttctcaccctttcagtggccaggttgtgcaccacggcacgctccacccagaggctggacccgtaact

SEQ ID NO: 619551 - DNA, 340 bp, Homo sapiens
  misc_feature (141)..(142): n is a, c, g, or t
  misc_feature (160)..(160): n is a, c, g, or t
acgtgaggatatcaggaggtggcattcacccaccaggagctagggaaagggaaccaagctgtctccacacccaggagaggtgtcccctcccagccaaaagacaggcaggacactctagcagctctccctacctgtgcccannggcccttgactacactcntcatcgtgccattcttgaaggcctaaagccaaggggaaaaggggcagttaaaagaaaggcccccaaacgtgaagcagggacaaggagacggacaggggtcagatgacccatgatagggaagagagggtgctgacggtgttcagaatttcaaattttaattaaaatgaaaaaaaatgtcaa

SEQ ID NO: 619552 - DNA, 132 bp, Homo sapiens
gaaggcatataacagttctcgtgtgtgagaaatagacatcgacatagtgagcggccatttgaattaggaggactggctaaggtgctcacttaagctctttgtagttttgttcagtcaattgagtgtttctat

SEQ ID NO: 619553 - DNA, 741 bp, Homo sapiens
gcaactccatcagttgtttgctgactcatgcacacagcagcatctgggcaccccaacatacgcacgcacgcacgcaggcaggcatcatgcacgcatgcaaacaaagaaaaagtaaaagatttcaggcttagcagttagaaaaaccgagacaaaaccctcttcgcaggacagaaagatggcttgtctcaaactgtgtggggtccgtaaatagctgggaaagacccatattttcattctgtcctgttaataatgttattatcttggctctttaacacataatgtttggatgttacttttcccattatgttatgtcatcactgtcaaaacacatagtcatgtttttcttttttttttttaattaggtatttatttcatttacatttccaagtgctatcccaaaagtcccccacacggctcccccaaaccagcaaatcgcacttctgtggcccgtggcgttcccctgtactgaggcatataaaatttgcacgaccaatgggcctctcttgccactgatggccgactaggccatcgttctgatacatatgcagtctagcagacacgagctccggggggagtactggttaagacattattgttgtaccctccctatagggatgcacgaccccttgagcaacttggggtaacttctactagactccctccatggggatagccacacgtggatgggactccgatcacaaattcccggagctcagactgtctgggtttccaagtgctggg

SEQ ID NO: 619554 - DNA, 344 bp, Homo sapiens
taggccccgggccggggctttggggttttaagggcccctgttccctaaggcctttggcccccaaaagggtgggcccccggggccggggatccggctggggcttctccaagggtaagggccccaaaaagggagggggggaatttttgttgggggccccccccccgcccccccggggggggttttcccccccccccgctttgggggggggccggttggggttttttctttttttgggggctttttttaatgccttgggtttgtttaaagtttttttttttttgtttaggggggtttttttgggggaaaaagggtacccccttttaaagggaaaagtttccccccca

SEQ ID NO: 619555 - DNA, 115 bp, Homo sapiens
  misc_feature (3)..(3): n is a, c, g, or t
aanctcataccattgctgacggccacgcttttgcgccacaagatgatcaacgtcgcgcttccatgcgcggagtgctgtcttcatccacccagaatgaattggtgatgccgaaact

SEQ ID NO: 619556 - DNA, 349 bp, Homo sapiens
gcttgatggtcgactctagcacggatcccctacacagtaggctctgccctaccccttgtctcctctgccttgccttctcataacacttttctctcttcaggacacctttgtgcctctgattctggggcttcctgactattgctggcagaatactgtacacctggattgatttgcaggataaattcatttgagtgacgcagcctccgtgtacgatctctgttgtttttccatcctgttctcctagtgaatcctgtcaccttccctactgagccaagcctagcctttttcacttgcttcaaatcccatcccagttctggagctttcacactacgaaacctggagcctcatg

SEQ ID NO: 619557 - DNA, 435 bp, Homo sapiens
tcgaatctgagctctgtacctgaacattcgtgtcctgccccacccaggccgtgggggctcagacgatcatctccagctgccgggcattctcgtatgacctgtttggcctgttcttgccgaaagaatggtggtgtcttccggcttctgctgctggctggcaaaactgtagtagttgttggggcccaggacccaccctcgcttcttggcgtagtctgtcatctttttgggtgtgttgaagaagaggatccgggtggcctcagtgaaaaggattttctcgtaggccttctcgatgcacccagcgatctcatccctgatagtgtcgagcaggatgtcaatgaagaaggtgtagctctcggcggggatgttacccttggccaggaacactttgttgtagctgccctccatcaggtattgctccagggacacgaatgttca

SEQ ID NO: 619558 - DNA, 147 bp, Homo sapiens
tatagccggacctaacgttcgtatttgcttcctctattaagtgtcagctgtggcatgctcagaggtacctgctggataccagctggagcggtgtgatacccttctttttcagctgtactgtgccttcctttctatgtgtccaccagt

SEQ ID NO: 619559 - DNA, 176 bp, Homo sapiens
caggctctctacctgatctcacatccccatttctttttctggtatgggggtagggccaggatgacatcctgggcctactccttatctaaaagagaaggatacacttttaatttctctatcaagttgacggaaaagttaggtttgggtttataactggtatcaagtggaagaggggg

SEQ ID NO: 619560 - DNA, 1033 bp, Homo sapiens
cgctggagcggatgcggcggcgggcgcagctagctgggtcggccgctggagcggaggtgcagctcgtgcttcccccgtgcacccctcctttgggcgcccgaacatcttggtcgacccggatccggaccaattaccgaaaccttacatacatcatgcacaacacgtatcagcggaacaacaaaaagacacaaagcaacagacatagacataacacacataatccaagtgggtttatcacacaaagacatacgtcataacacaagagacacagaccatagaacacagaaaaacaacaaaagacaaaaagcggacgacataacaacaacgcaccaaaggaccacaaacaaagataaacaaacaaagacaacacaagcaagaaagaagaacacaaggaagacaaacacaacacaacaccacaaacacagaaccaagaaaacaacacaacacaagagcgacaacaagacaaccaccaaacaacagacaacaagaaacaaccaacaaaacaacaagaaacaaaaaacaacaacacaaaacacaaaacaacgaaaaaaacacaaaccacacaaagacacaccacagaacaaaacaacaaaaaaaaaaacataccaaacaataacataaaacacaaataaaaaaaacaacaaccacacaacaaaacataaacacacaaacacacacaaaaaaagaaaaaaaacaaacaaaaaaaatatacataaaataaaacaaccctaagacaccgcagaaacaccacaagcgaccgatagccaccaaagacaacaggagagagaccacaacacaaccccgcacgacacacaacaagaaatccaccacacaaccccacaacacacaaaaaccaacaaaaaaagacagaatacaacaaccagaacaagagaaacacaagcaacaacaaaaaaaacagagccacaaagcaacatatcagcagaccaacaagacaagaaccaagacaaaaacagcacacaaaccaaacaaacaacgaaccaaagaaacaaaaaaaagagaaaacagaaaaaca

SEQ ID NO: 619561 - DNA, 308 bp, Homo sapiens
tggagtgatagtgatagatgaatcgtgattgtacgtgtgagtaatgagtttatcgcgaggggtagtgtatagataatggtggtgtataaaatggatggtccttataatagaggagagatctgtcaaggtgtaaggagaaaatggttaggtctacgtgagtgctccaggctgggagtaataccctgctaagggagagtagactgttcaacctgttcctgctccggcctccactatagcagatgcgagtaggagtaggagagatgtggaggtaagagtcagaagcttatgttgtttatgcggggaaacgc

SEQ ID NO: 619562 - DNA, 144 bp, Homo sapiens
acatctaagctgtggtgtgttccccatgtgtgtgtacaacactggtgactcaggtccattttcacctattaccagtgtccctggggactcctcttaatgttccaaatggaaggacagttgatttccaacatgaggtttatatgt

SEQ ID NO: 619563 - DNA, 140 bp, Homo sapiens
actccaccttactaccagccaaccttagctaaaccatttacccaaataaagtataaggccgatagaaatttgaaaccctggccgcaaataaatataggtccccgcaagggaaaaggtggaaaaattataccccaggctaa

SEQ ID NO: 619564 - DNA, 570 bp, Homo sapiens
gttctccgtttgactgcatagctctcgtgcctgagtgtgatcaggcattgagtatggcctgagctccttcagcttggttcaggggcgctgtaagctactcctctttgagcggtcgctcattcctcagcataaattttatgaggtctttacactcttcatacttgtatttcttctgtcggttggccaggaagccggccagttgagttagaaaacttctctctttgaggtttccgaactgctgtttgttctctgccaactgggggcgcaatttctcgttgatttctagaatgttcatctctgccttctcgctggaccaagggccggctgataccaccatgctgacgtttgtggcagaagaggtggggccagggacttactgttgtgacaaatgtgatcactcccacagcactttaggatccttcaccacaaaaacaaggttcgaggtgcctcaactcagagctgaaagcacggtcagtagctcagactctgatacgagtgaggtagattgtggccagcgtgccaggtaaccgtctccaaaatgttcctctggctctgatattctgtgactct

SEQ ID NO: 619565 - DNA, 354 bp, Homo sapiens
acagcgctaagctccactgacttttacctgagtaggctagaaataaacatgctagctttcattcccagttctaaccgcaaaaataaacccttggttccacagaagctggccatcaagtatttccttcacgccagccaccggattcattattcttctaatagctattctcttccaccatattctctccggaccatggaccctaaccaatactacccatccatactcctccttaattctccttatggctatagcaataaaactaagaataggcccctttcacttctgaatccccgaggttacccaagggaaccctctgacctccgggctgcttcttctcacctgacgagtggcccg

SEQ ID NO: 619566 - DNA, 102 bp, Homo sapiens
agcagatgctggcaggagacacgctcactgacaccagagctggcaggactcaaatggggacagagtcccagtgctgcagggatgagtgaggtcaggaccagg

SEQ ID NO: 619567 - DNA, 132 bp, Homo sapiens
tacagcaggaagaactgcatatccgtaggttggagaaatgatgggagcaggtggtgtttctggatcccagtagactggagcaaccttggagggagctaggaccaagatgtgtagtggaagactgtgtctgat

SEQ ID NO: 619568 - DNA, 270 bp, Homo sapiens
ctaatattagtatgtctcggggctagatctcaaaagcccacgtaattgcacgaacgtcatgttttacaacgcctaagtttgagttgtaattattgtctatatcaatttaccgttcaacattgcttcacctatttaattcataaggatctttcatattaaaatttaaccttcaaattcaaccgccatgtgctttaataaaggaaccattttttagagacgtctgagctcacttttacatggtggtgcctactgccgttaatgtccaagata

SEQ ID NO: 619569 - DNA, 164 bp, Homo sapiens
tccttgcctacaccaccacaccagttgaacagtctgtggtgatggtttcattttcgtaggtatgcttgtgtgttggtatgttatgtctaactttcatttgggtccgtgcaaagcattcacttcaggttttcatagaaacatttcccattgttttctcactaata

SEQ ID NO: 619570 - DNA, 539 bp, Homo sapiens
cacgtaacgccttcgggtgccaccgaccagcgtcctggaatctcaggtactggaacgcctgatcgtcgaaaacctgcaactgcagattggcgaacgttccggcatccgtatttcggacgaagaactgaaccaggctgttggcaccattgctcaacgcaacaacatgagcattgatcagttccgcgccgccctggcccacgatggcctgtcctatgaggacgcccgtgaccagatcaagcgcgaaatgatcatcagccgtgtgcgccagcgccgtgtggccgaacgggttcaggtgtccgagcaggaagtgaagaacttcctggcttcggacctgggcaagatgcagctctccgaagagttgcacttggccaatatcctgattccaaccccggacggagccaactcggagcagctcaatgccgctgccgctaaaacccaggcgatctacgagcgcctgaaagcgggtgcagattttgcccaaatggccattgctcagtcctgcagcgataacgccctcgaagcggagatatgtcgaaggc

SEQ ID NO: 619571 - DNA, 295 bp, Homo sapiens
ggtcgacggatgtgtctggagtcttggaagcttgactaccctacgttctcctacaaatggaccttgagagcttgtttggaggttctagcaggggagcgcacgtactcgtatacccttgaccgaagaccggtcctcctctatcggggatggtcgtcctcttcgaccgagcgcgcacgttcgggagggacgcacatggagcggtgagggaggaaggggacacccgcctagccagccagatcagccgaatcaaccctggcgatcaatggggtgacagatgtcgcagccagagtcgacg

SEQ ID NO: 619572 - DNA, 175 bp, Homo sapiens
agctcctgcccctcctaaagctgagccaaagcgaaggctttaaaggccaagagggcagtgttgaaaggtgtccacagccacaaaagagagatccgcacgtcacccacttccgcgccgagacactgcgactccgagacagcccaatatcctcggagagcgtcccaggagaacagtt

SEQ ID NO: 619573 - DNA, 320 bp, Homo sapiens
tctgacggcttagccgcggtgcagactgcggcggcggtggtcttgaggagttctttcttggcgttaaagcggagcggatcccccgacccgaggctacgatgagcacaccgcccgtgccccaggaccacagctgccccgagtcagagggcgcagtgcgcattcaaagagcaaagagacaaaactcaaggacaatttttgagagaaaacgtttttgcatacaagcaggaaatgaggtgttatccagtagagatcagagagtgtgacatctttaggaccaagttcaagaaggggcttaagttcttgaactttaaacaaaaatg

SEQ ID NO: 619574 - DNA, 394 bp, Homo sapiens
ggcaccgattgtatgtatgtagcaatatgtcttcaaagtacattcatggtatatgatgtgtcatgtgtccttcctgtataatattcctattttagtatacaatacattttatttatccattcatcaattgcttccatattttagctattgtgaagttattgctgctgtgaacatggagtgttcacactatctttttcgagaacttgagttcagttatgttggctgtataccaagaagtgtaattgcttaattatatggtatttctactttgtcagtttttgacgaattgccatactgtttctcctgtgtggctgcaccatgtttgcattcctaccgacaatgcacaagggttccaatttctccacatacttgccaacaccttttcttttctttc

SEQ ID NO: 619575 - DNA, 396 bp, Homo sapiens
ttttgaatacccagccatgcgcttgacccatgctgctagtttgaaattctcaaaattgtgggcaggaagttaaaagcatattactctgaaaaaatatatacacatactttttcagagtaatatgctttaaaacatgttacttattgcattacttccaaagtacatggttttgttgtatgtatactataaggagtgactactattatagtgagaacctgcttctacaaaaaatagaaaaaaaaaaattagctgggcgtggtagcatgtgcctgtaggcccaacaacttgggagaccgaggcaggtggatccattgagcctggaaagtcaagggtgcagtgagccatgatcatgccaccacattccagcctgagtgacagagcgagaccttatctaaa

SEQ ID NO: 619576 - DNA, 233 bp, Homo sapiens
ttagagtatcccgacacatgctcaagatgggaagcatctttcctgcacctaaataatcatgcaacctctcagactgacgccatccggtcccaaagccttaagtggagagaagcaaagcacgccacgcctgtcctgtccgtggacctctaccttctggactccctacgggtgcagagcacttgggtttctctactgccatcttgagcctgagtctccatcttgagcctgtgtct

SEQ ID NO: 619577 - DNA, 957 bp, Homo sapiens
  misc_feature (578)..(578): n is a, c, g, or t
  misc_feature (955)..(955): n is a, c, g, or t
taaccccgcgcactcaaccaaccatcatacttattctgacacaatttatgcagcaggtctgagcaactaccggtagggcatgaactcttcagatcatgtcacctattacgaaggagtggaagaggagacatttctgcatgaatcctcatgatctacaaaacaaaatccttgctgccttggactccacagctcgaagacggttcgactacgcgacacatgcccgatctcataagaatccctctcctgaatgactagaaaacccacttaccctaaaggcccttgcgaaaaaaaaaaataatagcgcctcttctggcccccatacggcgcattctcatgcagctcgttagccttaattcgtgggttacataccatgatcctcgactcactaactacaaagacctatgcaactctaggctgcctgcgaccggcctcacacccagctcaaaggcaagcgaaacgaataatacctcccaaaaacacgcgatctaccccacgaaataagcttcgcgaccactatccgccacgtccaacgcccctcaccccgtaactataggatcgtctacgctatacgcacaacncgatcacgctccgcaccctctcgccaaatcatcacaaatacacacatcacccgaacctcccaggatgcgccctatcctgtacagcgactactcactattcaccggcccaattccgcaaaactgctggccacgtagtcgtcgcatattaacatcacccctggcccacacaccatgacaccctcgtctattccacttcccgagtagaagtaagcagaacgcacttagtgaaaaggaccgcaaccgcctgcgcgatatcaaacagtctcgtgttgtcgttattctgtaagacctggacttgtcgcctacgccactccacagtaacagacacgccctgtacgtcgctcgagtcggaacttagaatctgagactctgccgcngg

SEQ ID NO: 619578 - DNA, 147 bp, Homo sapiens
gggtgatcaggtttatatttaaacaaccaaatcctggccaggtgtggtggctcatgcctgtaagcccagctatttaagaggctgaggcgggaagatggcttgaggccaggagttcgagaccagtctgagaaacattgtgagaactca

SEQ ID NO: 619579 - DNA, 447 bp, Homo sapiens
ttgaccagttaattcaataatcgagtataaatagataaacgcttgcaagtcgtaacttgttgagtggatccaactcgtgtaagtactatcgtattctgaccaagccttatcgaagtctgtacgtggcgaaacggtcttccagtcaacaataattttgttattgtagtctacgaagcaaaccgtccattaaatgtatcgttatcaaacggacttcactttctgaacttcacatgtttcaaccaagtgacttgtataaatcatcaagtgcattaacattgtttgcgacacgttataaattgtttcaacgagccttcagtcacgttcaggactaccatacttatagcgatttcatttcttcgtctgacaacgtctcttcaatacagacatacattatgagtaacgaccataacatgctctggttgtcgattgatacgtttctcatctacg

SEQ ID NO: 619580 - DNA, 1058 bp, Homo sapiens
gttgaggccagagcattgcccaccaggtgtttcccaggcacggaccccttgcccagcgtggcattcagagggggcagctccggccgcctgctcaggagtggggtgggatggggagctgcctctggagccttgtgctgaaggagaggaccgttgacggagaaggacatcacccaagtcctggggcctttggggaaagtaggaaacctgcctgtcctacaggagaagagaccacctcaccaactttgaaggatgcaggccttgtttagagcagatctcagaattggtgccctgcgggctccaggccttggccctgctggtggatgaaagtggcacaacctgccctgaggcctgagtgtcacgggaacaacagctagacggctagacactggccccctcaccccacctcccagggtggcacggctgtccagatatggtgctgagggaggtcagtgggatagccccaccatgggctcccccgcagactgcctgcactgaggactgtccccataccccttctgaggagggtcccaaatggtgtcccagagtgcagtcaactccccgttactcccagaagcagggtgctggggcgcaattccccaggcctgggaaacgaggaagggcatgtgcctggcagggccagtctcttggtggggagaagggcctgccgcatcaatcccagcttctctgtttaattcaagatgcactggcttggttgggagggttaatcgcctggtccagggttcagtgggaaccgaagcctggcatgcctggtcctggaccgtcaatgtcctgggactcgtgcctgtatgtcgcttaagggcggaagggtcccagaaggctatctctagtccagacagaaggctttaacagacccatgttgtccggaaacgtaaccttatggagtgtaacgaagaacacccattaattgtaccgtagggagtaacaggagattgggcaagggggggcgagtgaacgccagttagtctaacgcttgggaggcgaagggtagttatcgtgcgggcggagtggaaccgcggcgaaaaaccggttattaagaa

SEQ ID NO: 619581 - DNA, 471 bp, Homo sapiens
  misc_feature (393)..(393): n is a, c, g, or t
ttctagcagtggggaagtgttaactatctttccctaaggaagaagaatgatgttacttcatcacatacacttttacagtttatctggggctttcaagtgtgtttctcaaattcccctcatttaaaaactgatggccgtaaaaatgagaatgtacaaataaaatgttatactttagtatccaatctttaatcctaggactatgcaatagtcttgattttgtgacttgcttttttcacttaaatactgtaccataaacacttatattagggaactcgtacataaaatacaagcttgtgaaacaaccgttgcaattatttcttctagttttaagtattttcgggacagagttcttctttaccctattcaaacacaaccccaaaaggcaggaggcgnggagtaaattgcatctggcagcggcgtgttaaaacatctctgggatttaaccaccacagtaattctcacagtatcctt

SEQ ID NO: 619582 - DNA, 148 bp, Homo sapiens
actacaccaaagatttaccagagagatttggataggaatggggctgatggagcttcatctgtttataaatctccggcgctgcatgataaaacgaagtaagagctttgaaacgcttcagacgcctgctcctggctcatcacataaccag

SEQ ID NO: 619583 - DNA, 781 bp, Homo sapiens
gtcgggcctagatgtctcgctcggtggccttagctgtgctcgcgctactctctctttctggacgcctggcaggctatccagagatactccaaagactatcaggtttactcacgtccatccagacagacgaatgtataagtcgaatttcctgaatgctagtgtgctctagggtattcatccgatccggagcatcgcaagtagacttacgtgaagcactggagagagacatcgcaaaagtggagctattcagtacttgtctttgtcagcaaggactggtctatctatatcttgtactacactgaattcaccccgcactgaactgagatgagtatgcctgccgtgtgaaccatgtgactttgtcacaaggcccagagatagtctaagtcgggatcgagagcatgtagggcagacatcgatggaggttatgaagatgccgcatgtggattggatgaatgtcaacatgccgtggcattgactcctgccaaatggaaagtattcagcataatggctttaatatcgagctgtacgactttgactgccgcacagaagtggtagccagttgagtgaacttcagttcgtctgccagcactgggaccaccggcactctggtaccttgacataaaattgcgtgaggtttcgcagttgccggccattccaaactaatggtggacagcgtgactcctggacggcagggtggcctcaagccgaggcggtcagagcacaggtaggagcctgggtgacgctcacgaaggtctacaggagacagtaaaggaaagcacac

SEQ ID NO: 619584 - DNA, 941 bp, Homo sapiens
  misc_feature (277)..(277): n is a, c, g, or t
  misc_feature (564)..(564): n is a, c, g, or t
  misc_feature (849)..(849): n is a, c, g, or t
  misc_feature (905)..(905): n is a, c, g, or t
  misc_feature (917)..(917): n is a, c, g, or t
  misc_feature (931)..(931): n is a, c, g, or t
gtggtatgaaactcagtgtgcgccgactaactctcccccttttattagagacaaagtctgcgtttcttagagcctgaatacctccctggcagacgcgctgtagcgcaaccgcacgaaaccacacacacagcatcctccccacgttatttatgttatttcttaattaatcttgatttggtagaagacaaatctatcgacgaatacgactactaataggggggaaggcgcgccacggactgccgataccacaatcaactacatacggcattcggtatcncgttcgagttgtgcgtgtctgaagtgtgtttgagtgggtagaatactagattaacgacggatagacacaacttgatgtgagttcttcccatacacaatcgccccacacctccttgtgctttcgactatgttctcgtctcgcgcactgtttatgttgttatacaagttgaggcacatacggcacacacgagcagcaacacacaccagcgccagccagcactacaacaaatatttatccattataacgaaacatatccatatgagcgtacatctaacatcaataagatntcatggaattatggagtctaggatgatagtaagtgagagaccgaaggaagcacgctaataataacgcgtaaacgcacgatgccatgagattgaattaatacacgtaagaaagaactcactagacatgaaggtaatagagatacatcggcccactattatccgggcgtctccctgtacttatgatcgttggactacgtatattatttcgttcgagatgttcgtcgttcgatgttactccatcgtctacgtataccgaccacaccccactcatatctgacatcatcncatccgacatcagccagacacactaccgtaagacgatcacacgcgtgagtcgatgntagtcgccctcncatcctcgtctttnctactgcgta

SEQ ID NO: 619585 - DNA, 319 bp, Homo sapiens
gatggtgctgtaagattcagatgtactggctaaaatttaccattgtggtgatgtaaatggtgtagaaaaccattaattcatccaaaatattaaactatattaataagagaatgtatactttaagaaagcggtccccttatttaaataaaatagtgttggtctggaagtccagtgtgggggcaatctggggggggatcctcctctattcttccagaaccttggtctggcgaacattcttaatgggcccagatcaggattggagcggaagaccgattgtacctttagggcgctgtaggtaaccctacagcgctttccctaa

SEQ ID NO: 619586 - DNA, 363 bp, Homo sapiens
  misc_feature (124)..(124): n is a, c, g, or t
ctgatgcgagtatgcaatgtatagcctgtggtcagatctctgtctactcttctgactatttactgtatcatgtcaaagggatggagggatctaacagaagcctggttaatttaactccatcaangatcatggttacatagataaacttatttaccaaagtaaaaagaactcatggtacttctaatgaaaatggggattattacaagtgtggtttatatgttttctttatgattcctggtcaagaaagatccccaaaactgtatccctaacctttaactcaggattgtacagtatgtttaggtccctcaaaaagtgacctaagctaatgttataaactgctaatgatttatatatcacttagtg

SEQ ID NO: 619587 - DNA, 220 bp, Homo sapiens
tcgggaacgggaacctggacttgctcctcccactcctggacgaaaccccgtctctactaaaaatacaaaaattagctgggcgtgatggcatgtgcctgtaatcccagctactcaggaggctgaggcaggagaatcgcttgaacctgggaggtagaggttgcagtgagccgagatcgagccaatgctctccagccaggcgacagagcaagactctatctca

SEQ ID NO: 619588 - DNA, 209 bp, Homo sapiens
aaagtggctgtgtgcactggccccagcccatattccgccagactagggagggacacacctagggcccatctcagaaatggcacaagactaggttctggcagcttcatttgcgagagtgaaactctcctcgggaaaccaagctcaggccaaatgcgtctttgatcaggaaagcagcgctttccggtttctcccttctccggtggcgtggt

SEQ ID NO: 619589 - DNA, 687 bp, Homo sapiens
  misc_feature (180)..(181): n is a, c, g, or t
  misc_feature (184)..(184): n is a, c, g, or t
  misc_feature (190)..(190): n is a, c, g, or t
  misc_feature (219)..(219): n is a, c, g, or t
  misc_feature (226)..(226): n is a, c, g, or t
  misc_feature (231)..(231): n is a, c, g, or t
  misc_feature (239)..(239): n is a, c, g, or t
  misc_feature (254)..(254): n is a, c, g, or t
  misc_feature (269)..(269): n is a, c, g, or t
  misc_feature (282)..(282): n is a, c, g, or t
  misc_feature (295)..(295): n is a, c, g, or t
  misc_feature (302)..(302): n is a, c, g, or t
  misc_feature (304)..(304): n is a, c, g, or t
  misc_feature (310)..(310): n is a, c, g, or t
  misc_feature (321)..(321): n is a, c, g, or t
  misc_feature (347)..(347): n is a, c, g, or t
  misc_feature (389)..(389): n is a, c, g, or t
  misc_feature (412)..(412): n is a, c, g, or t
  misc_feature (418)..(418): n is a, c, g, or t
  misc_feature (422)..(422): n is a, c, g, or t
  misc_feature (468)..(468): n is a, c, g, or t
  misc_feature (473)..(473): n is a, c, g, or t
  misc_feature (518)..(518): n is a, c, g, or t
  misc_feature (530)..(530): n is a, c, g, or t
  misc_feature (532)..(533): n is a, c, g, or t
  misc_feature (549)..(549): n is a, c, g, or t
  misc_feature (553)..(553): n is a, c, g, or t
  misc_feature (599)..(599): n is a, c, g, or t
  misc_feature (684)..(684): n is a, c, g, or t
taaaccctggtgttctaagcataaaaaaggaaatagaaaataacacagaccactctattttaatatttttaagtagcataaatcataatggtttgtatactacactgtacaaataatatactgttacttttgaaagaaaatgaacttcttatagggttttctgaaatagttactccatanngcnaagatnttgaccctttagccattgcaacagcaganggaatanaagcnttgagganccaagtcttccagtngtgcctgtatctgtngccactgagggangagcctctcaganccctgtngnggcccngtccctctccngcgccaggcccccccggccccgccgngggcgcgtgccgctgggttttgtttttgttttttgttttttncaagcctccttcccctttaaganaacttncgcntcttcatggcttccgccttgaccgccaagctcttggcacagatggncaggnccacaatgagaacgcccaccacaaatgtcaccaggggccagaggnagcaatgcaggngnncaatctcatcatgagngcgntgcagaagcacatcatctggtctttgatgttgattaaaatagcaanttaatggctgggaaccaatctcatctttccagtactgttgccaattcatgacactttccaaattcttctgattttctctcttacnggg

SEQ ID NO: 619590 - DNA, 1432 bp, Homo sapiens
  misc_feature (1)..(1): n is a, c, g, or t
nttcttgatgtgttggtgtgtccccccccctagtaggcagcgttcgtgtgtgtggttgtctcgtttgtgtgggggagatgagtgttgtgattccccggcttggtgtgtgccgcaagagtttgtgtcaccgcccctccgggtggttgacaacaatttgtttgtccgtgggtgccccaaggtttgggtggatgcgccccgtcaagtgtgtgtgtccccaaagcggtccgcaattatgttggtgttcttctctaggtgcctcgacgagtaagacgctttttttttcctctggccgtttctgcttggtctcccccaccacggggtgtgtttatatcctcaggatatccccacacacacatgtcttctttagtcatccctcccgatgagttcttgtcccctacagatgtaaaaaagttgtgatgaatataagaattgttgtggccgacacatcatcatgggaagacacttctaggagacgcctcaacactctttgaagaggggcccacaagagagatgcgcgagacactaccccccggtgtgtcactatctcttttaaataggtttttctctcacaacacacaacactctctcgccacacacttctgagagtggcgccacacacacctgctgggaggagagaccactccttctcacacgaggtggtgtttgttcttctgacgatatagagcaggggccacctactgttgataataggcccacagcggagagtagagacgacaccacacacaccaggtggtccactgttgatcacacagcgtgttagtaatatatactacccacatttttcgtcgagaggcgcataactatgggtgtgtgtgcacccaccgtatgttttctcgggtgtgagaaataaattcttccaacagagatatagccacgcgatataccacagctttgtgggagaaggcgcaaccgcggagagccccacacatgttatatgtggagattatagagacacactctggggcacccacagctggtttctctcttctgtatagagaattgtggagagccacatccacgcggagccttctctttgtgtccctctatagtggttgttctataagagctacatcatgcgccacatatatataataatatgaaatggagatataggcgctcgagagcccacccacagagaaaatatttggtgggagaatacccacgtgtctcgagtaataatacgctcgagagcactatatatgtggagaatacacctgtttctttaatatctcgaggtggttaagtgcacctcgtgttgagatagtgttgataaaagttctcggagatagaggttctctttggtgtttataattgacttgaggttttgtctttaaaaggattatttcatcccttgttagttgttttgccgttttttaccttccataagtattagaagttataagcccctccc

SEQ ID NO: 619591 - DNA, 1906 bp, Homo sapiens
  misc_feature (66)..(66): n is a, c, g, or t
  misc_feature (161)..(161): n is a, c, g, or t
  misc_feature (163)..(163): n is a, c, g, or t
gacgggtagcaggggtcagcactggccccctcccagcttggcagtggcatgaagatgggagtgggngtgtatagtggaggaagcacctgccgggacccccacctgccagctagttggacaccccaaggctgtgtgctgcccacctggtgttccccaacacncncagccctacccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccctgcacaaggctccttactacttcctgctggacctgtgcctggccgatggcatacgctctgccgtctgcttcccctttgtgctggcttctgtgcgccacggctcttcatggaccttcagtgcactcagctgcaagattgtggcctttatggccgtgctcttttgcttccatgcggccttcatgctgttctgcatcagcgtcacccgctacatggccatcgcccaccaccgcttctacgccaagcgcatgacactctggacatgcgcggctgtcatctgcatggcctggaccctgtctgtggccatggccttcccacctgtctttgacgtgggcacctacaagtttattcgggaggaggaccagtgcatctttgagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctcagaagtgacaattc

SEQ ID NO: 619592 - DNA, 209 bp, Homo sapiens
cacttgtgtggattttgtcactgtgcatgtatgtatgggtttttggggcattggtcctggtgctctctcctcatcctgcatcccgtaccctctgtttcatggcccaggcagtgtgaaggcggagatgctgcacatgtacaacctaagaagaccctctctttaaaaaagaattaaatataaataaataaataataaaaatataatgttta

SEQ ID NO: 619593 - DNA, 2029 bp, Homo sapiens
  misc_feature (66)..(66): n is a, c, g, or t
  misc_feature (161)..(161): n is a, c, g, or t
  misc_feature (163)..(163): n is a, c, g, or t
gacgggtagcaggggtcagcactggccccctcccagcttggcagtggcatgaagatgggagtgggngtgtatagtggaggaagcacctgccgggacccccacctgccagctagttggacaccccaaggctgtgtgctgcccacctggtgttccccaacacncncagccctacccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaagatggagtttcgctcttgttgtccaggatggagtgcaatggcgcaatctcagctcaccacaacctccacctcccgggttcaagtgattctcctgcctcagcctccccagtagctgggattacaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccctgcacaaggctccttactacttcctgctggacctgtgcctggccgatggcatacgctctgccgtctgcttcccctttgtgctggcttctgtgcgccacggctcttcatggaccttcagtgcactcagctgcaagattgtggcctttatggccgtgctcttttgcttccatgcggccttcatgctgttctgcatcagcgtcacccgctacatggccatcgcccaccaccgcttctacgccaagcgcatgacactctggacatgcgcggctgtcatctgcatggcctggaccctgtctgtggccatggccttcccacctgtctttgacgtgggcacctacaagtttattcgggaggaggaccagtgcatctttgagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctcagaagtgacaattc

SEQ ID NO: 619594 - DNA, 134 bp, Homo sapiens
gaggatcccgtgatgttatcccaacacctgaaaacaggatgaaagccctgtttactgcaattccttttacccagtgtatcatgtctacctatcaacagaaaattacaaagcatacttaaaaggcagaaaatgca

SEQ ID NO: 619595 - DNA, 489 bp, Homo sapiens
  misc_feature (42)..(42): n is a, c, g, or t
  misc_feature (61)..(61): n is a, c, g, or t
  misc_feature (124)..(124): n is a, c, g, or t
  misc_feature (282)..(282): n is a, c, g, or t
aaaaacacaatccactgaaaaaaaaacggatcggattaaacnttaccccacttttattganttcccctgcactatgccactctgtttttcaaacactatcctcaaggaaatccctcaacaacanccccttcctttaagaggtaagcacctaaggcccctaaacatgatggttagagacactattaaaaagcatgttcctaggcagggtgcggtggctcaggcccagcaatccccagcactttgggagacctaggtgggcagatcacttgagatcaggagttncaagaccagccctggcccaatatgtcgaaaccctgtctctactaaaaatacaaaaaaattagctgggtgtggcagcatgcacctatagtcccagctactagggaggctgaggcaggagaatcacttgaacccgggaggcagaggttacagtgagccaagatcgccactgcattctagcctgggcaacaagagtgaaactccatctca

SEQ ID NO: 619596 - DNA, 252 bp, Homo sapiens
ctgcacgaagtgtactaacttggaggatggttttgggccaagccaggaaacggacaggaacgtctgtggttaacatctgaggacacaatgggagaggacctagcgttctaaatgaattgtcttaagatgcttcataagattgcaacctggtgagaaccatggaaaggggactgagtttctctgcaggacaaggcaccttgctactaacttctatctcccacttcggtgggcacgcggtgtaccgtagctcga

SEQ ID NO: 619597 - DNA, 291 bp, Homo sapiens
atcgagctcggtaccgacagcatcccgtaaccagtgcaatagataccatatactttaggaatcaaggcacttccaaatgagcatgaaaactgctgcttgttatacgaaaacaagcccttaggcatgcgttactcttttttttttttttggaaacaaggtctcattcggtggcccgggtgggggtgcgggggttcaatctgcggtcagggcaacctcggcctccggggtccacacaggttctcgggcctcagcctctggagtagctgggataacaggggagatcctcaaaag

SEQ ID NO: 619598 - DNA, 140 bp, Homo sapiens
gcgactctagacgatctttcccgactagcccgacagcaggcacgtggtagcagcagtgctacgggtggtctgcgcagtttgtaacaggtgcctgggccaatagctgggggttcagtgacacatgttcatgaattagccag

SEQ ID NO: 619599 - DNA, 739 bp, Homo sapiens
  misc_feature (26)..(26): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (111)..(111): n is a, c, g, or t
  misc_feature (120)..(121): n is a, c, g, or t
  misc_feature (129)..(129): n is a, c, g, or t
  misc_feature (142)..(142): n is a, c, g, or t
  misc_feature (152)..(152): n is a, c, g, or t
  misc_feature (173)..(173): n is a, c, g, or t
  misc_feature (176)..(176): n is a, c, g, or t
  misc_feature (180)..(180): n is a, c, g, or t
  misc_feature (182)..(182): n is a, c, g, or t
  misc_feature (199)..(199): n is a, c, g, or t
  misc_feature (207)..(207): n is a, c, g, or t
  misc_feature (214)..(214): n is a, c, g, or t
  misc_feature (216)..(216): n is a, c, g, or t
  misc_feature (218)..(220): n is a, c, g, or t
  misc_feature (237)..(237): n is a, c, g, or t
  misc_feature (243)..(243): n is a, c, g, or t
  misc_feature (247)..(247): n is a, c, g, or t
  misc_feature (252)..(252): n is a, c, g, or t
  misc_feature (276)..(276): n is a, c, g, or t
  misc_feature (281)..(281): n is a, c, g, or t
  misc_feature (313)..(313): n is a, c, g, or t
  misc_feature (323)..(323): n is a, c, g, or t
  misc_feature (343)..(343): n is a, c, g, or t
  misc_feature (349)..(349): n is a, c, g, or t
  misc_feature (365)..(365): n is a, c, g, or t
  misc_feature (367)..(367): n is a, c, g, or t
  misc_feature (378)..(378): n is a, c, g, or t
  misc_feature (385)..(385): n is a, c, g, or t
  misc_feature (392)..(392): n is a, c, g, or t
  misc_feature (401)..(401): n is a, c, g, or t
  misc_feature (408)..(408): n is a, c, g, or t
  misc_feature (411)..(411): n is a, c, g, or t
  misc_feature (420)..(421): n is a, c, g, or t
  misc_feature (425)..(426): n is a, c, g, or t
  misc_feature (434)..(434): n is a, c, g, or t
  misc_feature (436)..(438): n is a, c, g, or t
  misc_feature (443)..(443): n is a, c, g, or t
  misc_feature (446)..(446): n is a, c, g, or t
  misc_feature (452)..(452): n is a, c, g, or t
  misc_feature (459)..(459): n is a, c, g, or t
  misc_feature (469)..(469): n is a, c, g, or t
  misc_feature (474)..(474): n is a, c, g, or t
  misc_feature (649)..(649): n is a, c, g, or t
  misc_feature (656)..(656): n is a, c, g, or t
  misc_feature (666)..(666): n is a, c, g, or t
  misc_feature (733)..(733): n is a, c, g, or t
tctcttctgtttgcaaaatatgtttnaaagcattggtagtgctttccttatcagtaactggagttctcctgcttgcacnananaaggtaaanananaatcagtattcttanatggcaatnnggggaagnagcaatataccantgtacaaaantgaagaaaagttcctaatttntantttntnaagggagatgaaaggangtttaaantatatananannntcaaaaggaaaaaaaanaaaacnatancagtnttatatcaataacttgtaaaaacncaacncttcttggtcttggctaaactacctaaattcncacaacaaanaaggttaaaaatccattacnggaatnttggtattaataaatnanaataatggaanatatacntagccanaagcaggtncaatcantgnaaaaataannaaannaacaagtnannnttaanttnaaaaanaattatnggtggtgaantgtanttaaattgaagagaaaaatgtaagtaatggaaggtaaagaaaaattaaagaatggaaaataatattttgggaaagaaaaaaaattaaatgagaattaaaaaagtatattaaaaaagaagatagatatgagttaagatatatattattggtatttaatattaaaaaaaataattanatttaanatataaaggnggggtttataggttggtttatttatgggtgggtagtatggtaataaatggtgggtaaataaaaaatnaatttt

SEQ ID NO: 619600 - DNA, 227 bp, Homo sapiens
caagtttctgagaatgcttctgtctagtttttatgggaagatatttcctttttcacgttaggcctgaaagcacgccaaatgttcacttatagacactacaaaaagagtgtttcaaacctgctctgtgaaagggaatgttcaacactgtgacttcaattgaaatatcccaaaaaagtttctgagaatgcttctgtctagagtttatctgaagacatacccgtttccaa

SEQ ID NO: 619601 - DNA, 291 bp, Homo sapiens
ccatcatcctaggccctgagcatccaggcccctgcttttagggagctcacatgctgtgtgctgacctgagttcttctgcctgcactttcttttaaacactccttctccgtaacagcctgtgacttgaggggttaacttccagccaactgaactatttcactcagcacccctcccatgtcaacagcatggcaggaacagtgattacagagcaaagaaaatgttgtgttatagacaggattcttcgctaaaaggctctctgtcaactaacaaaaagactctgtgaaaagcacc

SEQ ID NO: 619602 - DNA, 144 bp, Homo sapiens
gagcggggaccaggaaccagcccggtggcgtcagacttgactgggaatgtaggggctgtccttaaggccttgtgtttaataaccattgagtcacaaaagcagctgctgggcagtgtgaaaaacagcacggagacaagcaaagat

SEQ ID NO: 619603 - DNA, 343 bp, Homo sapiens
tccaaacagccagtagggtgtgccattctcctctcccaagcccagtatgcgaatggcatggccacccatcatctctccggtaacgtgttggtactctcctgacttgtagatctcggccatgatgtccttctcgctattggacacgctgtaggaattgttccgtagtgcttgtcctgtttgtagctcggcctgtagccaggtctcacagatcttgctacacgtggggttctccctccccggcatgggccgggagccgttgacgtggtgctcacagggaggtatggagtacggtctgcaccctacatgggattcatagaggcccccagaacccaggccttctcct

SEQ ID NO: 619604 - DNA, 688 bp, Homo sapiens
tggagcccgagatgaagcctttgcactccagttgtgggcaacacagcaagattctgatctcaaaacaaacaaacaaacaaacaaaaaaaccactcaaaccgaaagaaagaaagagagaggaagacgggaaagaacagacgcgaggagcaacgggaggggacgaaagagtcgagtctcccagaaatatcccatctgtttctctagcggcttctctaagcagggttcttagtctcagcacaattttcctcttcaagcccccgctctcccattgtggccttgggcaggggctgtggggtatccccacgagaagggcccttggggaccggtggtgccatgtgctggccttctgtgtttctccatagacttctgcgcataagcgcctgtgttgggggaataccccgtgttttgtttgccaagcctaagctatttcccataggctgagtcccttagacggacgttacttgtgtgatttcccaaccgcgcggacttacgcggcccaaaacgccacttccttgagagggccatggcccttttgatccttgggctaaggtggcccctgtggattggaactcccgggaatacttcccaatcttccacttctttcgctgggggttcctgttgcgcatcttgtgttcatggggcacccccaatacaggaggtgggggaacatatttattcccttctctgc

SEQ ID NO: 619605 - DNA, 514 bp, Homo sapiens
aatctatatagtaagacgtggtgttgatatgggatgaaaaagaccacttaaaggaggcatttgcttatcatgcgacaattagcaaaagcttgaagggtatgttattctctcaatactacttgctccacttcgcaggcatatctattcaggagggcatcttgacaagaggagcagggtcacccacgacttcttatatctcctgcagtgcactggccaagtgtgtgtgtattgatatgcttgaagcccctagggttctcaacatgccaaatcacaaaggggttcaatttgtggcctgcaacattgcccccaagcaagactgtcatccagtccctaaaagacttgaagcctggcattgctttggtctacctcatggatcaaagtcctttcaggcatctgtttccagaatagaaaggttccatccatattgaaaatttgttctggcaagtgattttcctccagactcagcttatctagagtttcccaaaattcttccgctgcctttacatcagcactc

SEQ ID NO: 619606 - DNA, 1473 bp, Homo sapiens
tgatttctaagttagttggtggcattcaaatgccttttaagatcttggtaacattcccaaagcagaaaactgcctgacccacgagtggggattccctggagaataggggtcccaagaaggaatgcatgcccttctcgaacccagtactcccccattccgtcactgcctctctgacttttactgcatattcccgttcattctccgtcctttatcacttctttctagagtatccccatctccaactcatctctatcaaaccaagagatcaccaaaggaagcccatcgaggagcatcaattccccccaatagacccacctatgagcgtatgcgagatccaatgagaggatatgagcagtcacgcattggattaggcagagaacatggaggtgaccacgttgggcatgactggacccgtaaatctgggtaaatcctccatgttctctctatgctcatcaacactcattattccagaaggaccaatactcagaccacactatatagggcaactgactggaccttacactgtgacatggcaaaatacaaagaacatacaaggcgtgcactccagagagcatcgtttagagccctgccacaacagcgcgaacaatcaaaaaatacccacatccctcttgagaccatgaggcacagcacacataataaccaccaagcagacactaacccaacccaaatagagaatgaacacatactaccgacagaggtcatacggccatgcccaaatgacaacctcgaagaactaggagttcccgaacatatcgtaagggaatgatcacccatagagatgcacactcataccataacacgagaagggacaatccccgcacggatggaccacaatgggcccaaacggggcgcacaacagaacaactagaacaccatactaaaaaccacaccgtatgacatagcaccacatggcgatacccaatcaattggttccaaacaccacgcaaaacgcacaccatcagcacaagcgcgaaaaccaacacacacacagccctcataccatacacacaagggagcccaaaccaaacgaagcacacgagctcagaccaacaccagagaaacccaaccaacacacagcacaagtcgccgaagacacaacaaaacccaccacccgacaacccacacatcaggcaacacaccaaccagaatcaacaccagacacagcgcgccataccccgacagcgacagcataccaaaaacacccacagcaacacaagccacgcacacgactatcgacagcaacaacaaccagcagcgcggacgcgagaagacgaaacaacacaaccggacactcaagaccacccacgatgaagaacacggccagcaggcagaagagcaggggcaacaggagcaagcacacacaccgtgagcgagcggacggcttagcaaccgaggcagacaagcccgagcgagaccacggaaccacagaacacaggcagaacacaacacaca

SEQ ID NO: 619607 - DNA, 835 bp, Homo sapiens
  misc_feature (158)..(158): n is a, c, g, or t
gctcagcactactcgcgctgacgctgccgggccgaccggggacacgtcgcagatcatgggtctactacgtgtagtcctacaggactaggttctgccagatgaactccagcgttcgtgcatccgcaatcaggaatacagacggaccggggtccaccggnggtaatggaaggctggtactacgaagtagtgtaccgttcgtcgcatggatgccatatagcgtcgtgactccatactcgggacaggagaagctcgcgatgactgaagcgtctgcgatagtaattgcgagactctaggtgcgcacacgagacatgggctttgtctcatagtcttcagccaaggaccagtttcccagaggtgtatgtagaccacagtggttaggagaactatgtggcagatatcgaggtggatggaaagcaggtagagttggctatgagggacacagctgggcaggaagattatgatcgactgaggaccctctcctacccagataccgatgttatactgctgtgtattccatcgacagacctgatagtttcagaaaacatcccagaaaagtggacccagaagtccagcatttctgtcccaacgtgccatcatcctggtagggaataagaaggatcttcggaactgacgagcacacaaggcgggagcatagccaagacgaagcacgagccggtgacacctgaaagaaggcagagcatcatggcaacacagggaatgggcgcatcaggggtaccatggaccgaggaccaccaacacaccaaagatggcgtgaagagagcgcacgacaacggcacacagacgccgccccgcccgccaaaccatggaagacaaa

SEQ ID NO: 619608 - DNA, 296 bp, Homo sapiens
  misc_feature (55)..(55): n is a, c, g, or t
ctatggacggactatggactatctcattatgctcaaagccttgtcccaggggganagcattgaggtcccattcaatcccctggaagaaaaagagaaaaggcattttaacctatggccctctaggaaaagaaactgtgtctggttcaccttctagccaccagggcactgagtaggctttcatgaatgatactagtggataggctcatggatcaatggacggatggcaccatggatggctggatggatggatggacggttggatagatgaaaaccacaaatccataaattaaaatgtg

SEQ ID NO: 619609 - DNA, 547 bp, Homo sapiens
aggctcgagctcggggctgggggctgcagggctgggtcaggggtacacagagctaaggccaatgggctagagggtgccggaaagagagctggagtctgggctcctcttgggaatcagagtatatttaagaagccaagggggacctcgggctgttctggtggccccttctatgcccagctgtgctgggaggtcccagggccctagaagatcacagcagggccttctgcctgctgaccataacagtgccagcttctttgcagcttcctcttctaccatttcccactacgggcacctaaaagaagcatctctgaccagaagacaaaggcccaaatagcacctgggggagggaagatgcacagaggcacttccagatggcatcgaacagactaaggctctgaaacctaggcctgaacactaaggtctcgagacaccagaggtttctgagccaggagagcctgctggaaaagcagcctgcagagatttgtgaataaagctgattgccttctcagagccaggcctagaaaatggcctcctgagatgacccctc

SEQ ID NO: 619610 - DNA, 207 bp, Homo sapiens
  misc_feature (5)..(5): n is a, c, g, or t
  misc_feature (23)..(24): n is a, c, g, or t
tacanaacatttcatccaacaannagaatcacatcgttaacagcacatggaactttttccaagatagaccatatataagccataaaacagcctcaatatatttaagaaaatcgaaatgatattaagcactctctcagaccacaattgaacaaaactggaaatcaactcaaaaggaaccttcacaaccagcaaatacataaattaaat

SEQ ID NO: 619611 - DNA, 229 bp, Homo sapiens
  misc_feature (162)..(162): n is a, c, g, or t
tcatgatacatcagctcggtaccagcgacagcacttgcagataggagcgggtgggagctgcctggagaaaccacctctggaggttgtgaatcagtgctgtcagccgtcctgagctggctttgaccctcagactgatactggtatcctggtcccagctcctgncagggctgttaccgttgttttcttgaatcactcacaatgagaaactaacattttgcttgttccgctg

SEQ ID NO: 619612 - DNA, 1372 bp, Homo sapiens
acagaggatcatagtctacttgacttcaaacagatgtattggacgagaacagataccggaggtactactactatccagacctaccgcaccgcacctaccagatttcactactaccgacattgacataaactacacagggcacacatacttactacggaccatactacctgacattactagagagaaccatgacacagacaccagctaatactagtaggattacagctaccatatactatgccccaaaaccaaaaccgataggacgcatacaccgagacataacagatacgagcagatatcactttccccactcccgaaccgttgcgcaatgcgccacagacccagcacaacagccaatgcccctagagactccaaactaaatgcgttacacgctttgccatgaggacccctacgcataaacaaccacatgacccacttacctagctacctaagaagcgacatatatgcgatatcaatcagataacagggaacccacagaacgacaacatggaaccttcgagtggcgcacaagtccactggcgcaaaacgcaggcccgccttggcaacgcaccacaaacacacgatcgattgtccccaggccgacgaacaacatagaggagacacccaggaaacgcgcaccgcaacaacgacccggaccagacacggaagcccctatacacgacaacgagccggctgccagacgacgagaggccccaacgacagataccccacaacacacccccaacagcagaatagagcagccggagcacgcgcacggagcaaccacgagcaggcccccaggagcgcaacacgatcccagccgccaaccgcgccacacggcaaagcacaaagaaagagaacaacaaggagagacggcacacacaaagcgacacacagaaaacgcgcaacgacatgaacacacagacattagcacacaaaagaccacccaccagtggcggcacgacaccagcaaccggccagagcagaacacaaaagcagcaccccccagcaacaaagggagacatacatcactccaaacagcaccaacaatagaacggagaacaaaaggagacacggaaccaaggggaaacacccacgcgaaaaatacaacgtgagagagaagcacatcgctctcggcaacggagcaaccgaagcactaccagaaaggacatgagaagggaggaaggcaaggacgaaacgcataaccacaacagcaagcgacaatgagaagacgaaccgaaccacataggacaccaacaaacagtacaaacgcaagggaccataggagcgagagaacgcagacacagacgctagaggcaaacaggacgcgacgaaaggacacccaacacacgagcacaaagggggcaccgca

SEQ ID NO: 619613 - DNA, 210 bp, Homo sapiens
  misc_feature (94)..(94): n is a, c, g, or t
  misc_feature (100)..(100): n is a, c, g, or t
  misc_feature (107)..(107): n is a, c, g, or t
  misc_feature (144)..(144): n is a, c, g, or t
  misc_feature (170)..(170): n is a, c, g, or t
  misc_feature (172)..(172): n is a, c, g, or t
  misc_feature (208)..(210): n is a, c, g, or t
tgaggattccggaatatttgatatttcgcgtgacccattgactgcaatagcaactaataactaactgctctcgtttaggctgctaacaattacnggggtnccattanataattcgacgctaactaatatactactacatgccanatcgatgtatgatattggatgtgtananactagacgacttgatgctacttgctgagacttactnnn

SEQ ID NO: 619614 - DNA, 1523 bp, Homo sapiens
agctcaggctttgacaatgctgtggagtcaaactactgtgggaaaagcagaaatagagctctgcagttccactcctgtctcccttcctccactctgcatgcatggccaggctgaccacacttgtataaacaaactcttcaacactcgacaaagtaaaaatattattctctcacttaaaacacaaaccacttctacgaagcataatgtcaatcttcactgcaccactacaaccctcgtagcaaaacttctactcggcactactgtctaccacattcatctacgcctccatctcgcgctacttcaactatctccacacactctgtctacgcgcgagtgctcgtacgtctcataacaatgcttcgcaactcctcggctcctctacatctccgcggctctctctaaccactaagtgctctcccagataaacgatacgtgaccaccgccacgcaagaagggctctcccattggatccaactgatagacgcagcccccaccgtggcagctagacggccaaaccatacacgttggcgacacccctcacacctcagactcgccgctacattaagttggcgcaaggcatacgttggacaacccaatggcggcacagcaccttctccggcacggcacaccttaaggacttccccctctggatacaccaactgcaccgcccttccgcttgcaaacatcgggttggcagcgcaaaacaagaccgccccaagcacacccacgcttacacgcacacaggcctccactaatccaaagtcgttagcaacattcaccgcgggcgctcactcatcaaacctaccaatcgtctgggccttcacccctttgggcactctgcaatcacaccacaccggtcggcaaacatcgcttttgctggacagcgcaacgtaacagacacgcgcctggggagtacgaacacacgttctctctccactcggcatgcaggcaacaacacccagagtataacacgttactcagacccccatggtccctatcccacgacctcaaagctatccacccacactgggccacccttctggcatgtgcacaaccacagtcgtccaacaacagtacgcgcccacaaccacgcagacgcctagacaagcccgacagatacgagcgcaagcagcaacccccaccccaacacgtcgcacgcacaagcggccagcagcccaacgtaacactcgctgggcacgtccaaacaccgacagatgccttcaaccacccacacaacgtaacgacaccgccctagcgcacacacctgacgcaccacacccccacgcgcacccgacgctggacaacaaccccatgggaccccccacaccgcgggcccacctaccgccagcacaacgaccaagcacatgtgcaggcgacggccgacactatcacccacgcgagcgaccgctaacacgtaaacacaacgctgcggaccccacccgacgcacacagcagcacaaccacccaccacagcagaccagagcacaaccaaccccgcagacacggagcacgccgcacgcgcc

SEQ ID NO: 619615 - DNA, 662 bp, Homo sapiens
cattgtaatttaaagtgaaaattaaaaaaaaaaaaaaaaaaaaaaaaaaaaaaaaaaaaaaaaaaaaaaaaaaaaaaaaaaaaaaaaaaaaatttaaaaaaaaaaaaattaaaaaaaaaaaaaaaaaaaaactggggcccgaatttggggctcattggcccatttccccttttggggggcggtttccaatttatgggccggtgttttaaaagggtgggactgggaaaaccctgggggtcccccatttaaaccccttggagaaaattccccttttcccaggtgggggaaatgccaaagggccccgcccggtcggcctttccaaaaggtggcccacccgaatgggcaatgggaattggaaggcgtaaattttgggtaaaattccgggtaaaattttggtaaaacccgtcattttttaacccaatgggccgaattgggaaaaaccctttataatctaaagaattcccccggtatggggtgaggggtgtcccagttggaacacagggccttttttaagaacggggcctccaagcgcaaacgcggcccgtttataaggggaggcccatttggggacccttcccctatcaagtttttggggccgggcccgaaaggccttaatgggcccctaagggggcccccgtttagcttgcggggcccgccccgct

SEQ ID NO: 619616 - DNA, 184 bp, Homo sapiens
ggtgggtgttggggttggggtcaccgtggtggtggtgctgatgggtgtcgaggttgctgtctgtgtgccgctggctgttgttcttgatgtcaccgtggcgtgtgtgctgatgggtgtcgatgttgctgtctgtgtgcccgtggctgttgttcttggtgtcaccgtggtgtgtgcgctgatgggt

SEQ ID NO: 619617 - DNA, 569 bp, Homo sapiens
cccgccgcacatcctctgagcagaagatggctgtgccacccaggtatgccgatcttggcaaaatctggccagggatgtcttcaccaagggctatggattgtgcgcttaataaagctgtgatttgaaaacaaaatctggacgacatgggatggcgcaatttcacaagctcagggctcagccaacactgagaccaccaaagttgacgggcagtctgggaaaaccaagtaccaggatgggactggaggatacgggccgtgacctgtttataccacgagcgacaatggggacaatacccgacaaattacacataggcgcaccgaagattactggggtggaacggactcaggccttgtgcacctgttgggaccgtgaagcttgacctttccgcaatttcaacttcccttttccttcaacgcttaaacaaccgtgggccaacaagaccacaacaagtggccatataaaatttccaaagaaccgaggggcttaaccaaagtcgggggaagcccacaattatcaacccttggggcgtgcagaaccagtgggcattttccggaacaattggccctggc

SEQ ID NO: 619618 - DNA, 473 bp, Homo sapiens
  misc_feature (95)..(95): n is a, c, g, or t
  misc_feature (108)..(108): n is a, c, g, or t
  misc_feature (185)..(185): n is a, c, g, or t
  misc_feature (285)..(285): n is a, c, g, or t
  misc_feature (302)..(302): n is a, c, g, or t
  misc_feature (306)..(306): n is a, c, g, or t
  misc_feature (319)..(319): n is a, c, g, or t
  misc_feature (328)..(328): n is a, c, g, or t
  misc_feature (334)..(335): n is a, c, g, or t
  misc_feature (358)..(358): n is a, c, g, or t
  misc_feature (360)..(360): n is a, c, g, or t
  misc_feature (366)..(366): n is a, c, g, or t
  misc_feature (373)..(374): n is a, c, g, or t
  misc_feature (381)..(381): n is a, c, g, or t
  misc_feature (395)..(396): n is a, c, g, or t
  misc_feature (410)..(412): n is a, c, g, or t
  misc_feature (414)..(414): n is a, c, g, or t
  misc_feature (417)..(417): n is a, c, g, or t
  misc_feature (419)..(419): n is a, c, g, or t
  misc_feature (421)..(421): n is a, c, g, or t
  misc_feature (428)..(428): n is a, c, g, or t
cgccaagagaggggaaccagagaggaaccagaggggagagacagagcagcaagcagtggattgctccttgacgacgccagcatgagctccttctncaccaccaccgtnagcttcctccttttactggcattccagctcctaggtcagaccagagctaattccatgtacaatgccgtgtccaacgnagacctgatggatttcaagaatttgctggaccatttggaagaaaagatgcctttagaagatgaggtcgtgccccacaagtgctcagtgagccgaatgagnagcggggctgctctcancccnccctgaggtgccncctggaccngggagnnacccacccagagagatgaggccncngggggnccctggnnctccttnatcgatctccctcnnaaagaagctgaggnnntnctnantnccctcgngcctggagaccactctcggggcagatgcagatgcccaacggctgg

SEQ ID NO: 619619 - DNA, 288 bp, Homo sapiens
ggggtgtctagaggatcccaacacgcatctggactggactgcatcatcgctgaggtcacgcccaatatgaggagattgctcagaggagcaggctgaggctgagtctggttacccagacaaagtccgaggagcctgcaggtcacagcagggcagacattgggggaccggaccttgcgggcaaaaaccaaggcaggagaattgctgaaattcaaccgcatgatccagaaggccgagatctgagatcgaccacgtcaagaagcagtgccgccaaacctgcagggccgccat

SEQ ID NO: 619620 - DNA, 318 bp, Homo sapiens
ctcgatcttgcccagtgatgaaaacgtcggggatgccgggctgggtctctttatgcccgtggccgacggcgtctccgtgcgcaccatcacctcaagggctggcggcgtgacctggatgccttcggtgatgctcagccataccttgctgacggcgatcgcccacagcgacgacgtgataccgattgcagtccaggaactggacgccgagatccgcctgatcacccatatcgcacctgccaacaacctgacgttgaccgacgaagtccccatcgacggtcacgccaccgtacaagtcaattacctttaaggagtccctac

SEQ ID NO: 619621 - DNA, 537 bp, Homo sapiens
ttttttagctaatattttattgaggatttttgcatcaatattcatcagtgatattggcctgtagttttcttttttggtctgtgtgtttgattttgttatcagggtaatgctagccctgtagaatgagtttgcaagtattccctccttctctatttttggaatcgtttgggtaaggttggtattagttcttctttaaatgtttgctagaattcagcagtgaatcatcaggtcccaggcttttatttgctgggagactttttattaccactttgatcccattatttgttattggtttgttcaggttttgggtttcatcatggttcaatcttggtaggttagatgtgtctggaaatttatccatttttggtaggttttcctatttattgcacacagttgctgaccactagtgatcctttgaggttttttttcttttctttttttatatggagtcttggtctgtcgcccaggctggagtgcagagtgagactccgtctcaaaaaaaaagagcaggaagcaccagttaacctgtaacctaca

SEQ ID NO: 619622 - DNA, 742 bp, Homo sapiens
  misc_feature (644)..(644): n is a, c, g, or t
ccgaacatgcggcccagcgaaccggagagcgggacgaggaaaccgcaggagccgcagtggtgctctgcggccttggagttctctgcgtccgggctgtgttcgccactctcccagcgttcggcggctgcgacgcgcccatagtgggacagcacgcgctcgcggccgagcccgatcggcaggtcgccggtgtattcctcctcgtcccccgggacgagttcgtacccgggagcgagacgttcgtcgtcatcggaaacggggagcacatcgccggggccgatatcgccggcatggagacgctcttcccagggcacccattcgggggccagaagtgcgtcgggacctgggatgagggagatctcgtcgatcgtcacccgcgcctcggcctccgacagcacgcacgcccactgccatccgcggtagccgcggagccgggagccgaagtagtgcgtcgcggtgttctccgcctcgcaggcgatgccctcgtgctccccgacggccgacccgcccgcaacctcggcggcagcgtccctggccagcgcgacagcgccggcgagagcttcgctgacctcgccaccgcgtcgctgcatgccggttcgctcggttacggatgtcatgtgttcattatgaacgcaggggtgccaaancccataaaactcgcgggtgcaggacccgcgagtcggggtatgcggcatgatttacctatgcgccacatcgccgatttcgtcccgtcgccccgcctctc

SEQ ID NO: 619623 - DNA, 139 bp, Homo sapiens
cttttttttttttccaggtttaatcaaagcctggaataagaataccttaatcctggattttttcaaagggtttttccttggaattgcccttttcctttcctacttggcgagatttggctttcccttctgtcgtcttctc

SEQ ID NO: 619624 - DNA, 344 bp, Homo sapiens
ctccaggcaaaatggttttcgcatcaactcatgaccaggcaagagtcttggtgaagcttttattgtcttgaatttatgattatttaagtatttaggcaaaggatccaaaagtgtccgtgggatcctgtaaacaggatcccccattgcaggttgtgagtctttgagctctgcatcaggacctatatgctgcaatgtgtttttacatggtcaggtattcctctttaactcttaaatgtatctttgagtaattgatgttttccaatcttgattgacttattttgtttaattatgtgaactggaatggaaaatcttttcctgccaattaaatgtaaaatttttgttta

SEQ ID NO: 619625 - DNA, 413 bp, Homo sapiens
ggccttgaaggtcttgccttcgaactgctcggcaacgaaggcccagttgaccaggttccagaacgcctcgacgtacttcggacgcaggttgcggtagtcgatgtagtaggcgtgttcccagacgtcgcaggtcagcagcggggtatcgccgctggtcagcgggcagccggcgccgatggtgctggccagggccagggaaccgtcagctttcttgaccagccagccccagccggaaccgaagttgccaaccgaagtcttggtgaattcttccttgaacttgtcgaaggaaccgaaagcggcgttgatggcgtctgccagggcaccggtcggctggacaccggcgttaggggccaggcagttccagtagaaggtgtggttccagacctgagcggcgttgttgaagatgccgcccg

SEQ ID NO: 619626 - DNA, 103 bp, Homo sapiens
ctggtgtcgtcaccacttcaagtgcgataaacaccgcatcagcgactactgaacctgtacggtttcctgcgcgacatctaccagatgccgggcatcaccgaaa

SEQ ID NO: 619627 - DNA, 204 bp, Homo sapiens
ggtcgactgaacatagatgcaaaaatccttaacagcataccagcaaactgaattcaattacacattaaaaggatcatacgccacaatcaagtggatttatctctgggctgcaaaggtagttcaacacatgcaaatcaataaatgtgatacaccacaataaccaaatgaaggacaatcatctattgaactgaacatatgtcgacg

SEQ ID NO: 619628 - DNA, 389 bp, Homo sapiens
  misc_feature (321)..(321): n is a, c, g, or t
  misc_feature (341)..(341): n is a, c, g, or t
  misc_feature (347)..(347): n is a, c, g, or t
  misc_feature (373)..(373): n is a, c, g, or t
  misc_feature (378)..(378): n is a, c, g, or t
gcaccccctcaccccggtcctcctcattagggtgcagggcctaggttttttccaggtgggggaggggggaaagtcaggaataaggggatccccaaaagtgcaaagcttagcaggcttgggcctgtcatggctggccggaagtgtccccagctccctacagacgctgtagccatccctgcctttccagggaccctcctttcctgcccaggacagacccagccaaaacccctggtaggatgggccacccccaggggtttggcctccagggacctaaagaatgggagggagaacggggccccaggagacccggccccccccccncccgctacccttgggtgccncagggntgtgctgttgccaacagtaaacctgnttttnctgtccaggca

SEQ ID NO: 619629 - DNA, 778 bp, Homo sapiens
ggagtcttgtacacttaagcagagcagaacttttatcgtggggctgagtggtgagggagaagagcgactaacagctgaagtaatgacagatcgtggctgggtcatatcagctttatcccttggtcatcatatctgttatgtatcttgactctgtccaaatcatgagaataaacatcatagtttcttggccactgaattagccaaaacacttaggaagaaatcacttaaatacctctgggcttagaaatttattatcatgcagcactgtaggaatgtatgctaattgaacatgcaattggggaagaaaagaatgtagaagtgatttttgctatttctagatagaaagaaaatgtctgtttaccaaagataatgttatacatcctattttgtaatttgtgttgaaaaagagttcaatgtgcagttttccttaggtgttttaccttgtttgtctctataggtcatgatttctcgtgaagcagaacagatgccttgttaccatgaattcttgagtttacagtcaataatattgtactattaacggggatcagaagtaggaaggaacacataagagatagcagaggaaaacagaaaaacatttcctcttataaacttctgacagtaatttcgtcacaccaaagattcgtcagagtcaatcatgtgtctacaattattttatcagaaacttaacatggaagatattcctttttaactttgtggtaacttctttgaaggttatttagaaatatcctttggaacaattatttgattgtctactaaa

SEQ ID NO: 619630 - DNA, 133 bp, Homo sapiens
gttgtctctttagtgatccccttacagcttcagggctaaccacacacatgcactgagttcaggtagaggggctgaatgagactgagagggagaggctagtatgacaggaggaaatgtggaggatgaggttagg

SEQ ID NO: 619631 - DNA, 323 bp, Homo sapiens
gagaggacagcgtgaaagccgcaaattggggccaggcatggtggcttatgcctgtaatcccagcactttggaaggccgaagagagcagatcacctgagctcaggagtttgagaccagcctgggcaacatggcgaaaccccatttctaccaaaaaaaaaaaaaaatttaccctttggcgggggggggggcttatagccccagttcctaaggaggctgaggcagaaaatttgtttaaccccaagaggcaaaggtcgcagagagttgaaatccccttattccattccacccgggccaacagagaaaaactttgttaaaaaaaaaaa

SEQ ID NO: 619632 - DNA, 266 bp, Homo sapiens
  misc_feature (53)..(53): n is a, c, g, or t
  misc_feature (83)..(83): n is a, c, g, or t
  misc_feature (95)..(95): n is a, c, g, or t
  misc_feature (113)..(113): n is a, c, g, or t
acttctcttttctcgctcagaacaagtgtgcaaacgagcttctcctgcccctnctctgagatcagatcctgccttcagctganccatccactccncttcctgaggggaaaganagatggccaggcagagaacagaactggagcagtccatctagggaatgggactgtgagccatacttgtgaaacgtctggctgctattctagagcttttatttggtgtgttcgtgcacagctgtttgaaatgtttaataaagctttataaacttt

SEQ ID NO: 619633 - DNA, 454 bp, Homo sapiens
  misc_feature (5)..(5): n is a, c, g, or t
  misc_feature (17)..(17): n is a, c, g, or t
  misc_feature (35)..(35): n is a, c, g, or t
  misc_feature (39)..(40): n is a, c, g, or t
  misc_feature (105)..(105): n is a, c, g, or t
  misc_feature (115)..(115): n is a, c, g, or t
  misc_feature (138)..(138): n is a, c, g, or t
  misc_feature (201)..(201): n is a, c, g, or t
  misc_feature (219)..(219): n is a, c, g, or t
  misc_feature (279)..(279): n is a, c, g, or t
  misc_feature (356)..(356): n is a, c, g, or t
gcggntcgacggctccnagctgtgggcctcgctgnccgnntcgcccagtctcgcgagagttgggagtaaacagccccgaatggagtgcccaggcgtgttcgcgcnggaggcaggnttatcccgggcccgccggcatgnagctcccggcggcgcagattggctcacagtggttgattgatcaaccccattggacgtttgttnctgtggtacaaatgggantacaggactcagtcgtcacggcctgagtgagagaagccttatttccaagaatggaagaanaagcggagaaagaaatgaaagcctcctcttcaggctgaaccacaaaaggccatggggatttaacttttatttatgtntggacaagactgtaagatgggctgatcaagtaattgtttgcagcttttagctgaaacaaaaattcacttataatcaaagaagaaaaaagttgtgattt

SEQ ID NO: 619634 - DNA, 235 bp, Homo sapiens
  misc_feature (5)..(5): n is a, c, g, or t
cttanagcatcctaaccagcatctgtactttatttaattttttaatagccattctgactggcgtgagatggtatctcattgcagttttgatttgcatctctttgatgattagtggtttttcatgtttgttggcagcttgcgtagtcttcttttttttttttttttttgggaaagggattctcgctctgtggcccaggttgaattgcaggggtgcaatctcagctcatgtgcaagg

SEQ ID NO: 619635 - DNA, 1420 bp, Homo sapiens
tgccgcagccccctgcgcccccggtgcccccgacatgtcttccgcaaagtggtcctggcagagcaaattcctggcatgtgttctggtgcagccggtcaagaacgaccatgtgctatgatggacattcgcgtgtcccgtgttacctagggacagcacctatctgccgcctgtcaacctccaaagttacctggctggctgattcgtgcgatggccagctcgagtggcgtgtgccttatcctggtgctccccctaagccaacgaccgcggcctgcacttagaccaatggccctaccactgcaccggctgctgctggctgcaccctgtgtgcacctagctcctagcgcaccactcgaccttggctagtccctccaccaacctgcaccgcacacgtccactacgccccacgcctggccctccgcgcacgcgaccatgcacccgctgctccacctggcgctgctgcgccacgcatctcccccaccacggacaccgcgcgcctgcaccccctcccccctgcctgcacccagcaagccccgcgctgcgctgcgctaatcctcgcgcccgcgggtcgccaccatcctcaaccgcctgcacgctagcgcggcccttccatccggccccttgggcctaccccacttcaccgtggccctctgcacaacccctgcttgcattggcctaccacgccttgtccacgctgcccttgcccgcaccacacccgccttgcgccttatccttcctacttccgtggcgccactcacattggctgcgtctgccccacctcacgccccgccgccctctcgcagcgccctcgcgctcccccgggccccctgcgcgacatcaccgccccgcgttgcaccatcccctcctttgtcacgcccctcccacgttcccttaagccacaacgtgggctcccaacgccccttgcgccgcatcgagcttccagctcctacaagccttgtgcgccccagtggccacctgtggccttacgcctggggccctcacgccgagcccacaccttggcccacacgtgtgccaaccccacgccgcgcaagcgccgcggcttgtcccgccccactcctcccgactactggtaacagccgcccccccggtctcccctgtcgcggtcgcccccatcccccccctctttgctcgtctgtggtgcccctcatgtacatgccccctgtggctgtggtactcggcaaatcgtcgtgctcatcctcatacttctacctccggcgtgtgcggtgctctccccccctgctgctcctccgcatccttcgtcccctccgcgttcctcccatctcctcaatctccccatttgtcggcctcactcagcaacctctgcgccgacacccgtcgcagtcgtgcatctcgctcaccctccccgctcgcgtcctccttctctctcgtcctcccctcgcaa

SEQ ID NO: 619636 - DNA, 831 bp, Homo sapiens
ccaggtcgcagggcagtgggaatgaagccgagccactgagaaagggcaacagccgccacgaacacagaagacagccgacaaggcttccggcccaaaaacaaaggcggtgccaaaaatcaagaggcttccttggggataaagtacccccgagaccccggcccattctgaaaagccccggcgaaggcagcacgctgaagacacctcggaggcccagggcccttccgggatagtgtcggtaaggggttttcacagtgcaatctctgccccacgagaatagaagtttccacagatgcaagcagtttctctcagtcccggctgtgaacgtcgggtggccttgagcttagggaggaaaacagagcagtttttcactcagttttttgttccctgcccgagtttgctgaccccaattcgttgccaaaaagatgtgtcactcagaatatacaaatcccgtatgggtttgtgtcatcctctcttaatcattttttactaattctaataatcagactctagcttggctttcataattttcaatggctttgcttgatctgtggatgctttctctcatcaagatttgcagcaatttttagcccaggcagtatttactcatttataagcgaaaaatcaaagatgttggctgaaagatcaaaaggctcagtttagccaaccttgttgtttgtacacaggtgatgtcagtccattggattgtctttgaacgaagtatgttccaaaaaaagaattttaataatcagacaactgttctgttgagaaccattgcccttggtaaaataacattggggtttctgaaaatttttctttttgtttttgaacatt

SEQ ID NO: 619637 - DNA, 745 bp, Homo sapiens
gcacaccagctcatcagatgaacctcaggagatgtgaagttaccccagatgtaaacatttcaggccaaaaatttaacattacactcctgattccagttgcagaaggctgaatgaaatctggcttcgtgtgacaatgaaaaacagtatgcacactggatggcagcctgagattagcctccaaaggcaagaccatggcggacagttcttacaacttagaagttcagaatattctttcctttctgaagatgcagcatttaaacccagatcctcagttaataccagagcaagatcaccgacgtgatataactcctgaatgtgggtgtctcccggtatctaaaaaagtataagaacaagcaggaaaaaggatgcaaaaaacaatgccaggtatataagagattggataacagcgagaatcttggaggccatcagaatgtagctcagatgagtctaattgaagccaagatgagatttattcaagcttggagtcactactgaattggcatcactcacttccattgaaggttccaggggtgcaaaaaagaaagaaaattatggggaatgggtaagaaaagactgatcgggatggatgccagcactggagatgcaataaaacgatgggtttcagaagatggaaagggggatgtcatggggaatcaaatggtaccggaggagatgcgatgaagtacgatgtcctcattgacgagtcgtggcagggcagattatggggactattttacgtgaaaca

SEQ ID NO: 619638 - DNA, 399 bp, Homo sapiens
ggcgactctagacgatccctaacacgcaatctaaaaaagtataagaacaagcagataacagcgagaatcttggaggccatcagaatgtagctcagatgagtctaattgaagccaagatgagatttattcaagcttggagtcactactgaattggcatcactcacttccattgaaggttccaggggtgcaaaaaagaaagaaaattatggggaatgggtaagaaaagactgatcgggatggatgccagcactggagatgcaataaaacgatgggtttcagaagatggaaagggggatgtcatggggaatcaaatggtaccggaggagatgcgatgaagtacgatgtcctcattgacgagtcgtggcagggcagattatggggactattttacgtgaaaca

SEQ ID NO: 619639 - DNA, 230 bp, Homo sapiens
ggatctagtggagccttaccctggagcaaacctgtatctcctaaaaatacaaaattgaccgagcatgttggcgcatcctgtgatctcagctgctatggaaggctgaggcaggagaattgcttcaaactgggcagagtgttgcagtgagccaaggttgacccactgcactccagcctgggcaacaagagcgaaactccatctcaaaaaaaaaaggaaggaaccggtgccga

SEQ ID NO: 619640 - DNA, 251 bp, Homo sapiens
aaagctcttcttaaaaaacagtcccaatgcgagaagggaagaagaggtgggagtaggggcaaccatttatgctgagtatcatatcccctccggccacctctttggttcagccactgtatgcagctgattgtcacagcaggtgtggcccaacagtcttagcctcagctgcactgaggacctcttgcttctcagctgctgctggtcctgctcagcttgtcaaaatacttcccatttgcaggcttagtgcctat

SEQ ID NO: 619641 - DNA, 589 bp, Homo sapiens
  misc_feature (174)..(174): n is a, c, g, or t
ttcttaaccactcatttacagtagaggagattggggttagtttcagaggttaattaagtaaaccggctctgttacctcccgcaggctccaggcactgtcgccaagctggtgttcttcatgtgcaggtaaacgacctttagacgatgtgtatactagatttcgcgcaatgacagnatacatgagtcatgtgttaaaagcgatgcttcatatctgataatatcgtgcacaatcttcctggacttcaaagcagcagcgtatgtcatatgtggtgaccaggattcatcagatttataagtgagttgcaatgatatcatcatctgtttgaattcagatgtggtgtcgcgagcttgatgttcgagtcagccaaagactgtagtcgtaagggagacttgggttcatgagtagacaggacatctacaacaccgcaggtagttgagccataacttccgaatctttcatttcatatgcagcagatgtagtaggaatcaccatatgcgactcatgttcaagagacatataggtgagcatagaagtagagaagtaaattccccagccgcaggatcagctcatgatgtctcagacatcgaag

SEQ ID NO: 619642 - DNA, 450 bp, Homo sapiens
  misc_feature (56)..(58): n is a, c, g, or t
  misc_feature (63)..(63): n is a, c, g, or t
  misc_feature (87)..(87): n is a, c, g, or t
  misc_feature (92)..(92): n is a, c, g, or t
  misc_feature (98)..(98): n is a, c, g, or t
  misc_feature (115)..(115): n is a, c, g, or t
  misc_feature (165)..(165): n is a, c, g, or t
  misc_feature (178)..(178): n is a, c, g, or t
  misc_feature (190)..(190): n is a, c, g, or t
  misc_feature (198)..(198): n is a, c, g, or t
  misc_feature (211)..(211): n is a, c, g, or t
  misc_feature (248)..(248): n is a, c, g, or t
  misc_feature (422)..(422): n is a, c, g, or t
  misc_feature (434)..(436): n is a, c, g, or t
gattttgtgggaattatgctaactgctgccacctcaaaaacttgtgccacaactannncatanccacatgaagttgtaagaacaagnctacntgaagngggaacaaaattcaganctttttttcagactctatctttgcttgttcaagaagaaggttatgggtcnctttatcgtggtntgacaactcatntagtgagncagattccaaacncagccattatgatggccacctatgaattggtggtttncctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccncattacttggcnnntcggtaatgtgaaa

SEQ ID NO: 619643 - DNA, 187 bp, Homo sapiens
cacattgcatcgtatggctggtcataatgtggccataaacaagtctactaaattacaaatgctggatagggtgtgtagacaagagaaccctcctacattgttgctgggattgtcagtaggtacaggcactatggggaacagtatggaagttcctcaaaagactaaaaatagaatgggcataagggga

SEQ ID NO: 619644 - DNA, 155 bp, Homo sapiens
gtgtacatgatgtattgattagtgatgattgattcgtgcgtctgaaaaatgttgtcataacgctaagttaataacagcaaaaagggctctgtagatattggaatcttcatcaataagatttcgaccttctgctcctctcaaaatcacattaagca

SEQ ID NO: 619645 - DNA, 259 bp, Homo sapiens
agcggcttcttttcgcgcgtctccgagatggcggcgccggcgctagccctcctcctcgccgtcgctgagcctgcgctgcgccgtgcgctcccgccggccttcccgcaggcgagctccaaccagggtcggcaggccatgtcgctgaggcaggcgtggcgaggtagttatacccgccatatgtgcgaagttggaatggcctataggtgcgcggagactagacgcccaggcatgacttggttgacatgaaggtaactacgga

SEQ ID NO: 619646 - DNA, 212 bp, Homo sapiens
acagtaccaacacataatgtgactcctaacacagtgaaccagcaatcaggagcacagcagttgtacagccggggtcctccatgcccctcatattgtgggatccactctaggatctttacaaggagcagcatcgtcagcatcccatcagcatacgagtgcctcccaaccatactcctcttttgtggatcaccatcacgtccggggtacacgag

SEQ ID NO: 619647 - DNA, 376 bp, Homo sapiens
  misc_feature (15)..(15): n is a, c, g, or t
  misc_feature (38)..(38): n is a, c, g, or t
  misc_feature (137)..(137): n is a, c, g, or t
  misc_feature (159)..(159): n is a, c, g, or t
  misc_feature (333)..(333): n is a, c, g, or t
  misc_feature (355)..(355): n is a, c, g, or t
ggggagcgaaaaatnggaggaaaaggggagactctgtntgattctctggggccaggagaccccatcaggcaggctacaaagtcctcggggaggctgaggatcacgggagcccagtagttggtggctgtagtttgcgncataggccactgcaccctagcnggggggaggcatgacccgggctctataaatatatgtcatagacggttagccatctagtactgtcggctaggaaaaggcctcatgggtaggcagaagatcatgtgatggagtgtcttctagttagcagggagtgtggtctaggtggagggagagctgcttggaggcggcaagganaatagccggcgcggccggtttngtagtagtaggagcgacccgg

SEQ ID NO: 619648 - DNA, 257 bp, Homo sapiens
tctggcccaacgttggtctcagatcaacgatggtcctcagcttcccaagtagctgggattgcaggtgcgcaccaccatgcccagctaatttttgtatttttagtggagatggtttcgccatgttggtcaggctggtctcgaacctcaggtgatccacctgcctgggcctcccaaggtgctgggattacaggcgtgagccaccatgtacaggctttttttcttttttttaatactgggtctcgttatgttgcccaggc

SEQ ID NO: 619649 - DNA, 581 bp, Homo sapiens
  misc_feature (68)..(68): n is a, c, g, or t
gcctaatggatgagaggcccccgcgcgcgtgtttattcggcgagggagagcctagttattctttcttnctttatttcgttcgttattcatatcgtctttcgttctttttgagacggaggtttcactctggtgcccaggctggagtgcaaggtatgatctcggctcactgcaacctctgcctcccgggttcaagcgattctcccacctcagcctcctgagtagctgggattgctaacacctgccactacttccagctaaatttgtattttagtagagatggggtttcaccatgttggccaggctagtcttgaactcttgacctcaggtgatccgtctgtctggcctcccaaaggctgggattacaggcatgattcaccgcccttttttttttttgtttttcttttttaaagacaacagtgggggtttccatctcgtgtgttggcccaaggcataagggggggcagcagtgtgaaaaaacagatctaaccgccgctcagggccagggttcgaccttcggggctcaaagcaatcctccgtgccttacctccaaaagttgtggaactacgggggcgcttaccacc

SEQ ID NO: 619650 - DNA, 686 bp, Homo sapiens
cgggttttttgggagaaatgtaactcggacacgttagcttttcaattgaaaagacacttaacccatgtcgggatgtcatctttggacaattagtcgttcccatgtggaagccaattagtcacactactgcatgtaaagcatagatttaacttttaacaggaaaatatgtggtaaaacccagaaagcatccatcatgaatgcaagatactttcaatacaaagtaagttatatagtaggtagttaagtttgcttttgtggacttaaatgtgtctcttcacttaaatcgggttgaatgtgtatatatgttgttcagcctgaaaacgacttagtttatatcctagctcactggaggcatgctgacataaccattacttctgtcccttctaattgtcatgtatatgcctaactggagctagtactttaattcttaacacaaaattactcagccattgtttccagcttccctcctacaatagaatgaagttttatttgatggcttgagatggctctatcaatattttgatttttttttcttcatgtgctacccatatattcttaccttgattactacagggaacatctagaataaatgtaatcctttggtatttcatcgctacatatcagctgaggtggttgatggcgtcgagatgatcaccttcacagtagaattgcctgtaaatactcgc

SEQ ID NO: 619651 - DNA, 139 bp, Homo sapiens
gggggggggctgggggggggggcggcacccccgcttatttttaatttccgtttttgtagcccccagccggggacgtcggaggtcctcgtccttgcggctttgcccccccattcccgcaaaaaaaggggtttggacccca

SEQ ID NO: 619652 - DNA, 253 bp, Homo sapiens
tgatattgccttgcataacatctgcaggcaggtgcgaggacaggctgagcttgtaaccacatcccctgtggaattgttgtcacaagctgtggcgcaggcctctggcactccagctgctgtcccgcatgagccaggcctgggtcagcaccgaggtctcctccagatccatgccccgaagtcggatggccatcagcataggcccgcatctgtgcgcgctgccgggtcccatttattaacagggggccacgaagcc

SEQ ID NO: 619653 - DNA, 437 bp, Homo sapiens
  misc_feature (10)..(10): n is a, c, g, or t
  misc_feature (69)..(69): n is a, c, g, or t
aaaagagacngggaaatagggggtagaagagaatggttccccaagaaaaggcccctaccccttaagccntggagactctcagcccctaagtagggaacaggcatttctgttttcatgcccccaaaagttaccttttggccccatgatgctcccccagtcctgtaccccatagaaaccccaaaccccgggctccagaagcagatgagccaacaaggagacggggagacaagcagacaaatggcgtagcagagaaaaagaagaggaggaacatctgaatgccaagagttcagctgggagtggtcagagaggagttccactgctgaatggccaaactccaggggacgatcatcttcccactccatcccccttccacctccccatccatcctactgagagccacctccactactcaataaaaccctacattcatccttcaa

SEQ ID NO: 619654 - DNA, 109 bp, Homo sapiens
gtagcaacatggtaggctgctgctgcatctcccctgctacagaggcgccgtgacgggagtcggacaggtcgcaggcggggccggggtccggagctggtgtctcagcgct

SEQ ID NO: 619655 - DNA, 184 bp, Homo sapiens
tgaagatgctgagccggaatccggacaattatgtccgcgaaaccaaggttggacttacagagagttccaggaacttatgtatcctccttacaatcctttgaagggtccaaggagatatatatagagagctttaatgctatccacaactctgagacgcgtatatttcacaaaccacattccctgc

SEQ ID NO: 619656 - DNA, 131 bp, Homo sapiens
agggattctatttgagcacaaattaactgagggggaaaatggtagcctgagtatttatatgtgtgtgtgtttgtgtgtgtgtgtgtgtgtgtgtatgtgtacttaaaataaattttaaatacacatacaca

SEQ ID NO: 619657 - DNA, 449 bp, Homo sapiens
atctagaggaccccacgcgcacgcggtcaatatatctccttatttatggggttggggtttgttatcaactctctgagagttcctcagatgttttggatactcatcctttatcaggtgtgtgttaacaaatatcttctctcagcctgtgcttgtgttgcattctaacatcttacagtgcattccagtgagttgataatccttgactagtagaattaaaatacctaattacaatgcgatgacattcacattagctgctcgtgccccaaacacagcatagtaagaaaataaagatgtacagtgcaatattagttggcggatcaagcagatcgtgaggaaagtggagccaatactgacgtgaagtccgtggcagcctgtgtcttacgaaaaatgttgagccgtagatgccgtcggaaatggtgacgggagcctcgaagcactctgaggcttgt

SEQ ID NO: 619658 - DNA, 457 bp, Homo sapiens
  misc_feature (12)..(12): n is a, c, g, or t
acctcctgttcnagggcaaccgtatttataacgtcacgacgctggcctctacacaaggggtttgcatgattttcacgcggaacgtagacaccctgagggcatacacacacggtgtacctgtaaggggacgactttgcacagaacccaggaaatgcaggggtgcagacatgaggaaaccccgctaactagcgaggttcttccactttaagtggttgacatagtggctacggatcgtcaaaaatacttacagagcgcgaaatcagtggccttgcagggcaatgactgacgtaggtaccccggcgattctgcaaaatcggtggtggtgagacctcttctcccctttcctgaggagactgatatcaggattcgaatccccatgaaaagggcagcctgtcaaacagcgttgaaaagtttccaggtaacagcgtccaaaagtttccagttgctcaagcttttt

SEQ ID NO: 619659 - DNA, 245 bp, Homo sapiens
ataacagctcgtaggctacacgggcactccaccaaagctccatgtctcgcgcgctagcgtagggggcttatgagcaaaatctctgatcggtaacgcttcacaaaagacctatatacaacgtcgttatcatcgaataactagcgttttatcctcattttttggggatcataaggtgagggtgtcaaacagcgttgaaaagtttccaggtaacagcgtccaaaagtttccagttgctcaagcttttt

SEQ ID NO: 619660 - DNA, 390 bp, Homo sapiens
  misc_feature (4)..(4): n is a, c, g, or t
  misc_feature (42)..(42): n is a, c, g, or t
  misc_feature (60)..(60): n is a, c, g, or t
  misc_feature (70)..(70): n is a, c, g, or t
  misc_feature (72)..(72): n is a, c, g, or t
  misc_feature (79)..(79): n is a, c, g, or t
  misc_feature (81)..(81): n is a, c, g, or t
  misc_feature (109)..(109): n is a, c, g, or t
  misc_feature (145)..(145): n is a, c, g, or t
  misc_feature (173)..(173): n is a, c, g, or t
  misc_feature (209)..(209): n is a, c, g, or t
  misc_feature (214)..(214): n is a, c, g, or t
  misc_feature (245)..(245): n is a, c, g, or t
  misc_feature (249)..(250): n is a, c, g, or t
  misc_feature (252)..(252): n is a, c, g, or t
  misc_feature (301)..(301): n is a, c, g, or t
  misc_feature (309)..(309): n is a, c, g, or t
  misc_feature (317)..(317): n is a, c, g, or t
  misc_feature (328)..(328): n is a, c, g, or t
  misc_feature (330)..(330): n is a, c, g, or t
  misc_feature (335)..(335): n is a, c, g, or t
  misc_feature (389)..(389): n is a, c, g, or t
attnttttttaagattaatatatttttttgtattttttacgntatgtggaagggaatgcnggagtaaaananccccctntnccctccgcccgcccacccgcccgcccgntcgcccgttcgcccgctcctgtggtttttctgagcntgcgggcgccgggaggggatgctgaggntgatggagctgcctccagggctagggccactcaccngaggncgggcggggcctgcacttgaagtcaggccgnaccnntntttttttggaagggtagccgacaaatccttccagagggaaagttctttntttaaggntgtacttnaaaggtcaatntnagggnttcctgtttgaagtcaagtagaggtaaaccggtcagttacagaaggaggatttnt

SEQ ID NO: 619661 - DNA, 1280 bp, Homo sapiens
tgtatggcttgtggactgaggtcgagttcagatcctcttacctaaccaagaagacaacggtaaggactggactctactccgcgcgcacagtattggtatgttgggagtaaaatgtggtaaagacaggacgctacgtactatgatatgtcacctgtagggtatggaattgacctggataaaccatggcatattgatacgttctgaaccaagctcggtattgacctctttggtcgattctcgtttgtaccctaccaagtacccgtgagacctaggatgagcacgaacgcctccaagaccggcggaaaccagattgaggcattcttaacaagacaggtttaaacgagaacacgacgcacgtgttggtacgcccttctagctgtggtatagataccatctggctccgcatggccaccagagggttccgggcctcgcgagactcagatggattgtcctataaaatagaaaacgttagggccagccgaatgttggtatagtcacatgagaaggcgattttggaatgcccgatgtacacttgctcttggtagtcctggatcacgctcacgggtcttaggagcggtaaggaaccccttctgattagggtgctgtggcattttgtatgacgctaggaggcctaataatgcggtctcctattaaagaagagcgttctagctgggtctcctaattaagagatccaatctatgggggactcggggagccggcggccaacttagactatccgggaaccgttcgtctgccccgacacgtggcccggagcagcgacaaatggggccagataggcatattctaaaagggtgaccgctgatgacaggactcaagagggacatcagagcgctgagccactaaagccggagctcttctttacgttcttcatgtaccctagtcttctttgtgttttttctctctcctcacggcagagcgagcaggagaaggccgcgaaagagaggacaagcgagagcgagcgcgacgcagacgcggcgcacgagccgacggagaggaccgaaagagaggagcgcgggacaggggagggggcgagaggggagagaggaggagggaacgcgagataagagagcagggggaccggagggggaacggaggagaacacagtgacgagggggagagaggagggggagagggcgacagagaggacggaaagaggtcggaggagaggggacgagcggcgacgacagagagaaggggaagcagggacagagtaggcgaaaaggaaagcgaggaagcggaggggagcaaagagagagacc

SEQ ID NO: 619662 - DNA, 545 bp, Homo sapiens
  misc_feature (247)..(249): n is a, c, g, or t
aggaccagtcttaaaaaaaaataaaaaataaaaaaggaaagtgtatggtcgctttagatagtgaggccaggatggtctctgagaaggtgacatgaggaccaatccctgaatgataagatggagcaactgaggaaagcttttgaggccggtggaatatctaatgtacatgtcctgatacaggaaaaatcacctagcttcctgctggctggggtcatagctttcatctctgtgtaaggctagtcctgcnnngcctagaagaggcttataatatatacctttccattcagcctgattgtccaaacacatcccattgtttaattagaacaccctgatccagggccaggtgcaatggctcatgcctgcaggagaatcgcttgagctcaggagatcaaaaccagcttggtcaacatagccagacccccatctctactaaaaatttaatttaaaaaaaaaaaatgctgagtgtggtggtacgcccccgtagcccgatacacaggaggctgaggcgggaggatcacttgaatctgggtgggagattgaggctg

SEQ ID NO: 619663 - DNA, 238 bp, Homo sapiens
aaaattcaaaacaagaaccaaaccaaaaaaatttaaggggaaaattattcaaatcggaaaggagacttaagttgatagtgagtggatgattgaggcagatttaaagtttggttgataacaggtagtacagattaaacatttacatatgtatacattttggactattgtagtttagtttttgcgcaacacatcttatctcttcctcactctgcttgttaatccagagtcttatgatgac

SEQ ID NO: 619664 - DNA, 267 bp, Homo sapiens
cacgaggctcgatctcagccaggatcatgagcccgaccgagtacatcgcagagagcagcacgaacgtgagcgcagagcccaggtagaagtcgcggcgggtgaccccgtagccgagtgcgtacgaaaacgtgagattgatcgtctgcacggcgacaacgagcatgtacacgaagatgtacagggatgccccgctccagctgattccgaccgaagccggccccacggtcccctcacccgtggcgcggtcgatgatgagccagatcgaca

SEQ ID NO: 619665 - DNA, 794 bp, Homo sapiens
gcctcctaactcctcatggtacccattctaatcgcaatggccatacctaatgcttaccgaacgaaaaattctaggctatatacaagctacgcaaaggccccgaacgttgtaggcccctacgggctactacaacccttcgcgtgacgccataaaactcttcaccaaagagcccctaaaacccggcactatctaccatcaccctctacatcgaccgccccgaccttagctctcagcgtcgctcttctactatgaacccccctccccatacccgaagcgcccgtggtcaacctcaacctagggctcctatttattgcgttagccaccgtctagcctagccgtgtactcaagtcctctgatcagggtgagcatcagaggtcaaactacgccctgactcggcgcacgtgcgagcagtagcccaaacaatctcagtatgaagtcaccctaggcagtcattgctagctatcaacatgacctaataagtggcatcctttaagcctctccagccttatcacaaacagaagaagcacctctgattactcctgccagtcatgacgccttgggcatcaatatgatttatactccactagctagcagagaccaagcgagacccccttcgaaccttgccgaaggggagtccgaactagtctcaggcttcaaacatcgaatacgccgcaggccccttcgccctaatacttcataggcgaatacacaagcattattataataacagcctcgacactacaatcttcctaggacacatatgacgaatctcccctgaatctacacaacaattg

SEQ ID NO: 619666 - DNA, 737 bp, Homo sapiens
tacatcttagtctgcagggtggcgtttaggtttatgtacgggatataaagtatcacaatacaatcttcactgtacataaaatatgtcttcatgtacagatctttactttaaaagctgaacattccaatttgcgcctaacacactcaccaagcccctgcccaccaagtatctcctttaacatcatctcagtcctgttggcaccatgcaccccacatgtaattcacattttatatacttacatcatgcatcgcacagcgcattgaatcactctagcaccattatctaacacctatttctctccatattcaatcatgcattacaacttttgcctcaacatccttacttacatatttcccatttgccttgaatctttagttcgatttccctcttactacccatgtgacacacaacaacaagtaccaaggaatgaggtcacctctgacttgagaatatcacttcccatccgtaatctactatgactcacaggacccccttggaaatcatcgttacctcttcggctaacttactcatattctatcttgtataatctgcactctactacatagcgtccttaaaccgggctcacgtatacaccatcccacaaccacatcgcctataagacaccccaccaccccatagcgaaaggcttgagcgaaatcaagcgactgaccataaactcaattatgcgactacctccacccagtggcaccaaaccccattccccggcaccttccacc

SEQ ID NO: 619667 - DNA, 394 bp, Homo sapiens
  misc_feature (1)..(1): n is a, c, g, or t
  misc_feature (228)..(228): n is a, c, g, or t
ntgcacaggaagccttcacagtggaagggggacttgggcccccacatttgaaacctgtaggtccccccagttcacctgccttattggggcccaacattgtacccagttggttgggaggaccagagcctgtctcagggaattgcctgttggggttatccagggagaaggggaggtgcaggaaagagggcccggcctcagctgtcaccagcatttttgaccaagtcctgntagtggggcccctgccctagggtttagagcatggacctcctgccctgggggtcatttggggccagggctttttggatgctttcctgctgccccagccagggttggagttttagccttgggatccagtgaagccagaagccaaataaactcaaaagttgtttcccca

SEQ ID NO: 619668 - DNA, 422 bp, Homo sapiens
tgatctaaggatccccaagaacagacactctgggcacaaagggagaatgtctctaaaaaaataaaaaattaaaaattagccgggcattgtggcacgttgcctgtggtcccagctactcaggagtctggggtgggaggactatatgaggccaggaggtcgagactgcagtgagctgtgattgtgccactgcactccagcctgagcaacagagagagaacctgtcaaaagaaaagaagaaaagaaaagagaaaaatggaaggaaggacagacacaagatgtctaatttgaattcacaagaacaaacgaaaaaaaaaattggtatttagggtcaatataaacggtagatggtcccttcaagaaaatacctgccttatacagaactacgtggctgtataaccccaaagtgtctgactaggggaacc

SEQ ID NO: 619669 - DNA, 115 bp, Homo sapiens
gtggtactctgaggatctcagtgctacctccacaaacagtcaaacaaataaaaggctgatttggggattttatcttgaatgttgagtgtagcactctgtttgtggaggtagcact

SEQ ID NO: 619670 - DNA, 359 bp, Homo sapiens
cctctccctctcttccctttctggactttagtctttcacttccaattttgtggatgatattttcggaataacggacttctacagacgcaacaaaaggactgaatttccttgcttactttgcatatacagactggattattttttttttttacagccttttccccaaaggattgtcttgctttttactgacatttggtatgtctcattcatcggaatctttcttattttctaccgtgttagaaaagcctgtaagaaatacgggatttgataatattttgacggcgggaaaaccccgaattgtttcttctttgagagtcatgcctaccttctggtgtggagaaattgccattggacaattg

SEQ ID NO: 619671 - DNA, 352 bp, Homo sapiens
ctatgacacccgagaccagacgagctacctatgagcagataaaagagcgcacaccggtatgtagcaaaatagtgggaagagatataggtagaggcgacaaacctaccgagcctgtggatagctggttggccaagatagaatcttaggtcaactttaaatttgcgccacagaaccctctaaatccccttggaaatttaactgtgaggccaaagaggaacaggtctttggacacttggaaaaaaccttgtagagagagtgaaaaatttaacacccatagtaggcctgcaggcaccaattaagaaagcgttcaagctcaacacccactacctccctatagaagaacttggtaggt

SEQ ID NO: 619672 - DNA, 335 bp, Homo sapiens
  misc_feature (56)..(56): n is a, c, g, or t
  misc_feature (78)..(78): n is a, c, g, or t
  misc_feature (117)..(117): n is a, c, g, or t
  misc_feature (168)..(168): n is a, c, g, or t
  misc_feature (183)..(183): n is a, c, g, or t
actctagaggtcccctcgaatcgacggtctctaatcataaatcagaagaactttanactttaacaagaaaaggataanaaggcataacaaggcaaaagtgctcaagaaaagaaggcnaagctcatttaactgtggaacctgaatctgaccataacctctgtcctaatnattaattcacaaaantacaggaaacagaagaatactgattacgtgagatactacgggatacaaccatcaaaatccaaactgtggaaaacaacaggatagatgacatacaggttactagctatttatcgccgggaataaaattgcgaggatgagaaaagatgaaagag

SEQ ID NO: 619673 - DNA, 110 bp, Homo sapiens
ggcatctgacttctgcatacctgaccttctggcatcctgaccttctggcatacctagagcttctggcatacctggaacttctggcatacctggagcttctgtgcatacct

SEQ ID NO: 619674 - DNA, 167 bp, Homo sapiens
tatacgacgtcgagtctcggaccgtattattaaataccaaaaaacattttgtttctatttaataataaaccacactgaaattattgccaatgaatcccaaagatttggtacaaatagtacaatccgtgatttgcttatcctctttcctgttcttcagtacaaatcag

SEQ ID NO: 619675 - DNA, 303 bp, Homo sapiens
tttcctacgtcggattttggagacgcatttttacctctaaatcgtgcgcgtcccatttcgcgttgcccaccgccgaaatcggggggcaacgccagaccaattgcgtgatacgccttctctggctccctccacccatggaccagcgcattgccgtgtgcgcactgtcatgtgtcttgttctgccgctgctctctgctcctccacgcatgtgccggagcacctcgtgcttcttgtcggcgtcccctccacagtcgtgtttctgccacacctcctctcatatttgttgaagcacggtcacctctgc

SEQ ID NO: 619676 - DNA, 298 bp, Homo sapiens
tgctcccattacagataatgccatggcagagaggaacgcgggatgctgaggaatgtgttccacgccaagagtgcagagctgaacaattgagtgtgtctaccaagcactgccatagattcagacgcagcaagacagatgatcactggaagctcagtgcgcactgctccaagtgcctaggcgattgaagctgcatgtcccatgctgagccatgaacagctgggtgctggatgaaacacgggtgtgcatcagacgggagtgcctgctattgcccgtgcatgcttgctgcagattccatggg

SEQ ID NO: 619677 - DNA, 476 bp, Homo sapiens
  misc_feature (203)..(203): n is a, c, g, or t
  misc_feature (210)..(210): n is a, c, g, or t
  misc_feature (212)..(212): n is a, c, g, or t
  misc_feature (221)..(221): n is a, c, g, or t
  misc_feature (223)..(223): n is a, c, g, or t
  misc_feature (230)..(230): n is a, c, g, or t
  misc_feature (234)..(234): n is a, c, g, or t
  misc_feature (240)..(240): n is a, c, g, or t
  misc_feature (248)..(248): n is a, c, g, or t
  misc_feature (288)..(289): n is a, c, g, or t
  misc_feature (312)..(312): n is a, c, g, or t
  misc_feature (318)..(318): n is a, c, g, or t
  misc_feature (324)..(324): n is a, c, g, or t
  misc_feature (327)..(328): n is a, c, g, or t
  misc_feature (336)..(336): n is a, c, g, or t
  misc_feature (340)..(340): n is a, c, g, or t
  misc_feature (342)..(342): n is a, c, g, or t
  misc_feature (344)..(344): n is a, c, g, or t
  misc_feature (353)..(353): n is a, c, g, or t
  misc_feature (357)..(358): n is a, c, g, or t
agagcggtctggggacaggtatgatcatgatgacgaggtagagcgcggtagccgtcgcgtgtgtcaagctggacagggtcatcctgagggtgcgactccgccgcgatggtgacccggttcctgggcccacgctaccgggagctggtcaagaactgggtcccgacggcctacacatggggcgctgtgggcgcgtggggctggtntgggctnancgattggcngntgatccnggantgggtnccttacancaatggcaagtttaagaaggataattaattacacaaaccnntcacagactgctctggtgcctgntggtgntagctnctnncacctcancacntncncatctggancagnncaagcctcaggatggacaagaggaaacccacagctcagcttcaggcttcttatgtttctgaaaacagcttggatattttaatgcacgttgcattaaacctcactgaaacctgaaaaaa

SEQ ID NO: 619678 - DNA, 653 bp, Homo sapiens
  misc_feature (2)..(2): n is a, c, g, or t
tngacagagttgtgcaggtctacctgggtaggagtgattataagcagtggggaagagaccatgagcacaagggcactagcccagtggcagcagaaggagcaggccattgagacggtgacaagccccagaactggcgactatcatcaagcacagagcccaagtgtacatggccatggagtgggaaaagtggtgccaattagcactccgagtaatccttactcctgatgcccacaccaggagcattctgtccttaaggatattctaccccagaaggagttgtgggggaggaggggggtgcatcgtaaagccatgctaagtgtgagaacatccaggttagacttacaaggtgtgggagtggcagcaggttctcgatgggttgaggctcttctggacaatggcccacccctgtttacccgagcaccaaccaggcagagacaggaatgctaatggctgggagtggtagtaaaactgaacagggtgtgtatgacatacgtatcaatgtatgtgcatatctgttcccatgtgtgctagagcatgtgttcaccagaaataaagctttgcacaaccatctgtttgtggatttggaaacagtaaaaagaagacagcggcacaaatttggctaagaagtgtattagaggctgagttcagctcct

SEQ ID NO: 619679 - DNA, 718 bp, Homo sapiens
  misc_feature (98)..(98): n is a, c, g, or t
  misc_feature (126)..(126): n is a, c, g, or t
  misc_feature (142)..(142): n is a, c, g, or t
  misc_feature (150)..(150): n is a, c, g, or t
  misc_feature (155)..(155): n is a, c, g, or t
  misc_feature (216)..(217): n is a, c, g, or t
  misc_feature (221)..(221): n is a, c, g, or t
  misc_feature (244)..(244): n is a, c, g, or t
  misc_feature (252)..(252): n is a, c, g, or t
  misc_feature (255)..(255): n is a, c, g, or t
  misc_feature (264)..(264): n is a, c, g, or t
  misc_feature (279)..(279): n is a, c, g, or t
  misc_feature (301)..(301): n is a, c, g, or t
  misc_feature (304)..(307): n is a, c, g, or t
  misc_feature (346)..(346): n is a, c, g, or t
  misc_feature (348)..(348): n is a, c, g, or t
  misc_feature (353)..(353): n is a, c, g, or t
  misc_feature (361)..(361): n is a, c, g, or t
  misc_feature (370)..(370): n is a, c, g, or t
  misc_feature (394)..(394): n is a, c, g, or t
  misc_feature (442)..(442): n is a, c, g, or t
  misc_feature (519)..(520): n is a, c, g, or t
  misc_feature (544)..(544): n is a, c, g, or t
  misc_feature (595)..(595): n is a, c, g, or t
  misc_feature (617)..(617): n is a, c, g, or t
  misc_feature (628)..(628): n is a, c, g, or t
  misc_feature (673)..(673): n is a, c, g, or t
tagcattaaataacactctttaaatggtacacctatgaagcaagaattaaatataaacccagtctaatcctgtacacttgtaattaattgtaacaatnttaagtagctcacttctatcccatttanaaattaaaaaaaagcncgtttccngtttncccctcaccactttgccttggcatcacaccacccctgcctcgggcttcagctgccggtccnncccngcccctcctcccagctgggctgnctccagtnccngccccagtntccaccaactgagcngcgtacgggggttgtgtctggnttnnnnatctaccaccccttcagagcaacttccaacatgggaccngngaggnagctcgcnttgcttggnctgaacagatttccggaggttttntcacaaggccctgaaaacttcctaagcctgctttctccttgcacagcnggggtggggctatggtgggtgcggggggggggggtggcgggggcggcaggggctctcaacttaggtctctgaatcanngtggggacagatgctgccttagtncttcttgcctcccagggccaggtttcttgtgaggagctttcctgggcgggngggggtcagtgtggagactgtnggggattccancttcactctgtctaagagggtcttcttaagggcagctggggagancttttcttggtcggccatggactgtagctctcgtgttcggataca

SEQ ID NO: 619680 - DNA, 782 bp, Homo sapiens
ctttctgacgagtagcgcgatttttggataatttcatttgtagtcacgatctagatttgcaggtcctcaaatgggagacccccaaatttctctgtccgcaatctgtcgccagggatgtgatacaggcccgatacatgtggaaaatgggggaagacccccgggtgagaagcttacaatttacggttttggtcttgggcaattgggcaccacggaaacaagaccttgccttgagaatctttgttgtatcttggggacttttactcttgcttgtttgactgcttaaacttccaaattctctgtattccaatcttgattgtggcgaatctacttccaaaaggaaaataatcccactttgtggatattaaatggaaggtttgctgttctgatctagttgtttcccgtggcacacgttttatgaaatatgttctataagatgtacacttttttcacttgtaccatagaaccattgtaaataaattgattaaagtgctgcaacttttgactgaattttttctagccactttttacaacgagaacaactaggaacttgagtattttgtgtacggtactagtttccatcctccctccccttcctcctcccctcctctctctctcttcctacctatttaattttcatttgtcatgaggtttttggatttgcccatgcatttcgctggacatcatgccccctgtcatagagaatataagctgatgattgtacccgtccttaattattcatgattcaataaacctgatgcttatttattccaaaaaacataaaa

SEQ ID NO: 619681 - DNA, 693 bp, Homo sapiens
  misc_feature (218)..(218): n is a, c, g, or t
  misc_feature (301)..(301): n is a, c, g, or t
  misc_feature (329)..(330): n is a, c, g, or t
  misc_feature (355)..(355): n is a, c, g, or t
  misc_feature (392)..(393): n is a, c, g, or t
  misc_feature (411)..(411): n is a, c, g, or t
  misc_feature (422)..(422): n is a, c, g, or t
  misc_feature (431)..(431): n is a, c, g, or t
  misc_feature (435)..(435): n is a, c, g, or t
  misc_feature (442)..(442): n is a, c, g, or t
  misc_feature (467)..(467): n is a, c, g, or t
acatgccagagctggatggtgggtgcccggcacggaggggctgcggaccaatggctctgccctgcaccttagggctcgggatgctgctggccctgccagggccttgggctcgggtggcagcgcggaggacagcgtgggctccagctctgtcaccgttgtcctgctgctgctgctgctcctactgctggccactggcctagcactggcctggcgccgcntcagccgtgactcagggggctactaccacccggcccgcctaggtccgcgctgtggggccgcacgcggcgcctgctctgggccngccccccaggtcgctggctgcaggcccnnagctgagctggggtccacagacaantgaccttgagcgacaggaggatgagcagggacacagnnctatgaccacgtcgcggntggtggcctgnaggcttgancctnggggaanggcgagcagcaatgtggagaggcgntccagcccaagaagcagggttcccctgtgcgtggcttgaggagagccagaagacatgtgacacggggaggggcgacctggtccttcggctccccaggaccagcgagcgcagggggcagtgctgaggccctgctgagtgacttgcacgcctttgctggcagcgcagccttgggatacagcgccaggcatttgggggccagtgcctccatgtcacgcgattgtagagc

SEQ ID NO: 619682 - DNA, 110 bp, Homo sapiens
agcccttagcgacagacctgttgggagcctgaagacagtcccatcctggtcctcaggtgtgactcacactcactgcagtttgctgctgcccctaaggtggtcccggtgtt

SEQ ID NO: 619683 - DNA, 320 bp, Homo sapiens
  misc_feature (59)..(59): n is a, c, g, or t
  misc_feature (67)..(67): n is a, c, g, or t
  misc_feature (193)..(193): n is a, c, g, or t
  misc_feature (200)..(200): n is a, c, g, or t
  misc_feature (236)..(236): n is a, c, g, or t
  misc_feature (241)..(241): n is a, c, g, or t
  misc_feature (286)..(286): n is a, c, g, or t
agaaggctgggcctaggccgctggatgctggagtgaaaggaagggagaaagggagcggnaagagtcnagaaggctgagtgttaagaggccaagtgcgacgcgcgtatccggcagacggactgacggacggcccgtgcttctgccgcggctgcggcgcccgcgcgagtcgcgtctaagcggcggcggcggtggnagcggcngaaaccgaaggggagccatggcggctgactgtcggnaggangatggagaacttaatgttctggatgatattttaactgaagtccanaacagatgatgaactgtataatccagagagtgac

SEQ ID NO: 619684 - DNA, 229 bp, Homo sapiens
accccaaactcccagcccatcacggtagatgcaaactattacactgagaaaggataagcaatgaggtcctgctgtacagcacaggaaactatacccagtctcttgggatagaacatgatggaatacagtataaaaaaaggaatgtatatttacgtatgactgggtcactttgctatacagtagaaattctcccaacactgtaaatcaacacggtaacaccacagctacg

SEQ ID NO: 619685 - DNA, 344 bp, Homo sapiens
ataggtaggtaatatattagagtctagcaagttcaataaatcatgagatttcccatcgttacacccttttgtattcaccttccttgaatcaaacattttcgagtgaactacgtgtttttattacagacatttgttgtattcatcgtcgtgactgtacatacctttcaggatgagactgcaagaatgttgggcaataatggttgaatcttttttccgattgtctttcatacttaagtgaagtgtcttgtctgcattatcctgccgggtatgtatccagtactacataggtgggttaaatgtggtaattctagttcagtgtcttaccctgaagagaaagttgtagg

SEQ ID NO: 619686 - DNA, 1098 bp, Homo sapiens
tctctctctttccctgcagaaggggcccggtgtccagctgcctattttctgcccggatctcgggctcctcatctctccggtctccgcaaactataaaggcccttcgggattaatgcagcaggccatgtgcctgtgtgttgcacacggcttgatgccccgggagccccgtcccgcccccgcccttacctgttgccgccttgcgagaccagggtctccctgtggcatacctgcatacggggcgccgcgacagattggtgagagccgggaaaccagagcgctgtgtgagaagcggcctgtgagagggccagaccaagggccaagcgtacgttcaagagagccctgcaccggttggccaaacaccccgcacaggagacgcctgtggtgcacgcccctgtgctgtgctcacaaaacaagccagcttctttcagccctgtgaagacctcgccgccacgggtgctacacggccacacgctcgcacagaagccctgtgcctgtgggccctctgtgccggatcgggcccacaagctgtgggcaccctgtggaacatttctcttaagaacagcgccttcatctcagaacttgtgtgttggtagaccaagccccccgtgtggttccccctgttgccgagagggcccacagccggaaccactcctgtgagacggggggccaaaagtgaaaaggccaggagccggtcacttcaccacaaaaagacacacacccacatcacggagcaaaacaccgctcgccccacaaataaacccatcagtagcggagatccctgcactggcgtgtgtgagcacctttcaccggcaccacccttagcaccagcacatagcgctctatgcaccgagagccacttggcccacaatcaaacccgggtgcaccctagccatcacgcgacactacaacacgacccaaaggcccgggcccacggcagggggttctggaaacacggtaccaaatgtgcgaattctagacacagaagaccgtttcttcaaagggaggacaggcagggtgaaatccacaaaaagaggttttataaaagttttggcggcctgagaacccgagaagaaaggcaaaaacggtagggtgagttgc

SEQ ID NO: 619687 - DNA, 276 bp, Homo sapiens
tacagagtgaatgtgaatagtacaaatacgtgtcaaacaagcgccgtcaataacggcgctccctggggttcaaccgcgcagcgcggtgatcaaatcggccagccaaggctcggcgtcagcttccggggtgacgctttcgctggcgtccaggcgcagcatcggctgcacttcgcggatgcccagttcggcgaacaattcgcgcatttgttcaccgccgccacagaaggtatcgccatagctggcgtcgcccaggccgatgaccgctcccggcaggcc

SEQ ID NO: 619688 - DNA, 141 bp, Homo sapiens
tttatcatagatggagacctacaaagttgtcagaccacatctacaaaatgccagtatcaggcggcgggtaagaaaccaaagtgatgtttggatgtacacgtgacaactattaagcttgggcggactggacacgcacgacta

SEQ ID NO: 619689 - DNA, 126 bp, Homo sapiens
atgaggatcccagcgtcaagatactgaggtggagcggagagcaggtgcatgtggcggatgatgagcctgcagggaggcatctgttgatgtccatgtgcctgccatgggctagttcacgattgttcc

SEQ ID NO: 619690 - DNA, 371 bp, Homo sapiens
tgaatggctcacggtgtgtgtggcacagtccatgcttttacccatatttacacagaagaatgcccacttggcccaggtagaagtagttagagtgtttggttccatgtgtcacatacctccaagagttcctccccacgatccaatcccaggtggaattgcctctcttgtcaaatcccttcttgatatgacccgcaatgcccttctctatgtgtgtatttctccagcgcttaagtagcgcactccccaatgtcctgttgcatctcttcccacatgtccgcatttttgatcacgccctttcgctcgcacatggtcccaatgtgccagagcccgtggaaaagggctctgcccgtctgccgcggtctcctagggct

SEQ ID NO: 619691 - DNA, 835 bp, Homo sapiens
gggagggaagccggccaggctcggtgaggaggcaaggttctgaggggacaggctgactggatggaccagaggtcccgggaggaagcactgagggagaagatctgccagtgagtctcgatggcccatgtctgcctaactccctgctgtgggcccttgacgccaaggagtcttcatggcctcttgttgagcaagaggatgtccaagcacgttgcaaggctccttgaagaaaagcgcctttgaaggccccctggagtgaggagggccctctgggtccttgggtgggttttgcgcaggggctccctggtaaacttggagggaggcaagggaagggttgggccttttccttcccttcattttccataactcctaaatgttttagcaaatgtcaaccccccgttggggggaaaggggttggcccctgtgtttggagcacaggagtcgtcacacccaagagaattccctttctccccacaaaggtagttcccatctcacaggggggaaggccctcttcacaaagggccttttccccaccaagtttacaccccattgtggaagtttaaaccccctttcctttctttggggagaaggcccaaaaattcccctttaatgtggaacgggaaccttctcacaaggacaaaccccaaatggaaatagaaggcgacagggcgggcccaaaacggccacctcttttcccctttgtggacctcgttgggagtgtcttggggacgttccccaacagggcaatgccactcacaaggttcacggacaaggttgctgccccacagcgtttgggagtcacccatgcttgtctctggggtcaccctttccacagtga

SEQ ID NO: 619692 - DNA, 163 bp, Homo sapiens
gtataggggacaggactatctttctttgagtgacgtctgtgccggccctgtagtccgcagaggggtctgagctgcactggccccagtgctggcatctggtgagcggacccaatacccctcacattccacaggcccatggggtcgcttttgtgacagagtccta

SEQ ID NO: 619693 - DNA, 146 bp, Homo sapiens
tagaggatacccgatgaagcatacatagattaccgcacgtgcacatggcggtacgagataacgtggaatggaggtgtggaatgtactgaaggagaggttgcgcaatgtagccggcaagcggaagcgaaccagcgagcgagttaagg

SEQ ID NO: 619694 - DNA, 967 bp, Homo sapiens
  misc_feature (469)..(469): n is a, c, g, or t
atccctgagaatccaaaattccccgtgccacctatcacaccccatcctaaaaaaaaaaaaaaaaaaaaaaaaaaaaaaaaaaaaaaaaaaaaaaaaaaaaaaaaaaaaaaaaaaaaagcgtgtggggggcgcgcgcgcgcggcgcccccgagaaaaacttttaaaacacccccgcgggggggcgcgcggggcgccccagagggcaaaggaaaagaggggccaaagggggtgtccccagaggagaaccacgcgcggggacacaaaacaaagggcggcggggtgtttctccacacacaaataaaaaaacagcgcgcgcggggggaacacacagaagggtgttgcggaagaacaacaacaccacaagagggaatcttcgagaggggtacaaatatacgaggggcggcatacataatacacaagagaggagagccacacagagagagacagcgccacacagatattataacanatatatagaccccccgggtagtcggggggggggacacacaaaaaaaaaaaaaaaaaaaagaaaaaaacataaaacaaagaaaaaaaacagaaaaccaccaccacacgagcaacaggacaaaacaaccaccgaaccaacgcaaacagacacgacaccagcacatgcacccgaatgacgcagacgatgactacacacaaaatcacaacagacaccaacccagcaccacaacacgaaagcccacagacagcagtgcctgaaatcagaccgccaaacacgaaaagcaagatagacaaacgaggaaacagaggaacacgaagcaccacggaagagacagaacaacgaacccaaacggcacaagacaggagaccggcagacaaacctgacaacacaacataacaaccaaacaactagcacacaacaaaagcacagcagacagcgaaccccaaagacacgcaccatacaaacaacaggacagccaaagaaaaccatagacggcaa

SEQ ID NO: 619695 - DNA, 317 bp, Homo sapiens
agtacattgccatcttcaggacgacttgacgggtttgggattgtgtacaaacttttataataaggatcctaaaactgtcgcctttaaatatcacagcagcctacctgtaggctaattctgggcagcgggctggcccctggtgtgagcattagaccaaccacagtgcctgattggtatagcctaatatgctttcctacagaatggaattggaggccgggcgcagtggctcacgcctgtaatcccagcacatgttgatgccaatgctggtggatcacctgatgtcaagatctcgataccatcctgtccaacgtggtgaa

SEQ ID NO: 619696 - DNA, 931 bp, Homo sapiens
gcgaacacctcatcacaggctcctttgttacggggatgaacggtagagttcctatctaagacaagcgctccacttctcactagatctcaaggactcaaggacatgctcagcaattctctcccttttccccacatcacttgcctctcaccaggaccatcccatgagcacagacatgctatcatttccctaatcttaaaatccctcagccgggcgcggtggctcacgcctgtaatcccaacacttggggaggccgagacaggttgatcacttgaagctggaagtttgagacaagcctggacgaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtgggggtgggacgacagtgaaatctagagtaaaaccaagctggcccaaggtgtcctgcaggctgtaaatgcagtttaatcagagtgccattttttttttagataaacttctttcaattcttggagttcacaattttttgaactcaaactttaagttctaaaacccaaataa

SEQ ID NO: 619697 - DNA, 346 bp, Homo sapiens
gagacgtgtagcatgcaacatagctttgtagggaagggattgcatctcctgaaaaatgcagacagtcccgtgctggtcactgtggctcacgcttgtaatcccagcattttaggaggccgaggtgagtggatcacctgaggtcaggagtttgagaccagcctggcccaacatggtgaaaccccgtctctaccgaaaatacaaaattatccgggcgtggtggtgcatgcctgtaatcccagctactctgaaggctgatgcaggagaatcatttagaacccgggaagcggaggttacagttagccgagattgcatcactgtactccagccattgcaacacggtctctca

SEQ ID NO: 619698 - DNA, 1006 bp, Homo sapiens
  misc_feature (628)..(628): n is a, c, g, or t
gcgaacacctcatcacaggctcctttgttacggggatgaacggtagagttcctatctaagacaagcgctccacttctcactagatctcaaggactcaaggacatgctcagcaattctctcccttttccccacatcacttgcctctcaccaggaccatcccatgagcacagacatgctatcatttccctaatcttaaaatccctcagccgggcgcggtggctcacgcctgtaatcccaacacttggggaggccgagacaggttgatcacttgaagctggaagtttgagacaagcctggacgaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaagtgacngtgctgcccttttcacatcaaagaactactgacaacgaaggccgcgcctgcctttcccatctgtctatctatctggctggcagggaaggaaagaacttgcatgttggtgaaggaagaagtggggtggaagaagtgggggtgggacgacagtgaaatctagagtaaaaccaagctggcccaaggtgtcctgcaggctgtaaatgcagtttaatcagagtgccattttttttgagggttcaaactggatgtcaattatgggaatgcacaatttgttgaatatgcagattaacccggttgaaaaaggccgtaaaaaaaaatgactaaataaaagtatatgttcggggcgattggggccctgagaaaaagttttgaaaccct

SEQ ID NO: 619699 - DNA, 322 bp, Homo sapiens
tgtgtgtgggtgcttcgctagaaaaatgtgtgtgttgtggtggcgttgccgtttgagaactcggtttatttagtacggtggttttatgtgtattagatgttgtggatgttcctctggcacattgcagggatttattagtcagtttcgcgagtagtagtgtaatgaattagttactgagtggtgaatctcagtattgattatattatatgttggcgtgttagagtgtactgatctttttgcgctaattgttttctatcttgtttgcttctctctgactggtgtttattttttgtagcgcgcggagatatgttatgttttatgt

SEQ ID NO: 619700 - DNA, 991 bp, Homo sapiens
gcgaacacctcatcacaggctcctttgttacggggatgaacggtagagttcctatctaagacaagcgctccacttctcactagatctcaaggactcaaggacatgctcagcaattctctcccttttccccacatcacttgcctctcaccaggaccatcccatgagcacagacatgctatcatttccctaatcttaaaatccctcagccgggcgcggtggctcacgcctgtaatcccaacacttggggaggccgagacaggttgatcacttgaagctggaagtttgagacaagcctggacgaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctaggccctttcacatcaaagaactactgacaacgaaggccgcgcctgcctttcccatctgtctatctatctggctggcagggaaggaaagaacttgcatgttggtgaaggaagaagtggggtggaagaagtgggggtgggacgacagtgaaatctagagtaaaaccaagctggcccaaggtgtcctgcaggctgtaaatgcagtttaatcagagtgccattttttttatgtcacatgctttacatcttggaagccccccttattaatatgccacctatcagttcaaccttccactacattgcacattcaatcctagccactcccactacatgataataactccactttcatctgtgaccc

SEQ ID NO: 619701 - DNA, 146 bp, Homo sapiens
gtgctctatggtcgttaccggaatgcgagggttgtctagcatgttcagtatgagtggtgatggggaatgtccttgatcgatcctgatcactgactcgtggtcaacctttttcttttttatattttttttcataggtgttctaaggg

SEQ ID NO: 619702 - DNA, 361 bp, Homo sapiens
tgatctcagaggatccctgcgggttcatatttaggtttaagctctaagactcctgacccaacaatttatataactggctttccgtaggctgcggcttgaactaggtcagagaagccgaggagttcagatctatatagcacagaactacgtctcattctaaaacattgtcactactgttcgagtcgaccccattacgctgtttcaaattgtgtctcttttactgtgttctataattatattttgttcagagctaatctcaaatcttgctctgccttggttggctgtgctgttctcagtccgacatttacggactccagctttctccctcttgagtaccttggtcctaaatgtcctcccgcat

SEQ ID NO: 619703 - DNA, 574 bp, Homo sapiens
  misc_feature (574)..(574): n is a, c, g, or t
tataagtacaaattttgtgcctgggcatagtggctcgtgacctgtgatcccagcactttggtgggccggggctggaaggatcgctttgagcccagtgatgtttccagtggccagccctggggcaaacaatgtgcaactgaccccccgtgtctaacaaacacaggtttaccacacgttgggccacggttgtacgtgtgtaatgcgcctagtgtatcccatgctgctcgtggagacctgggtgcagaaatgaatcaactacaaatgcctcatggaagtgttttgcatgccaaaacggtggcacctggtagtataccctaggccaactttggcacaattccccaaaactcttgggtgccaaaacgagcatggcaaatgaaacccattgtgctccattcaagaaaagacgaacaagatcaacagagcggacaattcagcagcccacatttggtgagtcaaccctctgggggagcctctattgcggcacagcgcagtggcttctcaaccggagacacactgactatatagtccagttctcaccatatctatctactaataaaatgctggactcgaaccn

SEQ ID NO: 619704 - DNA, 945 bp, Homo sapiens
  misc_feature (623)..(623): n is a, c, g, or t
gcgaacacctcatcacaggctcctttgttacggggatgaacggtagagttcctatctaagacaagcgctccacttctcactagatctcaaggactcaaggacatgctcagcaattctctcccttttccccacatcacttgcctctcaccaggaccatcccatgagcacagacatgctatcatttccctaatcttaaaatccctcagccgggcgcggtggctcacgcctgtaatcccaacacttggggaggccgagacaggttgatcacttgaagctggaagtttgagacaagcctggacgaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttcccnccccccccccccccccccccctttttttctccacatcaaagaactactgacaacgaaggccgcgcctgcctttcccatctgtctatctatctggctggcagggaaggaaagaacttgcatgttggtgaaggaagaagtggggtggaagaagtgggggtgggacgacagtgaaatctagagtaaaaccaagctggcccaaggtgtcctgcaggctgtaaatgcagtttaatcagagtgccattttttttttagataaacttctttcaattcttggagttcacaattttttgaactcaaactttaagttctaaaacccaaataa

SEQ ID NO: 619705 - DNA, 508 bp, Homo sapiens
agcgggcgttgagccgccgccgccgccgccgcctcctcagcttcagcctccgcgccaggcccggtcccgccgcgccactgtcggactaccgtaaaagatgacaacagcacatggggagcatggcagatccgaaaccagacacgacaagagacaggtgacggagagccgaccacacgtaccaaaaaggatgatttcacccaacggcataccagaacggaagaacagcacacacagacgagagacacaaggcgcggcccaacgacaaggggcaaccaccgacacatcgacaccaagaagctacaccagcaacaagaaaagcacacaaagacgtgacacagaacgacagggagagacatacctgagcaacagatcagagacacgagatcacggaaacagacaatgagcggacaaaacatacagtcataccaccccacagaacgacagaacaacgaaaccaacaccccacgagcaccacgcgcacaaaaagagtcgagaagactgacgaagg

SEQ ID NO: 619706 - DNA, 418 bp, Homo sapiens
gcacgagagccgggcataagactccggaacttttgccgcgtgcgaggcaccccccgccccccgcatatgttgtgctttcgcgcggaggagaggcgggaacccgagggcgcagaccgcatatgaggaggaatcggcggagtccgcggacaaaggcctggagccctgaggtgttggctggccccgcccgggtttccccacccactgtgcttctttccttccgtgcgccggtgctggcaggcaggtctattagagaaacttttcctgtgtgccttggagggcagagcatttaaggacacaacttggaagagaagaaggcggggcccgagccaaggctgggaatgtgtgcactttgtggggagagaaagtgggttgcttgggggacacgaaacttgcagcagggagctatggctttggtttt

SEQ ID NO: 619707 - DNA, 377 bp, Homo sapiens
tcagagacgtgtcgaatgttctggtgatgagagtatactatagcatattatctccagttctgatttcttcctcttcatcctcagtgacatccataactttgatggctgccaacgtgacccgttttaacatgtcgagcctaatagacttgtccataggttagttcctagtgtccaaagagctgtgcctcttgggactaacagttaaatttacaaggggatttagagggtactgtgcgcgaatttaacgttgaactaagattctatcgttggacaaccagctatcaccaggctcggcaggttagtcgcctctacctataaatcttcccactattttgctacataaacgggagtgctcttttagctgtgcttaggtagct

SEQ ID NO: 619708 - DNA, 167 bp, Homo sapiens
attcccgtttttgaaaaaaaaaaaaattttttttttctctagggaaagggacagggtttatattttggagccctcccgaaggggtaaaattgtaaaaatttttatctatgaggaaatgttaaggaggtgttttaaaaaacttaataaaaaaattcttttcctgtgga

SEQ ID NO: 619709 - DNA, 360 bp, Homo sapiens
  misc_feature (124)..(124): n is a, c, g, or t
  misc_feature (303)..(303): n is a, c, g, or t
gggaggtcgctggaaggacgcgcggcggggcccccggcccagggtatttcggtggaaagaagggaaaaagggcacgagcgggggacacgggctaaagtagaactcggaggccgggaagatcggntcctaaaccggggcctcgaagttcctaccggcggacgaaactttgctcttcggcgggccggtcccggcgtcggcacccggggaaaagcaaacaacaacttgcttgcgcggggctggagagcctgaagcccggccggaacggccgggaaatgctccggggctccccgcggggtcggggcngactcaagacaagggaccggaaaagaaccacgcaagaaagaaagccctatttcttgg

SEQ ID NO: 619710 - DNA, 273 bp, Homo sapiens
gttcttctgctcgttgtggccgccgatgttgtaggtctcgccgaccgcgccttcggtcaccaccttgaacagggcccgggcgtgatcctcgacatacagccagtcgcgcacctgcaggccgttgccgtacaccggcagcggcttgcctgccagggcgttgaggattaccagcggaatcagcttttcggggaagtggaacgggccgtagttgttggagcagttggtgatcagcaccggcagcccataggtacgctgccaggcgcggaccaggtg

SEQ ID NO: 619711 - DNA, 231 bp, Homo sapiens
tggaaatggagtttggctctgtgtggcccaggtgggagtgcaagggcaagatctcagctcaccacaccctcggccttctttttttcttcgtgtttaaaaactggtggtaaaatctagaataacaaaaagttggccatttaaaccatttttaagtggacagtgcaggggcataagtgacttccccatgtgttgtgtacccaccattataatccattcccagagggtgtccat

SEQ ID NO: 619712 - DNA, 460 bp, Homo sapiens
gccagggatactacccagctattcactccccttttcacagcccctcctgtccgaaacaaggaatgtttgccccctttcccttcccctgtttttgccacacaaccctttcggggggcttgtctatctatccagggtacatgtccccccatgcaggctacccagctggtggcctcctacggtcccaggtgcctccatttgactctcatgaggttgccgaggttgggttcagctcccatgatgatgaggataaagccgatgatgtgatagaggtccctgggaaatagctagggagcccctccccccctcccttggggcccccagcaggttgccccccaagctggaaggcagtgatttagccctttttagaataggccccttggcaggagggaaaaggaagaggccaaaggagggtggttggccaaagtggcaaagctctgttgctgtttacccaaagaggcca

SEQ ID NO: 619713 - DNA, 195 bp, Homo sapiens
gaatgtgctgcaatgcagaggaatggaatgggatggagtggaatgaaatggcatggaaaggaatggcaggacatggcgtggaccggcatggagtggcatggattgcagtgcagaggaatggaatgggatggagtggaatgacatggactggaacggactggccggccctggagtggcatggcctggcgtgcactg

SEQ ID NO: 619714 - DNA, 105 bp, Homo sapiens
cgtctactcaggagagaacattttttgtcctcaagaaaatacggaagaagccctgtggttattgctgattagtgaactcaatggccaaccgggacgctgtgctgg

SEQ ID NO: 619715 - DNA, 395 bp, Homo sapiens
taaggataagaagcaagtgaggttgggcacggtggctcacccctgtaatcccagcattttgggaggccgaggtgggtagatcacgaggtcaggagttcaagatcaacctggacaagcttgaacccgggaggcagagattgcagtgagccgagatcatgccactacactccagcctgggcgacagagtaagactccgtctcgggggcggggcaagcaaatgaaacaagatggacaaaaaaaaaaaaaccgggattggatcaagataagggggcccaaatgggatccatttggccagggttcccccgggccctcaacagtcacttaagagactccaggattgccccacacagacctgtttaaccaatataccacacagattggactggtttaatacc

SEQ ID NO: 619716 - DNA, 749 bp, Homo sapiens
gtggacgagatcctcgcggaaggtcgccgacacacgcctcgtgatcatcatgctggtcaacaatgagacgtggcattgtcatgcctgtccctgaaatcagtcagctgcattaaagccctgtaaccaggaacgggtggcacgctgggctacctcccatcctcgtgcacacggatgctgtcacaggccttggggaagctagcgcgtggatgtggaggacctggtgcgtggacttccttacagatcggtggggcacaagtttatatggtcccagggattggcggcactttatatacgagggacgttggtgaagtttaacccgtctctaccctatgctatttggaggtggacaaggaacggaatttcaggccagggacagagaacaaccccaatgatatgctggccttgggaaggccgcggagctggtgacccagaactgcgaggcttatgaggcccacatgacgggacgtccgcgagtacctggagagagaggtctgtggagctggattcggtcagaagagaatccatctgaatgagccgagtttccaggcagccatgcggttcccgatacctgtcaagttgtgcatccggggaccccgggttcaaggccaccggtggttgcttgcggcagtggcgagtgctgatggcacgtgtggtggccgcgtgccactctggacccctgggggccacagcaggtgcagctcggttctcgcctcccccaggtctgtccccagtgcttgctgagtacgggc

SEQ ID NO: 619717 - DNA, 632 bp, Homo sapiens
caagcagtcctccaaatgggctcatccagtttagaagaaattgccccagacgccggacatttcttactatggcctgagtttctccttgtccttaatatggtccagcactgaagtctatcaggacacaaacacacaagatctccttgcatggaaggagagctcgcaaaacagtctgttggtgaaaatcagtgcgccccgcctctgcattttcctgctcctctctttccctcccttgctgtgatgattcctctcccctcctccatccccactccccccgcggctctccttcttggatttccatttcaaatcccttccaatttcatatcagctgccccgcagtgtttgccggtccctcggaaattaatttagcgactttcacacggacatatcatttctaacttcaaagtcccggacgcgggggttgagcctctgtccaagggcacagacacggagactgcagtcagagccctgcccctccaggcgtttgcttgcaaaccacattagtcactgacaccccgacctgcctcccaagcagaggttttagcgctgtcctttgaaaattccccaagtcactgtagatatcaggatctgtcagtatgaatgataagctagagagaaaaacaaaacaaaac

SEQ ID NO: 619718 - DNA, 121 bp, Homo sapiens
ctagaggatccctctctatcagtcggcacctcgcgtattcatagtgcaccatcaccctccttaacctctacttctaccttacgccatattttacacacaaccccgagtgccgatgaactag

SEQ ID NO: 619719 - DNA, 182 bp, Homo sapiens
caaagtgtcttcaaaacatagtagtaaaaaaccagtatcacaaaactgagttacaagaatacttatatgtaatatacagtgcatcccttacctagagaagtctcattaacaacactcacattattactagagggtgcattattgcaatagctgcaccagggcacagggaagggcaacaatca

SEQ ID NO: 619720 - DNA, 298 bp, Homo sapiens
attcgcggccgcgtcgacttttttttttgagacggactctcgctctttcgccaggctggagtgcagtggcacaatctcggctcactgcaacctccacctcctgggttcaagtgattctcctgcctcagcctccccagtagctaggactacaggtgcttgccaccacgcacagataatttttgtatttttagtagagacggggtttctccatgttggccaggatggtctcgatctcttgacctcatgatctgcccgtcgacgcggccgctaatttagtaataagtagtcgatccgggaa

SEQ ID NO: 619721 - DNA, 207 bp, Homo sapiens
ggggaaaaaaaattttggggggggggaaatttttcccgggttttttgggccccaaatttggggttttttttttaaaggggccccttttccctttgggaagggttaccccccccccccctggcccccggggggggggggggggggttttttttttttttgggggttttttttttttttaggccttttttaaaatttttggggccccca

SEQ ID NO: 619722 - DNA, 160 bp, Homo sapiens
caccctgaagtgccaaatacttagctttaatcctttcattcattggatttattttgaggttggataacgggtaataattttttttttatctttggtaacactgttgaaaactttccagttgatttgaacgtgtgcagttataaactaacgttctatatgc

SEQ ID NO: 619723 - DNA, 197 bp, Homo sapiens
tctcgagagtgtgcatggagaagggggctttttttaaacttgaaatgaaaccagcccatggctgtgtgtgtttaggaggaggggagcctgtaaaggcctatttaccttgaatcccctctggcttacagctgctgagagcattaggagagcagacatacttctagaattgggcagtgggatgatggtgattgcgttgc

SEQ ID NO: 619724 - DNA, 254 bp, Homo sapiens
tcttaccttcctccaaaaccattaatatacggtgaagaacgaccacctgagtaagagtctaccaaggagctcatacgtcgacagcccacgtcctgttaaaaaataatataaaaatttacagtaaaaaattccgtcgtataaaatttaaactgcaggaaacctatagctctatttcccatattaaattttctacaagagttttcggcactacctcaagatgtaagtctttattgtaatcacgcctagagatagca

SEQ ID NO: 619725 - DNA, 680 bp, Homo sapiens
atcttgaagacacaacctggccaacatagtgaagccccatctctacaaaaaaacaaaaattagctgggcatggtagtggatgcctatagtcccagctactcgggaggctgaggcatgagaatcacttgaacctggaaggcagaggttgcactgagccaagatcgtaccagtgcactccaccctcggcaacacagtgagaccctgtctcaaaaaaaaaaaaaaaaaaggtttttttaccacaataaaaatttttttcttcgaaaattggaacaacactcgtggtgaacatggaacaggatctggtggggacattttcaacaaggggactaccaaggtcttggtcaaaggtcccgggaatcaccgagagacgacgtaattccagggaacaaattctcttggaacaaattggctctggagacaatttcccaacattttgccacaagagcaacacaattctcaccgcgtccgagagaagagtcatcaagcaagaccactctaagagcggcggggttaaaagcccgaaaagagaaaaatcccgacatatccgagaattttgttccacccatattaaaaccgggcttatcaagcaccaagagcaccaaagactacgaacaaacaaactacaaagagtacgaccacaccacactctgggcgagacgcacaccggaggggactcgtga

SEQ ID NO: 619726 - DNA, 107 bp, Homo sapiens
tccccaggctctgagaggggtgtggtgactccatttatattcttttctgcgctcttgtttttccaagggacactcagatgtctcattacgtttgttatagatgaatc

SEQ ID NO: 619727 - DNA, 150 bp, Homo sapiens
taaatgtaacacttaatataaacgaaggaatatagttattggctgggcatggtggctcacatctgtaatcccagacttttggacagtcaaggacaagggatcacttgaggccagtagttttgagaccagcccgggcaacacaacaagaca

SEQ ID NO: 619728 - DNA, 326 bp, Homo sapiens
  misc_feature (12)..(12): n is a, c, g, or t
  misc_feature (16)..(16): n is a, c, g, or t
  misc_feature (21)..(21): n is a, c, g, or t
  misc_feature (163)..(163): n is a, c, g, or t
  misc_feature (179)..(179): n is a, c, g, or t
tagaaacaccgnttgntgtancaagaggtgctacgtggaatagggatattgtgaccaggtccgagcggctcgcccgtggtggagctgagcaagtgcgctggtcagcgcggcagtgcaacggctctaacccgcccaccgccttttataaacctctaatttattntgtgaactttattatntgtttccgccaagggaaaaggtttattttgtaattattgtgatttcccgtggcccagcctggccagctcccccgggaggggcccgcttgcctcggctcctgctgcaccaacccagccgctgcccggcgccctctgtcctgacttcag

SEQ ID NO: 619729 - DNA, 349 bp, Homo sapiens
gtcaccattgtcactatataccagtctgctgaattgataagctttgttaggatagaagacaagagaggcctgggggtcttggtaatgtcgaatggttagagatgttgaggagcacccgaatatcttagaatagagctgaccccgctctcccccggcccgatcccgtttaagatgcattgataagcctctaatgaaactccaagtttacctctagacaggtttaatatttgatctcatcttctgaaagatcttactatcagtcttatacacagcgaggcggactaattaagaggcaagggtgataggaaactggacacacatccttctgcagacaggtgcagcgtaaaat

SEQ ID NO: 619730 - DNA, 899 bp, Homo sapiens
ctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaaccggcaatctaccatcacctctaatcacggcccgacttagtctcacatcgtcttctatatgaaacccccttcccataccaacccctggtctaaactcaaactaggctcctatttattctaggcactctagagctagacgtttactcaatcctctgatcagggtgagcgatctaactcaaatacgccctgatcggggcactgcgagacagtatgccaaaaaatctcatatgaaagtcacccctagacatcattctatattcaattactaattaggtggtccctttaaactctctcacccttattacaaacaaagaaaactctggattaatcctgcatcatgagccttggcatatatgatttatctccacactagcagagacaacgaaaccccttcgaacttgcgaaagggagtcgaactagtctcaggcttcacatcgaatagcgagggccctttgcctattttatagcgataccaacattttttaataaaacctcaccaataaatttcctaggagaacatatgagcaatctccccgaagtctcaccacatattttgtgccagacctatttaactcccggctttgatttggacagaacccggtcggtggacaattaaatccttgaagtttccatccccgtgtttgttgttttccaaaatcggtccccacaaaaaagggggaaccaggagaggccttgaggccaggaaaggcgccgaagtggctggcacaatgcgtgcc

SEQ ID NO: 619731 - DNA, 1008 bp, Homo sapiens
  misc_feature (610)..(610): n is a, c, g, or t
tttatgtcggcgtagattcgtttcccatcccggctgggcccacttttccgtgctggaagataggcgtgcttgtcccgcccgtgtgggggcgcccccccagggtgtctcgagggtcttttcctccgccgcgtgcctatatgtgttgacgccgccgcgcggttcatgtggtcggtgcaccagtaagactatctttttggcggatattttcccatgctctatgtggggccaccccaccagttgttgtctgcgtagtgccccccgccgcgcgaggttgagatagaaccaatctcgggggggggaaaacacaacgccccggcgttgtcctccctggttgtatggggactgcctctcccgacaaacgctcttttagagagaggcggtttgtttgaaccacagaaacgacaaaaaaaaggaattgggggcgcccttggcccctcttgagtatggccgggaggcgcacgagaagggggacccacccaacgggacgatttataaggggagaggtcgacctctcactgccggcagtaccaaaaccaaccaggaacgtgcgccgctcgaagagggtgcaccccccgcaagacacacccccggcagtttttaccaaatgcgnggccctgcgagggacacaccacggaagttgcactacatctgtggtccccactctcaagaaggcacactcccctgtggataaccaccccggccaggagatgggggtgtcttatccgcgattccttgtgagcacacagagtcccgaatgttgaaggttcgcggcgcacacacacctcggtcacgggcccacgcgccatggaggggaggaaaactccaggagaatcctgtgcgtggctcatttatgaaactgaggtccaggtttcttcaacgtgcgggggggacaaaaaaaaaagcaggttattgaggggagtgcactacaaaatgtagaacaataacaatcatgctggagtctgggttacatggaaaaaaaaaaacaaaacccagaggcgaacaaaaaca

SEQ ID NO: 619732 - DNA, 266 bp, Homo sapiens
cggttattgtggtgtaccgtcaagtctcttctccaagtcatgattttcttttctgaggagatgttcatttgtgctggatatagattccagttataagtgatctcatatggtattgtcttgtctttctggctcatttcccgcaggatgagattctctagttccatccatgttgctacaaatggcattatgtcattcttttttatggccctttcttctgttgcaacatgagtatctagacaaagttctcaatgctattcagcaggatc

SEQ ID NO: 619733 - DNA, 240 bp, Homo sapiens
gctgaggcaggtggatcactgaggtcaggagtttgagaccagcctgccaacatagccaaatcccctctctactaaaagtacaaaagttagcttggcgtggtggcgcactcctgtaatcccagctactcaggaggctgaggcaggagagtttctttacccccaggtggagagttcagtgagccagagttcaccactccactctgccttgggaacgagagtaaactctgtccttaaaaaaaa

SEQ ID NO: 619734 - DNA, 375 bp, Homo sapiens
tcaatagaatggagtaattagctgatcatgccaatcataaatgaagcactaaggtgtgttcccacccactctgcatctaagaatcacatgggtatctgagcagaatcttactggtcaaagcatctctaacagcacatgggtatctgagagcatcttactggtcacagcatctctaacagcacatgggtatctgagagcatcttactggtcacagcgttgggagcctgtggcttcctctgcatggaagtctgtgcatcatgtgtgtagagcctatggaagtcagaaaagggtgtcagattctctggaaatggagttatagttgtttacgagcctccggatgggtgctgggaactgaactctggtcttcgtcgacgc

SEQ ID NO: 619735 - DNA, 272 bp, Homo sapiens
  misc_feature (4)..(4): n is a, c, g, or t
  misc_feature (181)..(181): n is a, c, g, or t
ggangttgcccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgancggcaacggcaacccctttgggtcccctccctttgtatgggagctctgttttcatgctatttcactctattaaatcttgcaactgcaaaaa

SEQ ID NO: 619736 - DNA, 258 bp, Homo sapiens
  misc_feature (258)..(258): n is a, c, g, or t
gctagaaccacaccgccttcgttgcctgtgctttgtcagttttggatcctattggaacgatcgcttgatactatcgtcgcacacgcagcagagtcagtacgaggacgaaaggcatccacccctctcccggggcattcatacaggcgcaggttcgctgaacggcagtagccaccaataatgagagtcctcaaggcacccaggttccttagtcggtgtattgtggaagtgacgatacatttcccagaacagatcatgatn

SEQ ID NO: 619737 - DNA, 102 bp, Homo sapiens
acgagtaagaagatttattttgaaaattagaccctatgtacaacagcctcaaatcaagattagctggcgctggagtctcatatctttagctttgtccgctgg

SEQ ID NO: 619738 - DNA, 199 bp, Homo sapiens
gtaacctggtgttgggggtagaggattttctcgtgctaggtagtaatgtgtccctaagctccagatggactcctggctcgagctgtggtcagaacagagctctgggtggcctccatgacttccttggctccatcaatagatcccttccttttgagatgttctccctcgaaatttttcccggacttctattccgcgactc

SEQ ID NO: 619739 - DNA, 195 bp, Homo sapiens
tagcagtattcggattcagggccggcagttttatgctctgggtaaaggtgtatcatagtagagatgtagtggatcatgttgacaatacgcgtggatctcgaattcctgaactcaggtgatccaccgaccttggtctcccaaagtgctgggtttacaggcgtgagccagcacacccagcaatttgtttattttttt

SEQ ID NO: 619740 - DNA, 565 bp, Homo sapiens
gaatccaatccaaggttcccaaatcggcccgcacatccgtccctttaagggtagcgctggggatggtttcgagtattcttttgcgataagtctgggagtatagtgagaaaggctttaacgccctgcagagagaaaaactttccctcgagcgagcggggctcctacagagtgccgcaagcggagtgttggctcatgtccgaactcttgcgactccgcgctagggttgcgatactagtaggggtagccggcttagtgtagggggttgagtgggatatgctattattgctacttctgcgtctaggtatttgatgaatgttgattcttatgtttcgatgtcgcttggataccgagaaaagtcctccctgttaagggaggctaggtgtgaaaggataccgaggatcctttaaagcccctcgcgggcctggtagctcctttagactgatctttgtttgtggctggtagttctactggttaagaccattgacggagaaaggaggacctccgcttaaggatgcccctttgaattttgagctttcacccaggttaggtatattttcgactctcc

SEQ ID NO: 619741 - DNA, 151 bp, Homo sapiens
ggcaggaggcacgcgcgcggctgaggcgaggtcgctcggcgcatctgttgcggggccatggcggggaccgcgctcaaagaggctgatggccggagtacaaaacaattaacactggaatcctccggaagggatttgtagcaggccccatgaa

SEQ ID NO: 619742 - DNA, 415 bp, Homo sapiens
atcagatccaggtgaagtcaaatacttacatgtgaaaggtaatacagtaaatgattgaaaataaaatatgggagaatataagcttggatagaggaagattttaataaataggactcaatattattcattaatgttaatatcgacacatttagatacattaaaacctgtcttcattaaatgatttcataacgaaaatagaaaggttctcacggcatggaagaagaaatatgaaatgaaaataatcatcaaaaggtttgtataaagaccctatgcaaggttcctacaaagtattaagagaaaaagaaagtcaatagaaaagtggtttgtagattagttgcagtagtggccctggccattcatttcctcctttatccatactttttgtgactttgcagtaactctcatcaaaaggtag

SEQ ID NO: 619743 - DNA, 175 bp, Homo sapiens
agaaaaggttagctgccatgtggaatctgaaatcatatcaatgaactttcatgtcctgatgcattacgacacattgacctgtcttgcaccctgaatggaacttttacccagatgtgattcttaacatctgcattgttgtttggaaaataacagttcactggatgataaaaaaaaa

SEQ ID NO: 619744 - DNA, 189 bp, Homo sapiens
tggtatgtgcagtgcagctttatctgtggctgaaggtcggagccctggtgtaggtccaagagtccaaaagctgaagacttggagtctgatgttcgagggcaggtagcatccagtaatggagaaagatggaggccagaagacttagccagtctagcccttccatgttcctctgctcgctttgatcctatc

SEQ ID NO: 619745 - DNA, 505 bp, Homo sapiens
gtgtggcaggcagaataatggtccactgaagatgtccatgtcttaatccctggaacctgtgaatatgtcaccttagttggctagagggactttgcagttgtgatgaagcttaagcattttgagatgaggtgattatgctgagtaatcctgtgggcccagtgtaaacatgagttcttaagagctacagtcagagccgggtgtggtggctgacgcctgtaatcccaacactttgcgaggccaaggcgggttgattgcttgagcctgggagtttgagaccagcctggtcaacatggcaaaaccccatctctaccaaaaaaaaaaaaaaaaaaattcaaaagttaactaggcatggccagacctagtggtgcctataatcccagctacttgggaggctgaagtgggaggatcacctgagcctgggaggcagaggtgcagaggttccaatgagctgagattacaccactgcactccagcctgagttgtaacagagtgagaccctgtctca

SEQ ID NO: 619746 - DNA, 430 bp, Homo sapiens
acataggctgctaggctgcatgcttgcacggagaccttgccctctgagccaggctggccgtctggaggacagattcccagccactacgctgctggcttcaggctggcacatttacaatgcaaatctcttcaagtgatccccctgcctctgcctcccaaagtaccggggctataggcatgaaccattgcacctggccaattttattcttttttaaggccgagtagtgttccattatgtatatgtaccacattttcttcaacgtccattgttggatagttggtggattccatatcttggctattgtgaatcgtgctacagtgagcatgggtgtgcatggcaggattgctggagcccaggaggtcaacgctgcagtgagccgtgatcataccactgcactccagcctgggtcgacagtgagaccctgtctcag

SEQ ID NO: 619747 - DNA, 204 bp, Homo sapiens
aggctttatcaacctcagctcagagtcacttcctccaggaagccttccccagctcccttacaatatgtcctctgcttcttctctgtgttctacatgacgaccccattggagtcatgtttcattcaagtttatacactccaatgttttacacacagtagatgctcaagaaaggtttcttgttgaataaagaaacagtatggctta

SEQ ID NO: 619748 - DNA, 325 bp, Homo sapiens
actgcaagctgcaagctgccccttgggtgaatggggactgagtgggaatgtctgggtggttaaccccttttgacatgcagtggccctacagggaaccctcaacaaaattagttttaaaagactcattcaagaaatgcatatagagctgttcacttggcatttttagccctctcagaggtgatagacctctgaagagagaaactgagacacataagagcgtggaaatgactcattggtaaaacactgcagtctcacccaaaatcagcacacattgatctgcaacacaaaaaaaccctaggccacagctccattcctccttttaaga

SEQ ID NO: 619749 - DNA, 641 bp, Homo sapiens
aggcgggaggttgagcgcgtccgcgggctgggaggccgctggtacccgggggcatggctctcccccggagcaggttatcgttccttggcctggactcttggaggtcttcggtaagaactggcgttcctcttgtctaagcggccgagctttcggcgcgttcgccctgacgcccaggcccggggaggccgtcactcagaaactgctccagtccgagtccgccgcctcggagatgccgagagcctggtcctgccctctgcccccggccccttcctagactcgctacttcaggtcactaaaggcgccctcccaccagtttgacttctgttctgcgctctgcgccccgcgtctgtgcctctccgtaatgccggttccctggccatgtctttagagtttcgctccccgtcaaaccctcggggcagcgcggctgtcggtgtcgagccttggcacctccactgtgccaggtggaggcgcctggagtcccacgtgacgtaccgggcgagcagcacgctatgagaccgcgtcgatgggcggccgaccgacgtcatggcgatggcttgcggaacactccacctgacagggaagtccatggcgaaggacacagcggggcatctgtcagggttgacaagaggacggcacgactg

SEQ ID NO: 619750 - DNA, 392 bp, Homo sapiens
gggaatcgagtggcatgtgatctcattgttcaattcccacctatgagtgagaatatgcggtgttggtttttgttcttgcgatagtttccagagaatgatgatttccaatttcatccatgtccctacaaaggacatgaactcatcattttttatggctgcatagtattccatggtgtatatgtgccacattttcttaatccagtctatcattgttggacatttgggttggttcaagttacaagaaaaaaacaaacaaccccatcaaaaagtgggcaaaggacatgaacagacacttctcaaaagaagacatttatgcagccaaaaaacacatgaaaaaatgctcatcatcacatggccactcaataccggtattgagtggccatgtgagactc

SEQ ID NO: 619751 - DNA, 133 bp, Homo sapiens
gagtctcacgatccctatcaccctaaatttattatggcagcctgagtgggctgctctcgtattcaaacatgctttgtctcaggcgtttgacgtatgtatgcatttggttagctggcgattttgtataaggtgt

SEQ ID NO: 619752 - DNA, 209 bp, Homo sapiens
ccgatactatggcctctacgtgatagtgtaccacacgcgcgtggccgagacacactcacatgcgatgacggctcgctctgataccgaacaggttaggcaatctgtgcctgagacaaccgcacctctgtcgtagtgtttcacccagtccagctgttgattgccaggctgccacggatggtcgccacctatctggcctatgcgcagcgtgc

SEQ ID NO: 619753 - DNA, 823 bp, Homo sapiens
gatacaaatggttggccggacattggagggcccatagggaatcctcttgtgtaggtggcctgcgttctatgttggtgggaagtgggtactggggtgacgtccctgcattctgcctgtgccttttccctggcggctctcttttcgtgatacgtcttgtcgagcggagatgggcccgaggcaaggggccataccctaggacgcggctgctgtagttgccacgtctatgcggagagcagtccggagctgggtgctggggaaacggcggggccggcttagcctccgcgcgcgcactctggtgtgttcgggccctggtaggagggctcgcaggcgttagctaggcatttgtcgtcacgttttgcctgtttgcactatttctttttgtaagcatttggacctgtgtgaacgtatttcgagtctcctccttgctctgacactcttcaccgcgattccattgtctgataaggcgcagcgagagcagacactggtctgatcgggtacagtcgggtaactcactttacttaaatagtattggctgtttacactgctattatgtagtcctattgggcaccagtacctccaagtccgattcctcggaagtgtaaacactgcgtgacatgcaccactctgctcttaattcgcgcattgctatagatgcagtcgactcattcaattaggcaccccaatgggcacatcccgagtggaagacccgtatcacaatacttggagaactcgcaagcgggcacaacaatctgacccatggcctgtccaaaggcaactcttgctgcaaataagggcgccagggtataaggctagggacgcccca

SEQ ID NO: 619754 - DNA, 381 bp, Homo sapiens
  misc_feature (1)..(1): n is a, c, g, or t
  misc_feature (18)..(18): n is a, c, g, or t
  misc_feature (53)..(53): n is a, c, g, or t
  misc_feature (75)..(76): n is a, c, g, or t
  misc_feature (134)..(134): n is a, c, g, or t
  misc_feature (197)..(197): n is a, c, g, or t
  misc_feature (208)..(208): n is a, c, g, or t
  misc_feature (319)..(319): n is a, c, g, or t
ntccggccgatcaggttntattgacggcagaagaaaattcttcctttcacttntaaaaggggtttgcttaatttnngtaggggtttttccattctttgtgtgagttgactgtgttttccaccctaaaatctgtnttttctttcttcaaataataatatccaccacagctacttattctgaaaagaaagtggaagggntgtcaacaggnttccaccaggggggggggggcctggctcgtttcttcacaaagagtctacttttcctattagttccgagcccggggtgggtgggaaaactgtggggttgggcgagtggatcntcttggctggccatcacctcccctacggaactccagagtttgatcgtaggtgccttcttcct

SEQ ID NO: 619755 - DNA, 922 bp, Homo sapiens
  misc_feature (22)..(22): n is a, c, g, or t
  misc_feature (75)..(75): n is a, c, g, or t
  misc_feature (85)..(85): n is a, c, g, or t
  misc_feature (133)..(133): n is a, c, g, or t
  misc_feature (144)..(144): n is a, c, g, or t
  misc_feature (210)..(210): n is a, c, g, or t
  misc_feature (282)..(282): n is a, c, g, or t
  misc_feature (296)..(296): n is a, c, g, or t
  misc_feature (298)..(298): n is a, c, g, or t
  misc_feature (314)..(314): n is a, c, g, or t
  misc_feature (345)..(345): n is a, c, g, or t
  misc_feature (414)..(414): n is a, c, g, or t
  misc_feature (445)..(446): n is a, c, g, or t
  misc_feature (452)..(452): n is a, c, g, or t
  misc_feature (456)..(456): n is a, c, g, or t
  misc_feature (487)..(487): n is a, c, g, or t
  misc_feature (532)..(532): n is a, c, g, or t
  misc_feature (536)..(536): n is a, c, g, or t
  misc_feature (630)..(630): n is a, c, g, or t
  misc_feature (787)..(787): n is a, c, g, or t
  misc_feature (844)..(844): n is a, c, g, or t
ggaggcagagccacggcaaganccctgccaggtctgtgctgggccaaccaccaccacataaggcacccacggccngtgcagctcngaaggcaggcgagagccaggctgagggggagagaagagaggcggcctnattcccctggncggctccttgggcagcagatgaagcagctctgtggaaggttctgctgctgaagatgccctgggaanactcctcctgggcctgctggcagctggcccctgtccgtcggtagagggagtgcacccgctgcaggaggcagnctgcgagcccggcncngcgggtgacgacgccngccacaaccatcatgatgactgatatggccngggaatgattatccagtgtagacagggctgcaatccaaccgctgtcccccaggccagggatgccaaccnactggatgatgtagatccctatttgacaaannaatacnaagnagaccaccaagaagctgccagcgttgtcggncctccaggccttctcgatgggtcggtaccaacacaggacggcacngggngtgaagctccgccaccaccggctggcgaggcccaagtccactcccttggagctgttgcccgagaaccaggccaggcaggcaagcaggttcaganacagagtcactgaatgcaacatccacagatagtagagcatcttgcatatccgctggtagtcggcagggatctctgtggagaaatcctgatagaagcagggcttcacagggcaccacgagggcagagggggccagttgttctgtctcacatgcaagtnggctacagtgttctgcagctcccgctccttgcgttccagctcggcagctttcctgtncagttcttcctgctgccggagcaggcctgcctgggctgcagacaccacggcctggggggtcggctgggttggttcact

SEQ ID NO: 619756 - DNA, 250 bp, Homo sapiens
actatatactaatactgagcaatcggaaaaacaaatctacaatagccacccccccgccacgtgaaatatcgttgagacccattcatggatctcaaatccaaaaatgtgaaatgctcaaaacctaaaactttttgagcgctgaaatgactatcaaaggaaactacctcactttacagcacttctggactcttacgacgttgggatgctcccgtacactactttgcttcacggtccagcacactacttaacc

SEQ ID NO: 619757 - DNA, 1088 bp, Homo sapiens
ccacgcgtacgtgtggagccacatggcgacgatgaagtttcagtgggacctcaatgcctggatcaagagtgccgaggccttaggcaagattgtggcagagcgtcctgtcactaactctaacaggccctgtacctcatggcgccctccaacgacgccccagggcccctgagcaagcagggctcatggcagctagccagcccatggaggtgcaggaaggctatggcatttgggtcaggagatgatccctactcaatgtgcagagccccatgtgtcaggtgtgaaacggtcccgctcaggtgagggcgaggtgatgcggcttatgcgcaaggtgccacggagtgagccttgaacgcctggtacctggatcctcaacagttgacagccagcgcacccgatcttcaaggtacttcccaggcagtaccactgaggactacaagccttattgttcttgaacgtggcgctgcctgctgcagctaccggtcagccagggactgcgcctgcaaggaacccctggtgacccaaccctggctggcatggccatagtcaatgcaggaggagacggaggctagcattggagccctcctactgccactgagggccctgagaccatatctgtgctcatggctcattgcggagggtcctggtgctgagaggtcccgactggctcacttagtggcagcaccagctcaaggctggaacgttgtgcatctagagggtacgtcagcccaggagtgtggccggggaacccgtgatgaacattgccaccattggcaagtctgcaaagccaagggaacacggtaaaggtcacccaaagtaatcaggtacactgacggccactcacgcctgaggattcaaggcacacagtgtacggcaccccgccactgcacggaaccacgaccggaaggcaaaccgcccgccaggcaccaacacgggcgcggcaaaacacaccacaaccgaaggaagagtaacaacagagaagcgcagcacaccgggaccacaccagaaggcacagcaagaaaagaccaaaaacaacaccaagagagccagcaacaacagacccgcaaaccaaacgaagccacgagaaacaa

SEQ ID NO: 619758 - DNA, 151 bp, Homo sapiens
caacggagactttactcccatgacgtctcagactggcacaactttttgtcagctaagaccgctgctttccagtcctaattctgttctggtagatgttttaagtatttcatttttgttttgtttctagtgcgcctgtactgtgctctgaggt

SEQ ID NO: 619759 - DNA, 381 bp, Homo sapiens
gaggctgagacgggggagatcactcgagctcagaagttccagaccagcctgggctacacggcgaaactctatctctacaaaaatacaaaaattggctgggaaccggtggcgcgagcctgtagcacaagctactcggaaagctgagatggtaggattgccagggcccaggaggcagaggctgcagtgagccaagattgtgtcactgtactccagcctgtattaaaagaaaaaaagaaaaagaaaagaaactgaatagaaagcccagaaatggacccacacaaatatattcaactgatctttgacaaagaagcaaaggcaattcaatggagaaaggacagtcttttcaacaaatgatgctggaacaattaggtgttcatatgc

SEQ ID NO: 619760 - DNA, 1017 bp, Homo sapiens
  misc_feature (1)..(1): n is a, c, g, or t
  misc_feature (825)..(825): n is a, c, g, or t
nttgtgtttctgtttataagacagatagacgagcgacggagcaaggcaaattgagagagaagagagaacgaagaaaggacagtagtaggcaacgcacatactcagctgcaacttggtgtgtatctatattgattgacgtacacctgtacgtggtctgtgggtctgtcaaccggctgttgtcgttcataacaacgtctcgtgaatctgtatatgccggcctcagcctttgtttatctataaccgggtattgatctcttgttggctccaggaagataatggtttgtgtgccagcgtaaacattgttgagctgcacgggtcgtgtttactgtggtctcgttgctttctgttccgatcgagcccgtgcgtgggagcacacctgcacttggcgcacatggcggtacaaccacagaaggtggcgcgcctccccgcgaactgtgtgcgcgtgttgggccacagcatatcgtctgtcgccgatttaatccggtcctgtcaacaacccaggagcccatgtggggtggtgtatgccccaaagacgacgcgtgggtcgccttagtcgacaggcggccattctaacaactgtccagttcgcccattcgtactcgcgagtttcccctcttggtaaatcttccacacggagtgttcaaacacgcagtgctattacctaggggagatttgttcaccatcccatgccaagaaggcgtacctagatcaaactgcactgtccccccaccagttaacccacggtgctcccacactgttcaatacaatacgaggaccactggacaggtgttggtgacggcaaacgatgagggcgtcccggtcttnctttgccacaactctcataagagcagtgctgctacaagttggtgaactccacgcgagagtagttcatactgaggttacgcgatcgtcgggaggtacgacccaacgggtggcaccgacaataagtcggttggccctactatgagtgggttttccgcccttcataacaaaggggtaaaaaacgaccggcaagca

SEQ ID NO: 619761 - DNA, 168 bp, Homo sapiens
tataagtgtgaagaatgtggcaaaagctttattctgtcctctcatcttactacacataagataattcatactggagagaaaccctacaaatgtaaagaatgtggcaaagcttttaaccagtcctcaacccttatgaaacataagataattcatactggagagaaaccc

SEQ ID NO: 619762 - DNA, 634 bp, Homo sapiens
gctgagaatttgtacttcacaggatactacatttttcagttaatggtaaccctgcatcaagcaagtctattggcaccatttttccaacagtatgtgcttacttcatgtctctgtgccatattttggtaatcttcacaatatttcaaaccttttcattattgtatctcttatggtaacctgtgatcattaatctttgttgttactactgtaattattttggggcaccatgaaccacgcccacataggatggcaaacttaaccaataaatgcatgtattctgacggctcaaccaacgggctgttcccccatctctctccctttccttgggtctctctattccctgagacaaaacagtattgaaattaggccaatgaataaccttccagtgacttctgcagtgttcaagtagagcaaagatccacacgtctctcactggaaatcaaaaactagaaatgattaagcttagtgaggaaggcatgtcaaaagctgagatcagccaaaagctaggcctcttgcaccacttaggcttagttgccaatgcaaagcaacgtttcttgaaggtcattagaagtgctactccagtgaacacaggacttagaagaaagcagaatagccttattgctgatatgcagaa

SEQ ID NO: 619763 - DNA, 156 bp, Homo sapiens
aggcagctcaatattaatgagacagtttgaccaagtcactcctgctacctaggcaaaaaggaatctagtgaccatgtataatgagaccatgtaagatcctttttctattgtgattcagaacacatctataaaataccatgtacgacttcaccctgc

SEQ ID NO: 619764 - DNA, 629 bp, Homo sapiens
ggtgagcctcacgcctgtagtcccagcacttggggagggcgaggagggtggatcacgaggtcgagagatggagaccatcctgaccaacatggtgaaaccctgtctctgctgggaatgcagaaattggctgggcatggtggcgtgagcctgtggtcctagctactcgggaggctgaggcaggagaatagcctgaacctgggaatcggaggttgcagagccaggatcgccccactgcactccagcctggcaatagaccgagactccgtctccaaaaaaaaaaaaaattaccaattttaatttctttaaacttattttaaggataagtaaaggtatataaaacggggtttgggaccaaaattatctcggagtccggggtatttcgcaggtcaaaattttaaacctgtagaatcacattaaggtggtgggaaaaaattggtctgaaagatttggcataattggttaccagaatgagggtatctagggattgagaccagaaggtctagataaatactctatgttacattttaaaccttttattataagtctacattaaaccatttgggtaactctctaccaattgtgacggataaatcgtcaaggggaaatgaggctttaataatgaatatgac

SEQ ID NO: 619765 - DNA, 146 bp, Homo sapiens
gctggctgcaccacccaaaggcagcaagggggccgctgttgagcatgttcagcagcgtggcttcgctggctcccactttgtctccagtcttgatcagctgcacatcactcaggctttcaatggtgcccctgaagatttgttggtgg

SEQ ID NO: 619766 - DNA, 157 bp, Homo sapiens
  misc_feature (44)..(44): n is a, c, g, or t
  misc_feature (49)..(49): n is a, c, g, or t
  misc_feature (93)..(93): n is a, c, g, or t
  misc_feature (134)..(134): n is a, c, g, or t
caagcgcaccaccaccatgcaggtccctccacggggcgccctgnccgantctccgttcgtttgaagaccgaggcccctttctacccgacccgncacatccctgcccctcaaatcacaggcctgattgtccccangcgcgcgctccgggttgggctac

SEQ ID NO: 619767 - DNA, 839 bp, Homo sapiens
  misc_feature (448)..(448): n is a, c, g, or t
tggtccgaatttttgacaaggctgcggtgtctgcggtattctccgagtttcgaaatgccgcctaaggacaaaaaaaaaaaaaggacgctggaaatgtcggccaagaaagacaaagacccagtgaacaatatccgggggcagggccaaaaagaagaatgtttgtccaagggcaaatgttcgggacaagctcaataatcttagtcttgtttggacaaagtctacctatgataacactctgtagaggaagttcccaattataaactttataaccccgagtgtggtggctctctgagaagaactgaagaattcgaggctctccctgtggccgagggcagccctttcgaggagctcctttagtaagggcacttatcaaactgtggctttcaaagcacgagagtctcagagtatatttacacccagaaatataccagaggggggagaatgtctnccagtctgcgtggtgaacagtatgccttgaaatgaggtccaaccagtctgtcactttggggaacaatatcaaactcttttattacaactctcacaaaaaaaaacaaaaacaaacaaattccgcagaggacaatcaatgtggcgcggggtgcgcggaacaacagacgacgggctacacgaagaacaggcggcgcccacgtgtggccccaaacagcggttgattccctgaggaaccccagactcttttttctgtggtccaaccacacggctggggacaaaaacatggccagggggtccccccacatatgagggaaagcccgcaatataaaaattgtgccagaaaaacgcccggtggttacccccggcttaatacacggcagccgacacaacgc

SEQ ID NO: 619768 - DNA, 390 bp, Homo sapiens
  misc_feature (302)..(302): n is a, c, g, or t
  misc_feature (374)..(374): n is a, c, g, or t
ttgcctctagtgtcctccgctgcgggaaaaagaaggtctggttggatcccaatgagaccaatgaaatcgccaatgccaactcccgtcagcagatcaggaagctgatcaaggatgggctgatcatccgcaagcctgtgactgtccattcccgggctcgttgccggaaaaacaccctggcccgacggaagggcaggcatatgggcatagggaagaggaagggtactgccaatgctcggatgcctgagaaggtgacctggatgagaaggatgaggatcctgcgccggcttctcaaggagataccngggaatccaagaagattgaccgccattatgtatcacagcctgtacctgaaggtcaaagggaatgtgttcaanaacaagcgcatccttc

SEQ ID NO: 619769 - DNA, 132 bp, Homo sapiens
cacgatgatggcctctgatcgaagcgggcgttcatgggcggccagggttgagtctcgggtcggggcctgtggattgtcggtgcatcacggccgatggctggggctggcggggccgctcgctgcctctcgctc

SEQ ID NO: 619770 - DNA, 238 bp, Homo sapiens
  misc_feature (3)..(3): n is a, c, g, or t
ttntccaactaatacatttactatgaaaaagcttcctggccctacacactagctctatgtctatgacacatctcactccctatatataacagcaagtattcccccacaatcatagaaatatgtctgctacaagcgttactttgctagagtacaaaaatagaggatcaacaccctcttctttctagaacactaggactcgacacctaaaactgagaattcacaaaatctccgtgcgtac

SEQ ID NO: 619771 - DNA, 163 bp, Homo sapiens
  misc_feature (97)..(97): n is a, c, g, or t
aggaaatgttgtttggaagccttgctagacctggccatcctatgggaaaatttttttggggaaatgctgagacgctcaagcatgagccaagaaagantaatattgatacacatgctagattgagaagaattctggatgcgttactactcttctcattacatga

SEQ ID NO: 619772 - DNA, 996 bp, Homo sapiens
  misc_feature (33)..(33): n is a, c, g, or t
  misc_feature (66)..(66): n is a, c, g, or t
  misc_feature (85)..(85): n is a, c, g, or t
  misc_feature (89)..(89): n is a, c, g, or t
  misc_feature (99)..(99): n is a, c, g, or t
  misc_feature (101)..(102): n is a, c, g, or t
  misc_feature (139)..(139): n is a, c, g, or t
  misc_feature (143)..(143): n is a, c, g, or t
  misc_feature (188)..(190): n is a, c, g, or t
  misc_feature (193)..(193): n is a, c, g, or t
  misc_feature (221)..(221): n is a, c, g, or t
  misc_feature (277)..(277): n is a, c, g, or t
  misc_feature (301)..(301): n is a, c, g, or t
  misc_feature (313)..(313): n is a, c, g, or t
  misc_feature (357)..(357): n is a, c, g, or t
  misc_feature (406)..(406): n is a, c, g, or t
  misc_feature (457)..(457): n is a, c, g, or t
  misc_feature (508)..(508): n is a, c, g, or t
  misc_feature (511)..(511): n is a, c, g, or t
  misc_feature (525)..(525): n is a, c, g, or t
  misc_feature (545)..(545): n is a, c, g, or t
  misc_feature (547)..(547): n is a, c, g, or t
  misc_feature (854)..(854): n is a, c, g, or t
  misc_feature (915)..(915): n is a, c, g, or t
  misc_feature (957)..(957): n is a, c, g, or t
tatctaaaattcaagaaattaaattatttaatntaatccatcaacctctcatagcaaatatttganaaaacaaatttatattcanattnttattttcantnnggaagtaagaagttgcagctcagtacacgtaaagttnaganagagatggagacatccagcccacttctctggaacaggaaagatgnnnggngagggaacacaggtcagtgtggggacangggtcacggtggacacgggggtgggctgtctctccacctcctcacattatgctaanaggaacgcagacacattcagatgnctttgcagaaanagatgccataggctcttgaagtcacaaaggagaggtgtgaatanatcctgcatctcagtcccacacaggcagctgtctcaggctttacaatcnatgagagactcatcatatccctgggcactgttgctggacgcagcctgatancagctccctccttttccacctgagctcttcctcctacacatcacaacagcnatnacagctcctagganagctaggacagccaggatancnaggccagcaacgatgcccacgatggggatggtgggctgggaagatggctcccatctcagggtgaggggctctggcagcccctcgtgctgcacatggcacgtgtatctctgctcttctccagaaggcaccaccacagctgcccacttctggaaggttccatctcctgctggcctggtctccacaagctcggtgtcctgagtttggtcctcgccatcccgctgccaggtcagtgtgatctccgcagggtagaagcccagggcccagcacctcagggtggcctcatggtcagagacgggatggtgggtcngtgtgtctttgggtgttcgcgcgctgcaggtctccttcccgttctccaggtatctgcggancactccacgcacgtgcctccaggtaggctctccactgctcgnctcacgggccgcttccacttgcgctgggtgatctgagcg

SEQ ID NO: 619773 - DNA, 548 bp, Homo sapiens
acagttacgcaacagcatactaacacagctgctatagtcccggatgtgcaattgttaaagtgtcatgactagatgaacacagcttgtcaggaacgaacactagaacgatttgagtagaggctgctgctcaccttttgtgacctgaggaatcccatgcctgttttaaattcttaaccgcacaatgcagcacatgagtgccagaaatagcactgaatcaagaaaatagccattgcggagatgccctcttgagtctttctgtccatcccattctattctgtactgtgactacagttcaggaagtatggtaaggggtcttaaataagaggaaagagcaagtttgctcagtcaagtgatcagatcacgaatctagatccccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcctcctgtgatgt

SEQ ID NO: 619774 - DNA, 303 bp, Homo sapiens
cgatctagaggtcccgtggggagagggggtctcactcatttgctgggacagggagtaaaatccactccacttggcaccccccgggccggggcaggtgacggcttgggcccctgaccggggagacactaagagctcacactggtggggcacctctgggagctggacgggggagattctcctggaatcctgcggctcccgctggggtctgggacaccctggtggctccccggatcacagggatgggcttacacacttcttccggtggtcctggggcccttggcactggattcacattctagaagg

SEQ ID NO: 619775 - DNA, 402 bp, Homo sapiens
ctttccattttttattaattgcagcacagagaaaagaggcttaatggttaaagaaatttatgttttttaaacagggtgttggctttacaccagcgttgaagaaaaacagatgaataagctttcgagcttcatttggtttctcttattctcatgggaggctgagatgcttttaaatgtgatgctataagcctaatggagtttgacttgtagcaacaagttttttaccctccttgggaaagcacgtctgcttatcgggagccttgcatctcttctctacaaaagctgtgaaatcattcataacagctttcacctgctcttttgctgccttgggcttgtgtttcacgagctcaacaagtgcattttgggtcttgataagcctgtccttctcagaaactggtgccc

SEQ ID NO: 619776 - DNA, 277 bp, Homo sapiens
tgtggtcgtctctagcacgatcccctgacgagcgcctctcttgaatacaggattaaccaacgaagacgactccctgaccatctttggcggtggcagagcgggaccaggcagttacacgctcctctcggccaggctcggtcagctccaggtcccggggccggtctggccgtcctagcacggtgaggtaggccttggcccaggtcttggtctagctcggtgctcagtcctcggggccgtgtctggagggcaccttcagacttccgcgcgcctggctctg

SEQ ID NO: 619777 - DNA, 207 bp, Homo sapiens
tcgacagtacttcgttggactacgtcgggcaacaattatcgtgcactcggatcttgacagaagatgtctggagtctcggcgatgtgcagcaacaagttcgtccacactgacatcaagaagtgtttggaccctcggcgtgtgcagcaagaacttcgtccattgtgatctttccaccaacagtcaatgtgtggtgcctcggagtgtgca

SEQ ID NO: 619778 - DNA, 921 bp, Homo sapiens
  misc_feature (825)..(825): n is a, c, g, or t
tggcttcaaaaagttttttttccattgggcccaaggtgggtaaggatagttaaaaaagttgcctatgggtctgggagggaaaggtttaggaaaaagcctctataatttggaagggggcccttcaaaagttcgctgtgggctctcagaagaggctcttagctcggtgctgtgaagaagttgagccattctcgaaaaaaatacgtcgcccagcccagccctcgcgggccacccagccgtggtgggaggtgggctcagggtggctccacccaatctctctggaataagcttcactctcctcatctaggaaaaggtaagttcctccgaggaaagtatcacagaagcagtggggtgtctccgagcgcggagtacagacaacccagggcacatgtgaaaaactccaacagggggcaccgtggtatctcagccgtcttgttctctccaggggcccagtggcacagcacttaacagtgaggcgtatcgtggggaattttaaaccccaccttcatctctctcgagcgcgtggcctctcgtagaagtgtctcacgtggaagacaaatacgcgcgcggcgggacccacgcgtggatcacgagcaactctctcgagggaagaagcggcctcgtataagccccgtcacgagcgcctcacctctatgaacatagcggagcgcgacctaaaaaaagtcccggcgctggtacaagaaaggcaacccaagcctctctccctcgctacgcgtggtcaccgacgcaatgacaacatacgcggcagaccgccacaacggacagcacacccatgtcgcttgaagtggctcacccccccgaccccancggtgcgcccagccgcgggctgtcccccaaatgggggcacacgccccgccgggcgaaccctcaaacaggccggaaccacgggatcacgacccgagg

SEQ ID NO: 619779 - DNA, 1329 bp, Homo sapiens
  misc_feature (209)..(209): n is a, c, g, or t
  misc_feature (301)..(301): n is a, c, g, or t
  misc_feature (457)..(457): n is a, c, g, or t
gataccaaggacgcgtgggagcacagataattccgtagacctgtgccgatgaacagactgttccatggcatgcttgcgtgcgtgcctgcttgctatatgtccttggcagcgtccgacggctaggcagacgcgcgcgcgtaggctagggaactaggatccacgcctgccttcctccggtccttgggacgctaggcacgtcaccgatactnttcacggccatgtacatcgctggctaagccttgctatagcgccatcgcgagcattcaaacggctccattgccgactatcggtggtctctgtngcgcacgtgcccccaagacaagcgcattccccgaaagcaaatcactgcacactgccggcgttcgacattcttgcgacttccatttgcgtggagctccctcggggctagcaagtgctcaatcctaatactcgcgagcattcccgtcaacgacggagncgaattgaggccctcgctatttccctaggggttcgcaaagcccaacgaaagtgtgggtcgcctccaccacccttgtggtacggtcattcatgcgccctcgtcatgttcctttgaggaaaattctcggaatttgctcgaaaagcttgtttcctagcccttgttgatggtcccccccaagggcctggtgggctcgggggtgttcgtcgcttgagcttcccgagatgaaccaccacgttttccacatttaggtcgaacccctacacgtggaatgcattcctggacaagggtgcctgcacccatggcatgaacaaaaggtctattccggaaagcgtgtcctgcctataccacaaggcaaattttcttttttttacctccgcggcacgtttgcatttttaccccggggaaaggatcactcataaggaaacacccgaaagatatcaccagcgtttgtgttattcaccctttggagactccgggcgggggccggtaaaggcaaagccttataattttgcccttggcgccgaatacttcaaacgattactcgcccccagaaccccttagttgcccacacgctagtccgtttgagctaaccaactttagcgaaagacgcgatatttcgcctcgcgaaagtgtcaacttgagataagaatcgcgtgtttacccaaataggtggggaccttgtgccgaacataaggattgttggggcaccagaataaggggaaccgttccctttcccctttgccctcttaattgaaaaatctcccagagagaaactttggataccgagaacctttgtcgccccgttggtggggttcctgtaaaacttctctgtttggggccgcgctttaaacctaaaaggcccacacatttgg

SEQ ID NO: 619780 - DNA, 226 bp, Homo sapiens
atcgagccgctccggttaaggctgcagtgcaagtccacaatctcaaaagtaggaagccagcagtgcagccttcagtctgtggtcaaaggtccaagagtcccaaagctgaagaacttggagtctattgtttgagggcatgaaagcacccagcacagaagaaagatgtaggctggaagactaagccagtctagtctttccatgttcctctgcctgcttttatcctagc

SEQ ID NO: 619781 - DNA, 235 bp, Homo sapiens
tagctttagactactatcattacctttaggggggggaggagggagtaatacactgggggtaacgggtttaagagtggtgtgttcagctgaacctcctaaatataaaggctagaaacaaaattaacttcccacatccccccctaaggtgatcttaaggactttcagagaagtttccctttgggcatgtgttttcacagatgatgaaggagcaactcccaaaaaaggggcggccgct

SEQ ID NO: 619782 - DNA, 281 bp, Homo sapiens
tgctcagcggactaatggacagcaagcgattactgtgtttccagaaaaggcgggcacaacccccaaatgctgcttaggactccattgtcaccatggtcttgatgtcgctcactaacatgaggtcacacaggcaagaaaaggacagaggcagagacagaatcctgaggacaggtgtggcctccagtctccggtcttgggccccacacaccctgagccacaaatcctttttccttgagaaataggatcgtacatagaatcttcttatacattcatatggttgt

SEQ ID NO: 619783 - DNA, 344 bp, Homo sapiens
gccgtgagccctgatcgtcgggcccatcctcagcgcagtacctggaagaaaagtctgacagcaaagaaggaggagctgctgaatgccatggtggcaaaacatggggaaccgggaggacccaatcccccaggactcctttgaaggcgtggacgaggacgagtgggactagcctgagaccacgtaacctccactcaactgtgctgccacttccatagtgcaaacatcacggtcatcctcaagctggaagatacctcatctggcaccaggacacctgtaacgcctgacactcctgccattacccgatgggaacttaccaattcatctgggcgctcaggcaagttaca

SEQ ID NO: 619784 - DNA, 117 bp, Homo sapiens
aactcttccttggacttcaaccttagctgggcgctgtagccgcagcaggagcagctgtggtggctgcagccacaggggcagtctgccacaaaggcagatggatcagccaagcaaggc

SEQ ID NO: 619785 - DNA, 570 bp, Homo sapiens
  misc_feature (41)..(41): n is a, c, g, or t
tgctcccatcacggtattactcgacaataccagagacgaangaacttgatttaagaacaggacaatgaccttaacggacacctcactaaagaagatataaagatggcgagtatgcatatgaaaaaaagtcacataatcaggaaaatgcaaattaaaacaataccactacacacctattagaatggccaaaacccattaacaatgacaatatcaaatgctggtgagaatgtgaacagaaactcccattcattactggtgggaatataaaatggtaccatcactttgaaagacagtttagaggtttcttgcaaaactaaaggtattcttaccatatgatccagcaactgtgttccttgctatttacccaaacgaactgaaaacttatgtccacacaaaagacacgcacacagatgtttgatgtttatagcagctttattcacgattgccaaaactagggagcaaccaagatgtccttcagcaagtaaatggacaaataaacccgggtatatccagataatagaatagtcaagtgcaaaagaaaaaaaaaagctgtcaaaccgtgaaaagcca

SEQ ID NO: 619786 - DNA, 124 bp, Homo sapiens
atccacttcgggagcaagtgtgttaattttccttttcattacaggaaagattagcgtttcattgcacacactatgtccatcttagcccatcttggaataccgatgctcgatacttcgtaatctt

SEQ ID NO: 619787 - DNA, 454 bp, Homo sapiens
  misc_feature (4)..(4): n is a, c, g, or t
  misc_feature (255)..(255): n is a, c, g, or t
  misc_feature (363)..(363): n is a, c, g, or t
  misc_feature (438)..(438): n is a, c, g, or t
ccantttatacttcaacaaatgcaatgcagaagaaagagtatttatcttttttcccttcatgatcgcaacagaaatagttttagaatgtggatctaggccaacactcacccagagaaaggaagaggactggggcaaagggatctctgggtaggtggctgtgtgtttggatttccagtgcagaacctctcttgtggctattttggggtcctgagacatccacttatgtgaccctgtcagcagcccccctgggaaantacgaaggcaagggggacaaagggaaagggagagctatggggggcacttttggcatccctccattagtgttgatccagagaggggagatgcttaaaggttaacccctntagttttgcctcccaagcattactgttacatcgagggttgattaaataaggcctccaagattaggcttttaggtngggagaggttgcacgg

SEQ ID NO: 619788 - DNA, 177 bp, Homo sapiens
cggaagagtccaaatcctaattcttcagagagtcagatatttgcgtggaggtgagtcccagcagtcggtggcgttcacaaggcttccaggtgattcttaacgcctgctcaagctggagaacccctggtgtggatttgcatcatttgaatttgtagtacataggatacagtagggaga

SEQ ID NO: 619789 - DNA, 326 bp, Homo sapiens
gggaagccactgccacccacccagtgaaacactatcacgaacaattctctacctctctatactaatctccctacaaatctccatgaattataacatacacaggcacagaactactcatattttatatcttctccgaaaccacacttatccccacctgggttatcaacacccgatgaggcatccagccagaacggctgaacgcaggcacatactccctattcttcaccctagtagggtcccttcccctactcatcggagtagtttacactcacaacaccctaggctcacttaaacattcctacctactcactcctcactgggccaag

SEQ ID NO: 619790 - DNA, 117 bp, Homo sapiens
cacggttccctggtagtgtagtgctgtgtgtgcctatgcattatggatactgcatagtagttcagaatgcaccccactatgggaaggacaaggtagggagtctatttctacggaaca

SEQ ID NO: 619791 - DNA, 266 bp, Homo sapiens
tagtactaaactgatgccggacatgatgcgggctgctgtcatcccagtacgcaggagatagaacagcggaattgcttgaacccagggtgatagcacctctgcacatccagcctggggaagagattgagactctgcctcgaaaaaacaggtgatctggagaatcactcccctcatacctccttaagtctacatggaacagtcacaaaaatcattcctacatcacagccaggtgaggtggcacatgcaagtaaatccaagatgctcag

SEQ ID NO: 619792 - DNA, 102 bp, Homo sapiens
tgtgtcatggaaagcatcactttcgtctactaattggtaatctgtcatttcctgttaggaagcactcccagatctgtatccagagccgcagccgggcgcgat

SEQ ID NO: 619793 - DNA, 100 bp, Homo sapiens
gtattatctgttactctttatgtgtaggtagggaagcaactttgcttgcatagagagagaagatcttgtaggtcagcttcagaacttatatcaataagct

SEQ ID NO: 619794 - DNA, 137 bp, Homo sapiens
tagcagcgcattgggctagcatgtatggttctgtcccagctgcctgtctcagcagcagcgggtctccctgcctcaggccctgcaccctgaccaccttgcatccgtgtcatttcccctccccatgcgtggattgccag

SEQ ID NO: 619795 - DNA, 556 bp, Homo sapiens
ggatagactggccagcacgcataggagcctgtgcgcgacccagctgctgctctacgaggacgcggcggagcatgctaggagagctgctgagcgttgcactaccggggaatcacttcacacggtgcaggcgtacgtacacacgctgttcagcctggaccaagcacagggcgcgcatgtgcctgctcatgactttctggacagactgtgttgtctagacaacctggaagcctcactcagtcgactggaggtggacaagagaatggtcaagactgttgtggacagcttggatgcatactcagtcaacatagaaaccaactagaacattgtggaatcagccaactggctactagataacctgacagaatgatctggatgggaggttcgtgagagtagctatcagacacatgaagggctcacatgaatttgtgtgcagcgcgcgtattcaaagtctctttggtcatagccaaacgatgacgtgtttttactgacgcgtcccctaccgcaataatttggctctcataactcacttacaatatctcatctgtactgctggttt

SEQ ID NO: 619796 - DNA, 200 bp, Homo sapiens
tctagaggatcgcccggtagatgggactctctctgactaaatacttgaaaggtgagcagatagaaaaacaatgagccttggaaagtttctgagatggatctgtagtcagcgattactgttgagtagcagtatcattgttgacatttaccccagataagcctgaaccttccctagattaatcacttttcagttgccacggt

SEQ ID NO: 619797 - DNA, 915 bp, Homo sapiens
ctaaggagcgttactccggcatgaatatgccccaggtacagggccgggagcaaggacaagacggaaccgccggagtgctcgcggactcctgaggatgggactggtgctgtccgtgtggtgctggcggctggcgcctgggtctgtcttgactcgtcgtggtgactctgggctcgcaggtagagtgctcaatgccgtacttgtctactccacgataggaggcatcgcagcacagcgttacgaatcgtcatagatgccccggacatccggagatgtcttggggtggcggacatctcgacctgtccaatcgtgcaaaatgtctattcaccgacatcaaactcgggtctgtacacgaaaggaatccctagatgatgggctcgcgttggccatccgtgggcaatcagagccgtgtgcacatacctgcatgcaagagatggcatcgccatgccgtgccgtgatgtccacaatcctagttgttctcacccatcgttccgaggactcactgtggtggtggtgtgggacacgctcatgtgcgtgaggccgcagtctgacgcctgtgttgcatgctcctgggctccacctgtggtgcggggacgttgtctcatctgtggaacgatctctttggctgagcggtgccgaaggggggtcccctggccgtggggggtcctcccccactatgggccgaggagcactccctccaggatgatgggccaactcctggtaatgagactcctaattgggtgccccaaatgggggatcccccctgggaagaagggactccagtgggcatgcccctcccgggaaatgcgggctcttccccctgggaatggaaggcttttttgacctttggcgcaccagagattggaagatggcccgcagaaaggggtggccaatctctaggcggctttacacaaaaca

SEQ ID NO: 619798 - DNA, 519 bp, Homo sapiens
ctacgatcaagttaattactcaaagcaaaagttgtccatataatacattggtcgtcaatttttatttccacatggtttcacaggactgaatgacttgctcacaatcccaggaggaattataagttttgctcttcaaaaaagggtgttactgtcgtaaggggaaaagccctcattgacaaaaaaatgactctaatgaaaacaaattcaagaatgatccactggtactgcaggttacagaaaagctgccaaagatcagttccccacctctagcaagcaaaggggatcaagggctaaaaataccttagaaaaatcaaacagcccctgctacccatgcttatataagggccaaacttgcaaatgtttccttttcgaccatgctgcccaaatgtgaaggaattacatataaggctaaaatctggcgaatgttatcacttcttcctgttgtttgtggaatataatatctctgcgagaggaactgggacaaacccgtgacattcttttagttcctggcaaaagggg

SEQ ID NO: 619799 - DNA, 165 bp, Homo sapiens
tcatagctgttccaaggatccccaatgtctctcctacgaacgtttgaactgttcagtgttggagttttgaaaaacgcatcatgtttggtttgtttgttgtggttttttgtttttgcaggtattaatctccagaaatagctctaaagttctggaatcaatgttaag

SEQ ID NO: 619800 - DNA, 318 bp, Homo sapiens
tttctgaccgcagctccagcgccgggtgggggccacgatgcaggtgctggtcgattccgcaccggccttgggccgcaagggcggggtggggcgcagctacgccgacgcaccggagatcgacggggtcgtgaagcttctgccgccggagaaggcgtccaagaccctgaaggtcggcgagttcaccaaggcccgtatcgtcggcgccgagggccacgacctgattgccgtgccggtgtgacggtcggcacggccgcctggccgcctgaaggcggcgccttgccagccggtgccggcggtatgcacggcaacccgaaggga

SEQ ID NO: 619801 - DNA, 973 bp, Homo sapiens
ggtgagtgactaaaactcctatctgtgaggtgcaggctgggcgctcgatgcagcatgcgtcgtgatctgccggcgtgtacagcgggaatctgggagtgcagaggcagctctgcgagttaatgcacgtatttaaaactcccgggacctgcggacgctatgaacagggaagcagctcgaggatattccatgacctgagatagcaaagttgccaccagatacaagtgtgggatggcattccaggtcaagacgttcctgaaccagcatgtcaggcatgtggggtctccgcgcctgtgaagaaagaggagtcgccgagctagtgagaacatcccccagtgaacgtgcgtctcaaaccgtgggaccacccggatgagccccccacggaaactgctgaagagcaaagggagtgacaaagactttgtgattgtccgcgaggcctaagctaaatcgagagaactttccaggtgtatcatgggactcccttccggatgagctgcgtcttggggaatcttaatcctgtctgtgcctccctgacctgctaaaggtctctgagtgtctgtaagatagtgagatcgctagcagtcatagatgagtctctatggcagaccttacgacctcaccaggtaaaaagtctgcacccggatgtgactggccggcttgctgtctcaaggggggtacttggcttccacggttgcgccacgatgcagttaagtagagcaacgagtgcgtagaagattttcaagccctttgtcgtggtcacgccagtgagctataaactcagtatagaggtgtccaccctcaaagggctactggtccagtggtacacagtgagaaataaagctagaaggctggggttaggacccgatggaaacgctcgaacagctccctagcgggtaactccgggggtagcaactcagtgtttcaatcacacctccagtggagaccccggtgagacgagcacatactttctgtaaga

SEQ ID NO: 619802 - DNA, 132 bp, Homo sapiens
ctaccccgcgtgcaggggtgtacaaggagctgggttacacagggtgaagaagcatctgcaggacctgtcctggagaaatctccagagctcggacaatgaattctgaaggcactggggagcccagaccggcag

SEQ ID NO: 619803 - DNA, 168 bp, Homo sapiens
  misc_feature (150)..(150): n is a, c, g, or t
  misc_feature (153)..(153): n is a, c, g, or t
tttaagtccctggggggcccccttggggggccccccgctcccaggttcccctttggtgttatgtcaggctttttgcaaggaaaacccccttggggaaaaatggaaaaggccaaaaaaaattaataaatttccattggccctggggtgagntgngggtttttgcaagga

SEQ ID NO: 619804 - DNA, 1287 bp, Homo sapiens
cgcagctggctcacgtccgtaatcccgagattttgggaggccgaggtgcgtggatcgcttgagggtccggatttcgagatcagctgggcatagagggtcaaaactccctcgtctctatctaataagatacagaagaaacaattagctgggctgtggctggcaatgctgtctaataatcccagggcactacaggcagtgctggaggcgagggagaacctgctgggaaccccatggatggcacgagaaggcaatgcagatcacggtcgaggatcactgcctagcatccaacttcacaggccgtcgggccgactagtggcacagtgatgacttcgtcagagagaactaggataatggtggcctttacttacaagcctctcgcgagattatcatacgtgtcacaggggacatttgtagggctagagctccatacgctgtgtggcccctgcaaacgccgtcgcatttaacggtgtacacaacaggttctgtaaacagcagcccgccacttcccgtgtgggataatctaggggggcttaagtaagtgatcacgcataatttccccattgcgtgaattgtggacatgtaagctacgagggcactgtaagagggcaacacacgagagctacatcggtactacggttggcacatctaagagctcaggagaattgtcacaataataaaaaggtgtggagaaaaaaggtgagagaaaaacgtttggtgattagaacacttaagagtatagtgcccatagaaatttttgaggaaaacaggtgaacccatgcatgatatgtaccgcaaaaggtgatgtaacgtgagacaggataatacaacaaggaaaaggccttatttaattgggcaaagatttcagagtggaaggttgtgtagaattaaaagagcacaacaatatagagtttgtggaagcaaagtgggacaaattaggggaagttagatatgtacaaaagattataaagaacaggtgatgtgcgtcactcagtttggcacaggacagtgtggatagcaaacgtttactcgtgggccatagtgtcttcgcgaactgtcttctgcaactcttggggctgttaaaagaagccaggagaaaccgccaaggtaagtatcctcttgggcggagacgtaagtgacacgagcgtcattgggggcaacaggccaagtcatgcgggtagcccgctttaagcactgttgactatgtatgtgccccgaaggagaaagcacctatacaaggtctgagagcttggtatcttaaaaaatggttggggcagacaatatccatca

SEQ ID NO: 619805 - DNA, 163 bp, Homo sapiens
gcggatttcacacatgcctagcagaccagaacctctcggcagttgctacggacttacgaaggacaaagcgagagctgcactgtgatgtgaatctttcattatctttaatgaggcaaaggatctagtgtaaaaacacagcaaacaaaaggtgaggtctaatgag

SEQ ID NO: 619806 - DNA, 499 bp, Homo sapiens
  misc_feature (460)..(460): n is a, c, g, or t
tcgggctggtgtgcagtggcacgatattggctcactgcaaccttctcctcccaggttcaagtgattctctcgcctcagtctcacgagtagctaggactataggcgctggccactacacccagataattttttccttttttggatttttggtagacacagggtttcaccatttttgccaggctggtctcaaactcctgacctcaagtgatctgctcgccttggcctcccaaagtgctgggattacaggcatgcaccacagtgcccggcctattttcatttttattggaatgaaaaaaatgaactaaatcccttcaaattagaagtgagctccaaagaatcactaatatattattttcttcaacgttttctcaaaaggcaccctcaaggtaagtaatttaaaatgtacctagaacataattttcaactatgtattcaaatcacaggataagttttgtataanaaataagtgttagttttgatcttgagaatgtgctacata

SEQ ID NO: 619807 - DNA, 1170 bp, Homo sapiens
ggcggcgcgcttagttgccggagctgaacggcgcggagctggtctgaggctgagcctgagcctgagctgatgctgctggctggtggggcctgatgagtgactgctgcagtgtggcggctgttgccatgtcgcactggtcacatgccactggctgggggtggctgccgctgcgccgccgaacgggaggatgcctgccctgagcagcgctggcctggcctactggcctgtacctgctgcatcgacttggagctggctgcaatgccttaactgatgatgcctgcgagggcatgcggcctgctggctgtcttcaagccgtgggaggagcggaccgaccgctccaagtttgttgaaagtgatgcagatgaagagcttctgtttaatattccatttacgggcaattgtcaagctcaaaggcatcattataacgggcagaggatgatgactcacagccctctgagatgagactgtacaagaatattccacagatgtcctttgatgatacagaaagggagccagatcagacctttagtctgaaccgggatcttacaggagaattagagtatgctacaaaaatttctcggtttttcaaatgtctatcatctctcaattcatatttcagaaaagttcggagcagatacgacaaaggtctttatattggctgagaggaggagtggacttgagcttcgccgaaacgaggtgaccatctgcaattacgaagcatctgccaaaccagcaagacataggggtcatcaggttgcccagagaacactttatttctacaggctggccaagtgtccatagaggagctgtgtcagtcgaagtgtacgagtacctgtgggaaggagagaggggatgagtgtcaagaagaaagtggttgcacaagccttgcaaggttggcatgggaggagtactgggaaagcgtgagttgggagaaacgaaacactggtagagtttgtgatgaggtgcacgagagacacatggggtataaggagggctgaaaagtattgagaggggcacatgagagagaaggaaaaggagatatcaagaagggagggacacaagagtagtgtggagatgatgtgataaagtcgtgtgtaatgaaaaaggaggagatgagatgcgagagtagagagacgagcgacgtgattgaattgtgttgttttcttataa

SEQ ID NO: 619808 - DNA, 185 bp, Homo sapiens
attagtttccaaggccgataacgattcttccttctctgtggtgccaacgccttgcgtgaatttagacaggcataaaactagaaatgctgaaaaaaaaaacgacttcaaaggcatattaggacgtcccaagtaacgaacggtctacaattgactattctatagaacgcgctaaaatctcagccaag

SEQ ID NO: 619809 - DNA, 494 bp, Homo sapiens
  misc_feature (43)..(43): n is a, c, g, or t
  misc_feature (46)..(46): n is a, c, g, or t
  misc_feature (460)..(460): n is a, c, g, or t
ctgtgtgagcgcctgacccctcgccttcccccgcgggtgcgtnggncatttagcttacaggggcaccctggcactaacccagccctaggcagtggctttatgagtggacccaggaggacaaacgtggcaggcacggccttgcaacctcatgggaagctggctgcagcccggggatccttcctggactctggactggtggctggcaatgggccctgtgggacacagaacccagatgaaagtaggtgggacttcctgtctcgtggcctgcagagtgctgggcctgaggcacttctcagccgcctgtgtcctgagagtgtggatgttgcagtgtcctgagagtgtggatgttgcagtggccaaatcaacccctggtcacacccaagtgctcatgctcagctcttgccctgccattaggaagctggacaagctggttaggaaagggcaatcttttaggtctttnttaagaattaaagaagatctgtaatttttatttt

SEQ ID NO: 619810 - DNA, 399 bp, Homo sapiens
  misc_feature (239)..(239): n is a, c, g, or t
ttttggccctgtccctgccctggggtccaacaggtcatccctccctttttttctctcctttggcggttggtcccggaggcacttggggtaatctccccctagcttcaagctgtacatagggcctcccagtgcaaatcctcctgcccataccgtgcacccttaaaagcctgggtgtgcataaagcgccccctactttcccagttaactcccacgttttctttccctgaagcttggtattntgtctatgtgcccacttctgacttttaaggtgggcacgttagggaagcacagcccccgcgcctgccttgcttccctgtcccccgaaatgtgtctgtttctttttgaaagtaaaatatacataatataaataaaaatgtataaatactgctttggttttga

SEQ ID NO: 619811 - DNA, 992 bp, Homo sapiens
agagactcttcagatcctggatctctcaaatcggcttttacaccctgatcccccacgacttggggatgaacaagcctccggtcctgaacaatgcagacagcgtgcaggccaaggtggaaatgcttgacaacctgctggacatcgaggtggcctacagtctgctcaggggagggtctgatgatagcagcaaggatcccatcgatgtcaactatgagaagctcaaaactgacattgaaggtggttgacagagtattctgtagagaagccgagatcatcaggaagtatgttagagaactactcatgcaaccatcagcacaagtgcgtatgacttgtgaaagtcatcgagtaatctttaaggatagagcgtgaaggcgacctgccagcgtggacaagcccttttaagcagcttcataaccgaagattgctgtgtcacgggtccaggatcaccaatctttgctgggactcctgtcccagggttcttcggatagtgcccgcctgaagtcgcccgtgacagtgctacatgttggtaaagggatctatttcgtctgacatggtctccaagagtgccaagtactgcatacgtctcagggagaaccaataggccttgatcctgtgggagaagttgcccttggtaaacatgtatgaactgaagcacgcttcacattatagcaagtaaaccgaaggatctagcacaggtggtccaaacggtttgggggcagaacctaccccctgatccttcagctaaccttaatcctggatggtggtagacgttcctcttgggaccgggattccatctgctgtgattgaacaccgctctaatctataacaaagaacctgtcttgaaataggcccggaaactcgaacatctgtggaacgaatcattaggacacccgggatatggaagacccaacccgagcaggataataccaaagatgtgacaaaaggcgcagagcagtgctacacaaaccacaaggaaaaacaggctcaaaaga

SEQ ID NO: 619812 - DNA, 298 bp, Homo sapiens
ctgcatgtgggcatctgttgtggacataaagggaggtacagctaggcttttttttttaagttggggttctggtttttttacccaggctggagtgcagtggcacaatctcagctcactgcaacctccgcctctgggactcgagcaattctcctgcctcgacctccctagtagctgggattgcaggtgcccgccaccacgcccggctaattttttgtatttttggtagagacgggatttcaccatgttggccagcctagtctcgaactcctgacctcaggtgatccacctgcctcagtct

SEQ ID NO: 619813 - DNA, 993 bp, Homo sapiens
aaagcttcttgtagttgcttcctttattcagaaaagaacatgcgataccacggtatatcatttgctcttcattaaagaacagtttttctaaatgttgggggaaatgtgcatagtcattactcagtcaaaaagttgtgttctcatgagcctaaaggatccattctagatttttattatcgtgttatatattgtgtgtgtgttgtgtgttgtgtgttgtagtttccgatagaatattgcatatggtaacatttttttccctcttaggtaattcagaggcgactctccagcactaataggaagataaacactcgcattgtaaacccatatgtctctttgagaatcgctctactctatctctcctaacatgtaaatactataggatgatcagtcactcgttgcatagtttgatggtggacacagagttgtacggtagaaaaaggctatacactatgtcaaatagctgcatcaccatatgtgacatttcgtagacatacgtgcaccaactctcttagagatgggcgtatcgatcattacacatagatgctcatcattacatccgctagcggcttaagatttggtgaacatactcttcctatcatatgggagagagacatttctatctacggtgctccatcaccagactgagagtttctctcatcatcaccagcatgtgagggaataaattaacaaaaaactgaataaggcgtcgttcttacagcttcagccttaccgtaactactacaagttgacaagttgcctcacctttcataccatggattttcctctcagagggggtcagtctcgctttgaggcatacaaatgttaggaactttcacgtggtaggcgacacatctggtaataaaccaggtcttttggatgaactcgcgatgttgtggaggaaatgtggctccatttgaaaaccctaaaacatgatggttgagatgtgtcgtggcgcccctttaagagaccatgggttggtaaaaacactggcgg

SEQ ID NO: 619814 - DNA, 457 bp, Homo sapiens
gcacgtgtcttttattagagcatcagaccctctcccgatacaggaactctgaggtcaacttgctatgacttatactaggaaactgcaaaccaatagcacgaaattctgctcgtctccttagtactgcctacaatcaaatcaattttatttcgaaaggcaatacagtagtgcatacgaaaaagtgaaaacagaacctgtcccatggaactggaggaacagcagtgtgccgacggtcatatagcactcaacagttaagtccaaaccattcggttcagagttagcttatccccatttaggcaatcagttcgtcacaaatcttggtgagtgcttctatttctttattcttctgctcccagcgtcctttccagggcgtcccactcgcagctgctccttccggaggctggcctggtgggcggattgctccttgcttggccttgccatatgcaagggtaccgag

SEQ ID NO: 619815 - DNA, 271 bp, Homo sapiens
  misc_feature (22)..(22): n is a, c, g, or t
  misc_feature (29)..(29): n is a, c, g, or t
  misc_feature (41)..(41): n is a, c, g, or t
  misc_feature (83)..(83): n is a, c, g, or t
  misc_feature (101)..(101): n is a, c, g, or t
  misc_feature (145)..(145): n is a, c, g, or t
  misc_feature (242)..(242): n is a, c, g, or t
  misc_feature (245)..(245): n is a, c, g, or t
gacatctagaggaccccgaaancctaatnacgggcaaggtnatgtgctgggataatgaacagactagagatgtcagatgattnattagctgagtacagtgnttgtcatatagcagggtggtcagtagatatttgctgaataaaanaatgaatatactgacttggataaaagttattctatattctcttcctccaaggtaatagaaatagcactggctgtctcttcattagacagcattagcnganaggtcatcgaggcgtacttagggttt

SEQ ID NO: 619816 - DNA, 226 bp, Homo sapiens
caacgcatgtgccgctcccctgttccgagatggtctgctgctccgccggagcctgggtgatctggccatcgtccctgctgcgtttacctgacagccccggattctctagcttggcagcctcttggatcgctgctggacagtcgcctcggaagcctccttctcctgaaccttctgagcctcgatctcggcgaagacatcgaccttctccggagcggcacatccgttg

SEQ ID NO: 619817 - DNA, 395 bp, Homo sapiens
agaaacagaatcccagctgggcgtggtggctcacacctgtaatcctagcactctaggaggttgaggtgggagggtcgcttgagcccaggagttcgagaccagcctgggcaacatggagagaccctgttgctacaaaaaaattttaaaaattagctgggcatggtggtgtgtgcctgtagtcccagctactgggtggagatggaaagatggcttgagcccaggaagttgaagctgcagtgagccgtgtgtgcgccagtgcatggcagactgggtgacagagtaagagcctgtctaaaaaaaaaaataagggaaaataagggaaaaaagaagggaaacagaaccccatctctaccccagaagtccgtcaggtgtgctagtcgtagtaacacatatcg

SEQ ID NO: 619818 - DNA, 347 bp, Homo sapiens
  misc_feature (43)..(43): n is a, c, g, or t
atttgtattgggtatttttttttaattataaaggaaacaaaangttcattgttaagaacctcaggccgggcacggtggctcaagcctgtaatcccagcactttgggaggcctaggcgggcggatcatgaggtcaggagatcgagaccatcctggctaacacggtgaaaccccgtctctactaaaaatacaaaaaattaactggacgtggtggtgggtgcctgtagtcccagctacttgggaggctgagacaggagaatggcatgaacccgggaggcggagcttgcagtgagccgagatcgcgccactgcactccagcctgggcaacagagcaagactccgtctcaag

SEQ ID NO: 619819 - DNA, 289 bp, Homo sapiens
gagtgcagtggcacaatctatggctcactacagcctccgcctcctggttcaagcgattcttgtgcctcagcctctggagtacttgggactacaggcatgtgcaccacacctgggtaatttttgtacttttttaaatagagatggggtttctctatattggccaggctggtctcaaactcctgacctcaagtgatcctcccactttggcctcccaaagtgctgggattaacaggcatgagctatagcacctaggccttttgttccttttctttagttttacaatctttat

SEQ ID NO: 619820 - DNA, 145 bp, Homo sapiens
cttacacaatagcttttattagtaaagatacctctttacggactccactttatgactccctaaaggccctattgtcgaaggccccctatcgtctgggtcaatagtatcttgccgcgtactctctaaaactaggccgctctatggt

SEQ ID NO: 619821 - DNA, 476 bp, Homo sapiens
aaccacataagaacggctagaaataaaccgaacagaattgcaatggcagaattgacaactggcttaccatttcagctgttcaaggcctgactggtctacctgcacttcctagtaagatgactcacggtaccattacagaattatctcacgctagggtcaaacctgatttctaccaccgagtgtgtggtagaggcatgtttctcagaacccagagccaagataaggaacagtctccaattccctgttctctcccctccctccttcacccttcattccaggcaagtctcctaggcaagtgtgtcccatcctcatcctcttttttttttttttttttcttttttcgcccaggggtctttttttggagggtaccgatggccactgagacgttcacaaaggacaaaaaattttatttctccccccccccagggtctccttggtccccctgttttcccgattcccacagagggtgattgtca

SEQ ID NO: 619822 - DNA, 134 bp, Homo sapiens
atgctagaggcgttagacaacaagctgatcttggtaactgactcttggcattatattctccagacaatcaccatgacgacgtaaacatgaaactttatttttcctagaacaatccagttgagtggcgaattcca

SEQ ID NO: 619823 - DNA, 885 bp, Homo sapiens
gctcttactcctttggaaccgcggctgggcagaacggctgatcgagcccctcaccaattctgcatccacagcgacgtctggcagtgtctctcctctatgaagtgtgtgaacagacggatagcaggctcatctcgctgtcctccggaccatgcccaatccacagtcgccgagctatccgaagacttagtgttcagaaattaaggatatagatcgaggactccgatcagaacttgaagatacctggggctgctaggcgatgtccaagatcctgagagatcccatcccaagtccgtgcagtcccacaaggacctcatcctgcagtgcctggacgcacgaggacgagtgcatccggctgcgggccctggagcctgctctatgggatggtgtccagagaagaactctgatggcacgtatgcgtgaagaagctgtatgatcccacgtagacaaggctacgtagggtaccatctaccgtgacgagctgtcagcatgatcattgacatctgccagagcagtgccatatacgcagtacatcaccaactacgagtggtacgatcagcatcctggtggtgctgaccggtggagggcacagggacggccaactcatcgggcgccaaatagctggactgtggccatccgcgtgaaaggcatccgcaagtgcgccggtcccagatgtctgcgcggttgacagtgcacacctggtggccagcagcacccaagcggaagggatctgggaaggtgagtagctggcggctggatgctgggggaagctcaagaagcctttgggggaacgcaccacaattggggggctggggggcacaggcccagtgcaagcaaaccggcgggtttggaaagggggaggccggccagctgagggaaggcaccgga

SEQ ID NO: 619824 - DNA, 462 bp, Homo sapiens
  misc_feature (131)..(131): n is a, c, g, or t
tgtctatttctaaggaccagctgtagactttctcagaggagcatcctgtgctcctgactgaggcgcctttataacccatcgaaaaagaccgggaacgagctgtcgaagtatttctttcgaagaccttcaantgtgcccagctcttttcatctctcatgcaatgcgtgtacgtcacgcctttactgctaccgagggcaggaccagcagggggtggtgctggacttctaggaggatggatgatcacgccatgtctgtgcgccactctatcgagggctattgccagtgtccccactccatcatgcgcatcgacatcgcgggccgggacgtctctcggcttcctgacgcctgctacctgcgtaaggagaggctacagatgttccactcatcctctgagatttgagattgtcaaggaccagtacgagaacgagcctgttacctatccataaatccccaaaaggatga

SEQ ID NO: 619825 - DNA, 285 bp, Homo sapiens
  misc_feature (20)..(20): n is a, c, g, or t
  misc_feature (75)..(75): n is a, c, g, or t
  misc_feature (134)..(134): n is a, c, g, or t
  misc_feature (136)..(136): n is a, c, g, or t
  misc_feature (141)..(141): n is a, c, g, or t
  misc_feature (170)..(170): n is a, c, g, or t
  misc_feature (247)..(248): n is a, c, g, or t
cggtaactaccccggctgcncacagctcggcgctccattcccgctccctcacacaccggcctcagccgcaccggnagtagaagatggtgaaagaacaacttactacgattgtttttggggggtcaacccaatgntnctcgnggaagaatttgaaaaaggcttataggaancttggcctttgaagtaccatcctgataagaacccaaatgaaggagagaagtttaaacagatttctcaagcttacgannttcgtctctgatgcaaagaaaaggggaattatatgac

SEQ ID NO: 619826 - DNA, 996 bp, Homo sapiens
cggggtgaagatggcggccttctccgagatgggtgtaatgccatgagcattgcacaagctagtggcacagcagatggcattggctccatccacaactgcatcatcccaggcgtgaatctcatcacccactagcatcttcaggcaggcaggtgcatagtaactttataggctgcagcaacaccaggcacagtggccactaacactggctgcttattaggtcatatcccagcttcatcccagcatcagctttcatgcacacactcgtgcacaagcaccgacacgcaggccacaggccacaacacacaggcaaacacaccaaccacattcaacaactagggtgcgttcagctgcatgcaacacagatggcgcagatgcacacccaatcatgcacagcaggcatcgtggcattcttttgccaaaattaggggatccagcatgggtccttgtgtggaggtccaaccagccaggagcagaggtcaacaggggacatgaggcaatgggcgatggtaagaagcctcaactaacaggcgcatttgacatgcaacacaggggcaaacgacgttacttcatggaacagtatcacttgatccaatggcaacccaacaggggggtttacattgccaagcgggactacgagcgaatgagattcctcaccccaactggacaaaggggaccaatcacttcatcggggacgcacattagcgggttaacgtcggaaccaaacgggatacacgggaaatctccggggcccatatagcggctgggcacaaccaaggggaaccacaggaaacagatgtaggcccaagtaaaaggaagaaagacaaacctttgtggaagtcacaagattatagtgggggcaggaagggggaacagttccgacgtataggtgggccagtggaagttaagcccaaatttggtgggaaactggaattgacaccgatgggcagttaattaggaagtacaaggggggacagttgggttcaagaatgtacttag

SEQ ID NO: 619827 - DNA, 249 bp, Homo sapiens
  misc_feature (34)..(34): n is a, c, g, or t
  misc_feature (106)..(106): n is a, c, g, or t
  misc_feature (118)..(118): n is a, c, g, or t
  misc_feature (151)..(151): n is a, c, g, or t
cccatatacaattttaacatttctaatatatttnaaacaagtgaagttaatatgcatccaaaatatttcaacctgtaatcaacataaaattttaatgagatatttnatattatttttnggtactgaatcttcaaaatccagagtgtatttnacacttaccgcacatctccattcagactagtcacatttttaagtgctcagtagccacatgtggctggtggctactggattagacagcacgagtctgga

SEQ ID NO: 619828 - DNA, 383 bp, Homo sapiens
ttgttatcagtaataaagcagagacatgacattactccaggcgtgaagtacagtggtgcaaccacatgcgcacaggtgatcctcccacctcagcctcccaagtagccggaaccacaggcgtgaacaccatgcctagctaatttttaaaattttttataaagacggggtctcaccatgtttcccaggctggtcttgaactcctggccttaagcaatcttcctgactctgcctcccaaagtgctgagattataagtgtgagccactggaaccagccaatcttgcttgtttctagcaaaactggtcagcctcacctacagtgatcaaaataggtaaaagtaggggccacttttcgtaaggagggaaagaaagcattgtctttcagt

SEQ ID NO: 619829 - DNA, 118 bp, Homo sapiens
cgcaagttctgcaggtagaaactgaaacgctgcaagcggaacgcaactcccgatcgaaatccatcggcgcggccaaagcgcgtggggaagacatcgagccgctgcgtcgcgaagtgaa

SEQ ID NO: 619830 - DNA, 180 bp, Homo sapiens
tcggtagtgtctgtgtgtctgcgtcgtgtctgtagacgtcgcctgtccgggtggctggagctgggtctgacccgttgtatggtttgacctgatatactcgattctcccctggcgcctcctcctctggtgttctctccatgtccccctcccaactccccatgcgcagttcttactcgtaca

SEQ ID NO: 619831 - DNA, 775 bp, Homo sapiens
aactcccaaagttggtggtccccgcatacataaaacgggggggcccgttatattgacattctagacagagatccctcacaggcgcactttatcccgcggtaggtaaatttactagggggattttattagggggagacattttaccgcgaggggcgagaaccgcattaggtagaggagttgtagtgcgcggagtatactacacaggagtctagtactactcatacctcgcggggggactcaacgccacatatacacaccacactcgtcgcgggggtggaccacacggcggcgcggcgcccccccataggaaggtggccccccagcagacaccttatcagggggccccaccgcggcccgcgctggggggggcacccaccacccccggggacggaatggcgcacgcccccctctctggggggaaggcccccacgggggcgcgcggggcgacatccgcgcgcagagccctctcaccgcgggagggattcacccacacccctctcccgctcgtggccacacacacaccccgggggaaaaaccccaaccgtgtctcctgggcaaaaccggcaacaatgagcctcggtgcgctcgccagggcgaacgtcactcgggagactcgacgcaccgggaccgacgtcggcgggaagggccacgggaggaatacaagggcttgacaccacgaggcacgtggagggtgccacctgcagccccagcctggcccaccagagccaccacctcggtccaccacagagaaggaaaccccgtctcacataaacgc

SEQ ID NO: 619832 - DNA, 238 bp, Homo sapiens
caggttcgcggtagcaggattgtctcgatttcctactcgtgatccgcccgctcggcctcccaaacgtggtgggattacatggcgtgagccattgactccggcaatatattttatgtttcagtagagacggggttatgccatgttatccagaatggtcttgaagtcctgatctcaagcaatctgttcgtcttatcctcccaaagtgctggtattacagctgtgaggcattgcactccgg

SEQ ID NO: 619833 - DNA, 684 bp, Homo sapiens
gttatttcaaaaataaagatcactctggagggtttcatgcagacatttaaatgctatggcccagaaatgccatacatcatatggcctcacaaagaattaaccaggattagttgtgtggctccaaagaatcatgacaagaaggtcggatagtgcagcctatcttgtacccaacagtagagagctgtggtacacaattctgcagactactgctactggtagtaatccttgtccatatgataacctgccagctaaacagtctcttcctgtagctttatggcccaagtcttccattttttagggcaaactgccagagtagccaccagcttagagggaaacattgttatcaggggaacccgcccccaatatttcaacatagattctttatattttccctaagtgtcggccagtctgagcaataaagagaaagaatacaaagagaagaattttacagctgggccgctggggatgacatcacatatcagtagatccgtgatgcccacctgagctgcaaaaacctgcagtttttattagggatttcaaaaggtgaaggtgtgtatgaacagggagttggtacaaagatcacttgcttcaaaggctgcagagcaaagatcacatgcttctgagggaaccaggccagggcacaaatcggaactcctgtaggctctatattcggtgccgttttgc

SEQ ID NO: 619834 - DNA, 256 bp, Homo sapiens
ctgcggtgattctagaggatcccgatacccacctgagttcatttctatcgattgggcaccaacagtgaggtgaagcaactctaaggaggtttgaggttcaggcacaccagtctcagggtgtcctctccacacccctcagtgtggtatcctaaagatctttatggctgtctctgagtcttatgctgcctccggccttgatgatttctgatgctttttttattcctttatttccgtggtcattagcaggtgggtacgt

SEQ ID NO: 619835 - DNA, 497 bp, Homo sapiens
ggcggacattctgactgagcgtgcctaccgcatggagaagctcccgcggtcctacaagaacatctgtctgggctttaagacacccaaggaggctattgagggcacctacattgacaggacttgcccgttcagtgatactgtgttcatatcggggcggatcctctgtggcggggtgaccaagatgaagatgcagaggaccattgtcatccgccgagactatctgcactacattctgatgtacgaccgtttctagaagctgccacaagaacatgtctgtacacctgtccgactgcttcaaggacgtccagatcggtgacatcgtcacattggccgagtgcactactctgagcacgacagtgcgctttaacgtgctcaaggtcaccaatgctgccggcaccacgaagcagtttcagaagttctgatgctgtacatcggtccgctcatcacattgaaatagagttatttgctcattcccagtaagctactaaactgatgta

SEQ ID NO: 619836 - DNA, 1380 bp, Homo sapiens
cttcaccagtcgctccaccttctccaccaactaccgtgtccctgggctctgtccatgtctggcccagtctacggcgcccgggtccgtgctcgagtcacgctgcggccagcgtctattcaggcgctggggtgctctgagttcccgcgagtctccgtgtcccgcatccatcaggctatcagtggagcaggtatcggagtgtcccgtgcgtggcctgttgccaccgggaatacgccgggggtctgtcctgactgggaaggcactcccaggcaatcgagaatcggacgactcactgtcaaagctcttagacgacccgctcatggaccttcttatcccgtggtacacgagttgatgagatgcctggcagacctcgagaacgcagagaaggccgtggaagatgccatagagagttcctgggtacctactctgcgaggataggacatgggtaccccccagtgttccatgcagacttgcgacgccaatttacgttcaaaaggactcaatcggaggggaaccctgagaggcctccaggagtctttctgccaccattacctggtgcgaacaactgcccctgcattcggtttcctgccacgaatttgaccaattgcccacagatcctatgcttggctttgagtcagcaccttttcacggagacgtcaacagttaatttcacgcaccaccgcatgcctagcgccatttggcgcccaagtgacctttgtgagtgagagacacaccgacccattcccaattgaggactcccccgccaaacatggttccaattcgcattcgaccaccaccacaattatttccaccagcggacgttggcttagccttgcggaccgaaacacggatgcacttcggaaggggcctcccttccaacggggaggagacatgccacagcttcctctctgctgacaagtgaacacgaaacagcgcaacgacacacggcagtgcaacaggttacaacaacagggcccattcaccagaggcccccacagaaattttggcccgatgacattcttggggggtttttgtatccgcggttgggcacgagcttaagaaatggtccccccccgagaatttcatccactgcgaaacccctccgacgccaaaggcattccacttggcgcaacaagcaattcccggagagcccccaaatctatcggcctccggagaccttgggtcttccggctcaaacgtcaccaccccggacggcatgggaaggccgtaagagaaccacacaggtactcgtgggggttcttccacagccgagcaagtttggacggaagcaaacacacccaagacagtgttgggtcacccccacaacacaggtctctcgctagacgcgtctggcaaggccctggctcgcagacaacgacatca

SEQ ID NO: 619837 - DNA, 133 bp, Homo sapiens
actacccgtgccataagttttctgatttacgttcttagtatatcgtctctgagagcattatcatgtctctctcatatacatcgaggcaacactcactactatcatcgcgatatctaggcaacaatgcctggtt

SEQ ID NO: 619838 - DNA, 687 bp, Homo sapiens
  misc_feature (126)..(126): n is a, c, g, or t
  misc_feature (132)..(132): n is a, c, g, or t
  misc_feature (453)..(453): n is a, c, g, or t
  misc_feature (485)..(485): n is a, c, g, or t
  misc_feature (539)..(539): n is a, c, g, or t
gaagaggagcagcacttcaggaggttagcagtcttgttacaccttttctagctgtacatcccatcccaggagcgaagacagtccctgggagtcagcgacagctcagacagaatcgctgctaccagnagaccnagacacattccaccccagtggggcgctcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggcagctgtggaggacagcaaagccaagtggactcaacggagaggccagcaagtctcaggaaatggtgcactntggtgaaccaaggagtcgtcagaaactccagnccatgtttatgacagctgatgagacaaggaacctgcagaatgtggacattgaantggggtgtaactctaaccccattatattgcaaagacacaacagttgccatcataaccattacagggaagtggtacagctcccacatacaatgaggggtagagtgtttcattataaatttttttcagcataaaatttttttctctttta

SEQ ID NO: 619839 - DNA, 302 bp, Homo sapiens
  misc_feature (211)..(211): n is a, c, g, or t
cgcaatgaagacatagtcacgtaacaactctgtataagcttttctggtttatctgaaaactggcaattctttccttttataaggtctaattaaacatggaaagtggcatatgtactctttgagtgttccctcatttccatcaactactttccacagtggacacaggcttgaccttaggggctgatatggagccccactcctggtgtactgnttgggctcattttcttgggcagcagagggtataggctacggctagttggatcaggaggaaaggtgcctgatgatattggggtggaatctca

SEQ ID NO: 619840 - DNA, 628 bp, Homo sapiens
  misc_feature (394)..(394): n is a, c, g, or t
  misc_feature (426)..(426): n is a, c, g, or t
  misc_feature (480)..(480): n is a, c, g, or t
ccaaaaaacgcacttaggcattgcacacacatccacacgcatcctctcacttcatcagtgcactataactgagcttcaggggtgagaggatcggtgcgctcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggcagctgtggaggacagcaaagccaagtggactcaacggagaggccagcaagtctcaggaaatggtgcactntggtgaaccaaggagtcgtcagaaactccagnccatgtttatgacagctgatgagacaaggaacctgcagaatgtggacattgaantggggtgtaactctaaccccattatattgcaaagacacaacagttgccatcataaccattacagggaagtggtacagctcccacatacaatgaggggtagagtgtttcattataaatttttttcagcataaaatttttttctctttta

SEQ ID NO: 619841 - DNA, 466 bp, Homo sapiens
  misc_feature (85)..(85): n is a, c, g, or t
cgtggggcccaaaaccccccctttccaagggggcgcacttcgcgcaaccctttccctttgggtgttaccccaaaaaatttttttnaaaccctttcttccttttcaaaggagggaggtggcccccccttggggggtttaaaaatcccaaattttttgggggggggggaaaattcccccacaaaattttttggggttttcccttttttccccttccaaaaaggttttaaaaaaaattcttcccccccggggtttccccaccccttccccaaacccagggaaagggggggggtttatttttcgggccaaaaaaaccggggcctttgaaagggccccaatttcccccccccttttgggggtttttcccggggggttttgagagggggcaaatttttccccccccccccttccccctaaaaaaaaaaaagttttttaatttttttttttttaaccatttttgggccgtcca

SEQ ID NO: 619842 - DNA, 619 bp, Homo sapiens
atcggatcattgagacctgggtaaggtctaggttcatgagtagatcacggcgattaatctatataaagtactctagttacctatctgtgagcaaagcccttcatgttaaaaggtggtaggctttaaacacataaagcaaaacatgtccaattcttgattatgaggtataaagctgcaattaaattatccagccatcagcttgtaggatattggaagcttagttgattgatccttaaaggttttataaataaatcagaataaatccaatgttacaagatttgattcagacaccttacagatttctagagaggctaagtaaaatactatataacctttaaaccagccagtcctggggtttactcggaaaacagtatttctccaaccattttttaacccacaatcttttatactaaatatggaaattttaccctactgagagattcagagtccctaaggtggctgtcctgcatagagaatcatatattctaattagccccagtagccaagaaaatgctgtctaccttaactttctgaagtctgtaattctttttatttcaggtgggatatggtttacaaaacatactctcaataacaaaagatataacatttccaagagtga

SEQ ID NO: 619843 - DNA, 889 bp, Homo sapiens
  misc_feature (328)..(328): n is a, c, g, or t
  misc_feature (334)..(334): n is a, c, g, or t
  misc_feature (655)..(655): n is a, c, g, or t
  misc_feature (687)..(687): n is a, c, g, or t
  misc_feature (741)..(741): n is a, c, g, or t
ggaccgggacaggacctctggcaatgaccacgcagcagagtaattctcagagcttctggacagcacaggaaggcttggaagaagatagagaccatccgaccactggtactcggacatcaagccataggaatgatgtcacaggtggaagaagagaccccgatcgttctgaaggctcaactactgtactggaagggtatacctctcattacccacacgcgaaggaaagccggaccttcatcccagtgacctcagctaagactgggtcctgtggagttactgcagttactgttggagattcccactctaatgtcaatcgttccttatcagnagaccnagacacattccaccccagtggggcgctcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggcagctgtggaggacagcaaagccaagtggactcaacggagaggccagcaagtctcaggaaatggtgcactntggtgaaccaaggagtcgtcagaaactccagnccatgtttatgacagctgatgagacaaggaacctgcagaatgtggacattgaantggggtgtaactctaaccccattatattgcaaagacacaacagttgccatcataaccattacagggaagtggtacagctcccacatacaatgaggggtagagtgtttcattataaatttttttcagcataaaatttttttctctttta

SEQ ID NO: 619844 - DNA, 267 bp, Homo sapiens
  misc_feature (168)..(168): n is a, c, g, or t
gatgataaacccttattcgatcaaccctctctccctaaggaggcctgcccccgttaaccggctttttgcccaaattgggccatttattcgaagaatttcacaaaaaacaattagccttcattcattccccacccattcgattagccatccatctcacccttccttggncttaagcttgggtggattccttcttagaagtctcgacctgtgcagtgcattgcatatgctttggtcgcttggcccgtctcgttttaccaaccgttcgtt

SEQ ID NO: 619845 - DNA, 115 bp, Homo sapiens
acctgactccggcctcaaagctcgaggcttgactgtcacggggctgtgtcctcgggtccgggactctccctcccccaggcagtgtctggtctgggatgctgtcactccggcatga

SEQ ID NO: 619846 - DNA, 301 bp, Homo sapiens
  misc_feature (37)..(37): n is a, c, g, or t
  misc_feature (103)..(103): n is a, c, g, or t
  misc_feature (137)..(137): n is a, c, g, or t
  misc_feature (140)..(140): n is a, c, g, or t
  misc_feature (146)..(146): n is a, c, g, or t
  misc_feature (177)..(177): n is a, c, g, or t
  misc_feature (182)..(182): n is a, c, g, or t
  misc_feature (188)..(188): n is a, c, g, or t
  misc_feature (197)..(197): n is a, c, g, or t
  misc_feature (199)..(199): n is a, c, g, or t
  misc_feature (285)..(285): n is a, c, g, or t
  misc_feature (289)..(289): n is a, c, g, or t
ggggggctggactcaggtgcccccgtaggtgcaaaancaacatccacatctcactcctcccggtgctttttgcggtattcctgcagcgctttctccgccacgntttccataaatttagggttcttcttggagacttntanaggganggtcacagtgatgggatcagagtaaaagagnttcangaccanctcagtganancggaaggaacgtccgagtcagaagtgtgggaagccaccgtggtgacccgcagatagtactggtcttcgccttgcgtgaggtttgcnagcngggacatccagt

SEQ ID NO: 619847 - DNA, 677 bp, Homo sapiens
  misc_feature (513)..(513): n is a, c, g, or t
ggagagagagaactagtctcgagtttgggttttttttttttggtttaaaatccggtaaatgggaatgactcatcatcgggacagcaattagggatgggccatataggggggacagggaaaaaggaggggaggcaggggaggcaaggctctggcggggcttgtggacttgatacccagggcccgggccacacttgcttggaagaggaaggggtaggacgggggcagggtgacagtaggtatgctcgggggtgggtggggtgcttggtaagggctgtcgggcttccacttctggttttggagctgatgggccagccagtccaggccttcgtacagccggtccccgttggttggcacaggtggcctgaattgtcccagtcacgggggacagacaggggaatgcaggcccagctggtcgggagactctcagcagggtcaatagcataaggcaagatccggtaggttggcaaaagacaagggaggtacaggaatccgggagctcgtcctcggccaganattctcattcgagctctttcgccggggccctacattaagctcgctcccggatcattggggtgtcagaaccagcagatttttcagacccttgtggggtgtaccggagaagaaggtggtctccaaaagggggtcagaatctggccccgtggccacccaagattcca

SEQ ID NO: 619848 - DNA, 343 bp, Homo sapiens
gcggccgcctactactactactgctcgaattcaagcttctaacgatgtacggggacatgttggccagtagtgtatttagttatttaaggagggctcaatcaacaggtttaaatggtgtgctattcataattattgcaaaaataggccgggcctgtgattccagcactttgggaggccaaggcaggtgaatcacttgaggccgggagtttgagatcagcctggccagcgtggtgaaactccatctctactaaaaataccaaaagtggcgggcgtggtgacaggtgcctctggtcccagctgctcgggaggctgaggcaggagaatcgcttgaacccaagagtcg

SEQ ID NO: 619849 - DNA, 192 bp, Homo sapiens
cctaaaaaagtggtctaaatgattaacgtgcccacagccgctgcccagtcccctcacacactccctcattcacagacacacacgcaggaacacactcgcacatgcaaaaacacacaggttcatacacacagactcaacctctcatacacatatgcactcacacacaccaatcatgcactcacacagttatct

SEQ ID NO: 619850 - DNA, 197 bp, Homo sapiens
atcagggatgatccaagaacatctgactgcagaactgacgctctcagtggacagggcatctgtatagcctgagagctgtggcagacacgtcttgtaaacattagattttagtatacgagtgcagtattgcagagtctagaggaattaatgtttccttgattaacatgattttcctggtagaaacatccagggcatgg

SEQ ID NO: 619851 - DNA, 104 bp, Homo sapiens
tgtcaccgtagccccagactgggcagagaaaggaaatggcacatcactcacagctgacagtctagagactcgtcagtgattatatcagagaaggctgtcttccg

SEQ ID NO: 619852 - DNA, 110 bp, Homo sapiens
ttacaacccttttgatgggcccaatgagaacccggaagccgagctgcctctcacggcgggaaagtacctctacgtctatggggacatggatgaggatgggttctatgaag

SEQ ID NO: 619853 - DNA, 307 bp, Homo sapiens
ctgggtaaaattttttttttgttgagacggattttttatgttgcccaggctggtttcaggctcctggggtcaaatggtcctcctgcctcagctttcaaaggcacaggccaagttggaggtttgtcccttgccatcaagcccaacaaaagggtttaaaccctttaatgaaatgactttcataaattggttatgttggtgggcaagttttttaagctggaaattgtaaattcctcctgaaaagttttttcatgcaggttccatgaactaatactccaataaaggatggttttgggggtcaatttttgga

SEQ ID NO: 619854 - DNA, 532 bp, Homo sapiens
ttctagaggatcccgactcatccaacgccgcacatttatttatgtttgttacaactgcatccaggaatcaatatgcctgccgaccgtggtggattagcatcttaatgtgctgctggatatgatttgttagtattttgcgtgaggatttttggtgtctatgtttatcaggatacttagcacaagttttcttttttctttgtatctctgccaggttttggtatcagaatgatgctgacctcatagaatgagttagggagaagtccctcctccttgattttttggaatagttttgttggttttgtaccagctctttcttttatgtctggtagaatttggctgtgaatccgtatgtcccagggctttttcttgttggtagcttattacagaatcaattttagaactcattattggtctgttcaggatttcagtttcttcctggttcaatcttgggagatggtatgcttcctggaatttattctttttttttctaggttttttagtttgtgtgcatagcggcgtgggatgcagtcgg

SEQ ID NO: 619855 - DNA, 1253 bp, Homo sapiens
  misc_feature (108)..(108): n is a, c, g, or t
  misc_feature (349)..(349): n is a, c, g, or t
  misc_feature (509)..(509): n is a, c, g, or t
gcggtgtctaactgctcgctctgttattgctgtagcttgtagagtcgcatcctgcgtggtgcattggtagtgatctgtcctcactgattccggtcggcagatcacgcngggtgttacacaaaacttcctttttaaaggtgcaacccgtcctcaggagttcgccccttggcggcgaacctccgcaattccccaacacctgggttttgtggcccgccccccccttagggtagagggaccccccgggcgcccccggaattcccaagcgcttcccgggacttctttaagccttaaggcccctccgggggaccggggattaaaccaagtgggtcgaaacccaccacgggggtanacaacgctttatggcaccccatttaaggggccctcaatttttaaggggggaacacgcttaatgagagagcacaaatgtttggaacacagaaaaaagccagggcgtgggttaccccgggttccgcgaaatttccccgcggataaaatttcggtcggaaacnccaacggccgtttcacgcggctttggcccctcggggggaaaactctctgggacaacccctctggggcctctttgggaaaggtcttctctgtgagaagatcctccttcacaaaagctcggaggttctgttcgcctctctataagagaatatcttggccccacagtggccccttatagagatatcacagcgagaacccctgagagtgcccacagagagtgaactgcgcacagttgtcacacagggagaagaaagagagaattgttggtcctgaacacaccttggtggcacatccaaaatgcctcggagatccccgttgagcacaccccacaaaccccacacaagggagaggaaagccctggggaaagtggcccacgtgagacttatatggccacaagggtttgagatgccttaaaccccccccaatttcttgtgaagaatggagatggcccagtgcacagcggtgagccttgaaagtgtttgcacatgggcacatgttgtgggagaaatctctgcggtttctcccctgtgagaagcgcttgaattctcctgccaatatatggaggaggctctggaagtcctgctctgtgtggtccacggtcctttccacaccctgagaacttggctccacccacctgagaataatcctcctttggggaaaaggcttggcacacaccaagcacggcttttcaagaaagtgccacgttgatccaatgaataaattaacgagcctatttttctttgcca

SEQ ID NO: 619856 - DNA, 109 bp, Homo sapiens
tcctgacaggctgatgagagttatgaattagattttctattacaatgagatcaacactttaagactactgataaaactaaatttcgtggggatagacagtgagcagtga

SEQ ID NO: 619857 - DNA, 103 bp, Homo sapiens
catggaattgcgattggactcagggtcaggtgaggggtttcggtctctcaggaagttaggccataatttctgcaggttcagtgattaacttggatccagtccc

SEQ ID NO: 619858 - DNA, 462 bp, Homo sapiens
tttatttgtccccctttctctttttcatcgttccaaggtaaacgccttgattgccgtaaaactttaaagcactggtattgcaaggctcccggcctccaccattgggtttttaaaacccgaaaaattgccttggctattcaaaagatttctaatccatggggggtttccttgggctgcccggctggaaaaacttcttaagtgggggcagggtgcggactcttgtttctagggccctgactggacggaagctggaagtaaaaatgggattacactctttgccttatggaggaaggtccaccataataattgtgccccggctgaccttgttgccaccagggtaggcctgcgcacggctcttaaagactttttcaaaggcagggaaaggcagatttttcattttcttttcgatcaaggcaagcttggcatttttttcctaaagtggacatacccgcctaggtaggc

SEQ ID NO: 619859 - DNA, 113 bp, Homo sapiens
ccctcgtccgacggtacccaacaaatggcgaagtcgaatggctatcggttccttgataccatgaattcacttttataaacttcagaaatcacgtctaagtctccataatgctg

SEQ ID NO: 619860 - DNA, 203 bp, Homo sapiens
gtgactctagacgatcccgttctagcctcgccgagtgtagtggctcacgccataatcccagcactttgggaggctattgcttagcgcaggagtttgagactagcctggacaacatagggagaccctgtctccacaaaacttttttaaaaaaatcagtggggtggccgggtgtggtggctcacacctgtaatcccagcactttg

SEQ ID NO: 619861 - DNA, 103 bp, Homo sapiens
accataacgacgctttcataacaccctccgtaacagcgcttcataacagccctcctaacatgcgctcctagtggctaagatggagccaccgcggcgctcgtta

SEQ ID NO: 619862 - DNA, 106 bp, Homo sapiens
tggtactctctctaaatagcctattctaggtaccccacacaagtggaatcatatactagtcctttagtagtctagcttatttcactgagacatacatgtagtcaaa

SEQ ID NO: 619863 - DNA, 244 bp, Homo sapiens
tttctgaattcacgacgcgtttcaccacatagcggttcatgcttggcatatcccatttcggtcacacgtagcaccgttgtctgacctccaaatatcgttcagctgtgagcctggtcgactcttgagcatcctccagtacccgagcatacttgcttgcctgctggtcgatcgtgatattacaaacatctgaggtgcatgtcttccctggacaatgtaccgtcgacgactgtgatgcaccgttgct

SEQ ID NO: 619864 - DNA, 303 bp, Homo sapiens
catgaagcgagacacaagtgacgcctctagaaacgtggttagtgcaactgaggaaggaatatttaatcttatgtgattctaatgggctcacctttaaacagccgcatgtggttactgtatgggctagcacagccctagagcctgacgaaagcaaaccaaagaccaccagctgggtcccaaacagaaggccgcaggggtagaaccatccacctcaactcatccagccccatcagaaggcaccaggaacagggcaagagaacaaggcaaaaacccacccagccacgatgaaagatcactcagtca

SEQ ID NO: 619865 - DNA, 102 bp, Homo sapiens
aatgtcaagtaactataagccctacatgtcagtcaaacataaaaagcattactcaggagaactctgcctaattcaatcagcaaggaagaggaggaattcgcc

SEQ ID NO: 619866 - DNA, 331 bp, Homo sapiens
  misc_feature (16)..(16): n is a, c, g, or t
tcatctgatatggttnggctctgtgtctccacccaaatctcatgttgaattatgatccccagagttggaagtggggcatggagggaggtgactggatcatggggatggtttctaatggtgtagcaccattcccttagtgttgtctcatgatagagttctcatgagatctggttgtttgaaagtgtgtagtgtctcccccttcgctctctctctcctgacagccatgtgaagatgtgtttgcttctccttcaccttccgccatgattgtaagtttcctgaggcctccccaaatgcagaagcctgtgtagcttgcagctatgagccgttcctg

SEQ ID NO: 619867 - DNA, 692 bp, Homo sapiens
taggaaatgaggtccagagcagtgattttttttttccaagagtatttaagtaatttggggttttacagaacccagtactaaaacacaggtcttctgacttttgagcttttggctcttcagctttcccttataaataaatgttgggattaatggattgatgtcaaaaataggtcccttttagtgttggctccttccgactccaggtcagattctttttttaaaatttctttctaaaaaagcttaactcagattcttaatacagattgtcccaaagcacattaggatggtggagttattcttaccaacttcagtctgaattacttttaaatttgtccccaaaggtggtttggacattatgggtttactctgatctttattctcgtgtcttctgaagtcccgtgtaatagatactctaacccaagaaagtgatggctatttagatttcctttggcttacaattctcattcccaaagatgtctcccttgggttgtccaaaaagcttcctgaggtatagtaacttttagaagaggaattaccgctttataatccattggggcccttgagaatggtgctatgtgtggacaggtgtctaggctggtattattccaggttgcatgaaaagcccagaaaccttgatgacagatggtctggttttaaagcattttttacgtaaaatcatcatggtgcaccct

SEQ ID NO: 619868 - DNA, 206 bp, Homo sapiens
gtctgtggttctgtaaatggcatgcctatttgcagcaatcctgagtgctagatttgcatcttggttctctttgctaatgcatattctgctaacgaccactcataaaccacttggccatgaggttcctctttctcttattctttagaggacatatcatgtttgtgcaaatggtgtgccaatctgcacaggtcacggtaacaccacag

SEQ ID NO: 619869 - DNA, 567 bp, Homo sapiens
caacgatggtcctcagcttgtgatcgagagtcaattctcctaataaactccccttcatagattcatctattctacgagtcctgtccctctagagagccccaactaatacaggcactgaggggtgggggagagctccagttctcagctccttcacctgcttctctgtcacagttttgggattcctcatcaccttggtggcacggaagccattacagatgggcaatggccattttaaagtgttctcaaggcggagtgtcctgcagtccatggctgtgagctgttgactggagaggaaggcaagaatgattcttctctgtggtgtgggagtcagatgattttaaaccatccaaagacagaacagctatgttaacagccacataggttgctagatgatattaaatctgtagtcagctagaaaacccagttcttttcatatttaccactgatcaactttagtcacagaagcataggtctgcaattgatacagaaaactcatttcagctgaggaccatcgttcaacgatggtcctcagctgtatttataccactttccagaaacctggtcagt

SEQ ID NO: 619870 - DNA, 414 bp, Homo sapiens
gtgactctcgcaggatttcaggattcgtagatcagttaagggaagatagtcggaggctggctttggctgcgaaaagagacaccaacgaacagagaagagaaggagaaccaggagaacaaagaaggaaactagaagaaatgaagccataaataaagagaactttgaactccaagctgctcaagaaaaaggaaaagcttaaagttgaagatgagcctgaagtcttgacagaacctccaagtgccacaaccactaactaccataggtatattctgcaacctggacaactttgggaggttctcatgggtaaaagaaattataccataactacaaccagttcaaagaggaaaaaccaggaaaaataaaattacttccagaaaacgttcaaattatattttgatgattctacgaaatcct

SEQ ID NO: 619871 - DNA, 749 bp, Homo sapiens
gaactcgggggcggccactgcgcagaccagcacttcgctcgttagtcgtgcgcctcgctctcctgcattcttgctccgcgaaccattgtctggacaaagagccacgatatggcttggagtatcagagagacattctgatcaagtgcgaaactgacacgaagaccagagacgcgacgagaaagagatccgactgcctttccgagaagagaacgagttgagacaaggagatagaaatgcaggcggaatgcgtaactgaggcgtgcagccgtcatatatgcacatgtacattgcccttacatggcattggccttgcttattgtcacgttcttttggagctgtttagcctttgttagatgcacagaggttggatcaagtttaagatgactgtgctgccccgtttcacatctaaagaactacgtgacaacgaaggccgcgcctgccttgtcccatctgtctatctatctggctggctaggggagaggaacaagaactttgcagtgtgggtgaaggacagaagtggggtggcaagaagtggggtgggacgacagtgaaatctagagtaaaaccaagctggcccaaggtgtgcctgcgaggctgtaagtgcagtttaatcagagtggcatgtctctggtggtccaaatggtttaaattatggggatgcccaattttgttaagtttgcaaatagaggttttaatagttaaaaaaacgtgaagataaaatttttttgggggcagggctcgaaaaatta

SEQ ID NO: 619872 - DNA, 286 bp, Homo sapiens
atgctgcggttactctgaggactccccgtggccggaccacgtagtcgtaggttcaccagcgacgccgcgagtcgagagaggagccgcgggcgccgtgatagagcaggaggggccggagtattgggaccggaccacacagatctacaaggcccaggcacagattgaccgagagagcctgcggaacctgcgcggttactacaaccagagcgaggccgggtctcacatcatccagaggatgtatggctgcgaggtggggccctacgtgtccggccacggttaccgagct

SEQ ID NO: 619873 - DNA, 200 bp, Homo sapiens
cattgtatgagcctggactgccagcttctgtattatttaaccagtagcccgtgttaagtctaccacctcttatatctttaccacagaaaacacaaggtcttatagtgatcaggtcattttccccaccacagattactgatacaggtcatatttactcagtttccaactgagattagtatatttgtcatagaaaatatctg

SEQ ID NO: 619874 - DNA, 1034 bp, Homo sapiens
tggggagtcatgtgccccttaataagctgacgccattatcttgaaagggataaagcgggaggattgggtggccccgaatgccgggccggccatgcttaacggggcttgtaggtagatgggaaaactcgcccaggtagtgggccgatcatctcgggcttgatctccaccgggttagaagtgtcttgccgttgtaaacgcccaccatgctggcccaccatctcgggtaggatagatcattgtcccgcaggtgcgtcttcaccaatttccgggcattctccaggggcggggcctccttctggcgccttgccgcaggcgcttccacgcagggagctgctgctttccgccgcaaggccccgggttcacgcctgccgccgcttggccgccgcatctggtcacacgttctgctataagctggctcgaaaggactattgcccagcagtctggcgtacgagtgtccaagccgcgggtaaggtagaacttcgccgaaagggtccgtatactaaccttctggctcctaacttctggccattcttcgccggagaagacgccaggatgcaccaggggggtggcccaggggcccccttgggtgggcccttgcggagtggggaaaacccgcggatgagctcaccgcaggagcgtatacgcaccagggggcaatccggggagcccgagaggcacagcgcgcctgatgagaccgcggcccgggtggcaccgaaggcgcccgcgggacgactccaggcgcgagcggccagggccccgaagggcaaatcaacgggacgactggacatttcgcccccgttataacccaacaaatgttggggcccgcacttgggcctccaaagcggcacgccttgacgtcattcgagggtttccccccggcagcggagcacacactccagaccgtctgttcaccccccgtgggtccctaatgaacggggaccgatccccaacgtcatctcatctgggattccctatctacggggggggggaccctcctctacccaaggcgactgcaagcacgtcgaacaccacct

SEQ ID NO: 619875 - DNA, 291 bp, Homo sapiens
accttcgacgatactcacctaatagatcggaacatctttcgtgtgatgtatggcggctggtacaacagccgtgcacagctgatagtccaccttttacaaccactctaaaaaacctttgggcactatacagacgtcaaggctactttgatgctgcagaaacgttataatgaagctgctatcaggtctcttacacagggtcttgacaatgttcacaaacagagggtggcacaagtgctcaatgaccctaagaacatcgataagcgcaggagccgttagagtctccgtcgaact

SEQ ID NO: 619876 - DNA, 381 bp, Homo sapiens
gatatcacgcttatccacactgctgagtgggttataaagtctaagccattgtaaaatacttaacaagctgcagataccatgtgaacttcgtgtcataattcttgctgcacgtcacgagtgtaaattaaagaaatggtaggactcatattattcagttgtaccccagtatttaaaaatgactctcttaagccttaacaagtcactatgctttgtcctgactgccagcaattatattacattattcattaatgttcattcattcagaaacaaaaatttcaaggcagtcgagcagtcaaagaggcttaattagtttgtgggcagttttcatatgctctgtgaaatgtgtccagatgtgacatagttttttttttttaaatatgg

SEQ ID NO: 619877 - DNA, 309 bp, Homo sapiens
  misc_feature (269)..(269): n is a, c, g, or t
  misc_feature (292)..(292): n is a, c, g, or t
tcggtacccccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaatcgaccccaaggtgagaagatgaangggtttcattttttcttatgagnggaataggtcagcgttg

SEQ ID NO: 619878 - DNA, 1006 bp, Homo sapiens
  misc_feature (115)..(115): n is a, c, g, or t
acagtaggaatagacgtagacacacgagcatatttcaccgtccgctaccataatcatcgctatccccagccgtgcgtcgaaatgtagttatacgctgacgtcgaccacgactccnacggcaacgcaactcatgaagagtgactctgcatgcatgatgcgtcgtgagaccctaggattcatctttcttttcgaccgtaggtggccgtgactggcgttgtagttagcagagactcatcactgagacatcgtgactacgactgacagcgtactacgttggtagctcgacttccactatgtcctatcagataggagcttgtattgtgccatcataggatggcttcattgcagcgtgatttcccctattctcaggctacagcctgagagcctaaaccgttacgccaagaatccatttcagtatcatattcatcggcgtaatagtctaactttctgtgcccacaaggactttcgtcggcctatccggaatgccccgtactgtgactcggactaccccgatgcatactagccagtagtgagacatcctatcatctgtaggctcattcatttctctaacagcagtactattagtaagtctgcagtgagtcgagaaagccgtcgcttcgaagggaaaagtcctaatacgtagaagaaccctccataaacctggaggtgactagtctggatgccgccgccaaccgtgatcacacatttcgaagaagccgtaatacggtaaatctagactagagatgggacggaattcgaaccgccgcaaggtggtttcgaggactaatcgcatgtgctccatggacttgttttatagatgcaagccacaagcttagggttgatagcccacggttggaggccgcatggagcctgacagaaggcttttgggaaccacgttcctttgggaccaggtcccaataagggatatcgaaactcggggccgatagatttcgcacagaaaggccctgcgaggacaaagtgtgggatatctcccacaaaataaggc

SEQ ID NO: 619879 - DNA, 400 bp, Homo sapiens
accagtcctggccagggcagttaccaggacggtctccggaggccgggattcgcggagggtccagcagcaggaagaaaccccaggaggaagaaacctcagacagatcgccggcgaggcagcgcgggatcccagcctcaggcgtgcgcggacggtgtgcgggtgagtctccccaaaagtggagcccttgtgatgacgagcacaggtccgcctgcgtgcccgtgggcggccctctcaccggtggctctcagtcgtggagagcagaacccggcagcttcaggggctgcctgcgggagggtgttccctgctgtacgtgtgtgttcgtcatgggtgtgtgtgtctgtgtgttggggggggtgcgtctgtgtgtgtgtctgtgtgtgtgcgcgcgcagtgcctgtct

SEQ ID NO: 619880 - DNA, 1127 bp, Homo sapiens
cacccccagggtgggccttagcccctggggttgtcccttatagtgaaggaagaagcccctttgtggcgccgccgctttgtggtggaggaagtgtatgcccgcgcttgtgccccgtggggcaaagagggggttcccactatttggtcccccaccaatcatttggggccacacagcactcccctcttgtccccgggtcacaagtccagtgtcctgggagcctgtggcccccgtgcccctctccacgttgggagggttgtctctcgcggcgctctgtggtcaccccccgtggggacactttctctgaagcgttcctgtgtgcccgctgggttctctgtggcccccggggcctccctgtgggcgcacgggtccacctccccccagggcctcactggctttctttagtgggtgcctcccgaggccccccttggtgttgaagaccccacgaaaagaaaggggagaacccaccgaggaaatttggatcccgcggtgcacattttgtcaccaaatcgtccacggggaactccctctgtggagggacccccccgcccccttcctggaggttgcggaatccacggattagcttttccggattttttctcggtggggatattctgggcccactgtaggtgtgttaaccaccgggagcatttcttggggcaacggcgcctttctcacccgctgttcccatgcgctctcctctataggccccaaggtgaatccctggaccacagcgcaccacggccaagaacccagaggtgtatcgggcttcttttcaggcttcacaggacccccggcgaattacggtgcgtcccccatgccggtggagatcgtaattgctgaaaataatgttgggctctgcgccccccctaccaagctttccacagagacactctgtgaaggacccggcaattctggaacgtggtgccgccacagaagcccgcaagcgtaaagaaggaacctgggcctcgcagatagggttctgtggccccagcaccccgcctcccaccctcggccgggcgactgggtcctcccctccagtttcttctttggaacaacccccccctttccccccctcccctgcccccaaacccgtttccaaaaaatttacgtttatttcccccccctta

SEQ ID NO: 619881 - DNA, 975 bp, Homo sapiens
gttctcaccgataaagcacgtaatcgacggtgtgaactcatgttggctggggggcctcccggggcgcgcggagaggctggggtgcgcccacatgcagcatgcttgtgctcaatggcagggtccgtcgttctcgagtgtgcagagggcggtgagagctcaagtctcgttcccacctcccaccgcagatcccccggttgggtgagtggatgccctggactggggatagccaggtgggagtccgtcgctgtgtggactgtggatctcggaagttatgtggactccatgggaggctctcgtcggaattggcaccgcactacttcgtagtccctctcccatagactatgctctgggaagcgcctctgcactccgatcctagacggaaacccttcggggccaggagtttgaaaaccgtggaatgtgaccatgactggtggctagtcgatttgcacggtgactggattacactctctcattcatggtcacttccgaagcgctttagtgccttccgtccctaaaccgcaacagcagaacggttctccccgggttgtcactgatccgcaagggccggaaagggccttcgtttacccgggatcacctctcccctcaatttacctgctaactgtcatccaacttctgtactgggagaaatccctcctcctcgggtgctgccggttccggagtgactcggcagcagaccgagggccggggctgccggtgtcaccggtcagccaatggctgatcttctggagctgaggactcgggaaaacatgcatgaagcaacttgagctgttagagggtgaaatccgagagatatctggaggccaaagcggatacacggtttggaaaccatgagtaacgcgagcaatcgatcattgaagcgacctaggggatggcgcagcacggggttaggcagggccaagttggtttacaagcggtgcaatggaaatggggttaaagtttcagcgtgaaggcgcc

SEQ ID NO: 619882 - DNA, 855 bp, Homo sapiens
ggcccgcttggtgtggagccggtgtccagtggtacacatttggtcgtggagcgaattttgtggtcctggtgctctgcccctgtgtggaaccgacgtcgtctgtgtgggcgcgcccgccatatttttctgcggcggctcgcttttgtatatatggtgcgctgtgggtccccccgggagtctatctcgtggtgattgtcttcctcttcctgtcgtaaggtatttctctcttcaaggagtcgcttgtcgtgatgctggcacctttttgcgtcatcacgccgggagatggttctcccgcggctcgccggtggtgcgccctcggtgtggtgaggttgattgtccctctctctcacccgcggtgtcgacccactctttgtgtgggtaacctcaccacagtgatgtcgccggttccgccatctgtttgtcgtggagtctcttgctcgttttcttcgcgatgcgggccccacacggtgagtctgtcgctctttcgccgcggaggtggtccacgcatctgtgccgcgcgtgggggtgctcagttcgcgagttgcctaaccccgctgtggcccgtgcattctctggtgatttctctctcgtcagcgcggggtgatccccccgagcggtggttttctcgaagtaatgttttgctctcggggaaggaggcgcctctcgcacgcacacattggggtgccaaacgcctcttctcatttctcgggggcacaaattctttgcacagtggtaacattcttgtcgtcgccactgcacgcctgctgtcgggctcggcgccaccactgccccttcacgggacaatgtggggttcattcaaagaaaagctggcacccgttctgtcataacgcaaaa

SEQ ID NO: 619883 - DNA, 347 bp, Homo sapiens
  misc_feature (35)..(35): n is a, c, g, or t
  misc_feature (42)..(43): n is a, c, g, or t
  misc_feature (53)..(53): n is a, c, g, or t
  misc_feature (61)..(61): n is a, c, g, or t
  misc_feature (75)..(75): n is a, c, g, or t
  misc_feature (105)..(105): n is a, c, g, or t
  misc_feature (127)..(127): n is a, c, g, or t
  misc_feature (132)..(132): n is a, c, g, or t
  misc_feature (143)..(143): n is a, c, g, or t
  misc_feature (174)..(174): n is a, c, g, or t
  misc_feature (182)..(182): n is a, c, g, or t
  misc_feature (192)..(192): n is a, c, g, or t
  misc_feature (209)..(209): n is a, c, g, or t
  misc_feature (242)..(242): n is a, c, g, or t
  misc_feature (278)..(280): n is a, c, g, or t
  misc_feature (284)..(284): n is a, c, g, or t
  misc_feature (288)..(288): n is a, c, g, or t
  misc_feature (312)..(312): n is a, c, g, or t
  misc_feature (332)..(332): n is a, c, g, or t
  misc_feature (342)..(342): n is a, c, g, or t
tggtgacaatgtcacataatgaatgctattgaaanggttaannagatacagcncggagttntgagcactctactngcaagacttaaatagttcgagtataaatgncgtttttttcttgtgctggacnaactnataagcgatgntcttgttaatgcatttttgatgggaagaaanggtacatntttacaaagnggttttatgaaaagaanaaaaattgacgtcttgcttgtacatataggagnaatactattatattatgtagtccgttaacacctacnnnaaangttnaggggttttctccttggttgtagngtggcccagaattgcattcngaatgaatangggtt

SEQ ID NO: 619884 - DNA, 185 bp, Homo sapiens
  misc_feature (100)..(100): n is a, c, g, or t
  misc_feature (168)..(168): n is a, c, g, or t
aaaagtaaaaaaaaaaaaaaaaaaaaaaaggattagcaggcatggtggtgtgtgcctgtagtcccatctacttgggaggctgaggtgggaggattgcttnagcccaggaggtcgaggctgcagtgaactgtggtcttgtcattgcactccatcctggacaagagagtnaggccctatctctttta

SEQ ID NO: 619885 - DNA, 502 bp, Homo sapiens
cgagttagagagagttacgagagagagagagagagagagagagagagagagagagtagagagtttagagagagagagcccgagagagtgagggggagttttttatagtgttgagttagtcccttattttataggttctcttctccctcttttccttccgtctttctcgttccttcatgtctctttctctcttcttcctctctctctctctctctcctctcccttctcttctcttcctatcctcattttctcttcttttcttcttcctctttccttctttgtctcttctttctcctcttctctgcttttctcctcctcttttcccttccttcatttatttctttcctttctctctctcttttccttctctctctcttctctctgcttttctttcctctccttttctctctctcttgcattctcctctctattctctcttctcttctttccactccccttctatccttttctctctctcctctatcctcctcttcctctctcct

SEQ ID NO: 619886 - DNA, 144 bp, Homo sapiens
attgtaactatggacttaggtgatgatgtgtcatgtcggctcatcaactataacaaacataccactctggtgggggatgctgatgatgagggaggctgtgcctgtgtgggggaaatacatgggaaatttctgtgcccatttcaa

SEQ ID NO: 619887 - DNA, 462 bp, Homo sapiens
  misc_feature (22)..(22): n is a, c, g, or t
  misc_feature (97)..(97): n is a, c, g, or t
  misc_feature (219)..(219): n is a, c, g, or t
  misc_feature (250)..(250): n is a, c, g, or t
  misc_feature (268)..(268): n is a, c, g, or t
  misc_feature (325)..(325): n is a, c, g, or t
  misc_feature (376)..(377): n is a, c, g, or t
  misc_feature (435)..(435): n is a, c, g, or t
  misc_feature (438)..(438): n is a, c, g, or t
ttgtgaagaaccctcactggcnaaaccctcacccttgaggtcgagcccagtgacaccattgagaatgtcaaagccgaaattcaggacaaggagggtntcccacctgaccagcagcgtctggttttgccggcgaacagctggaggatggccgctctctctcggactgcaacatccagaaagagtccaccctgcacctggtgttgcgcctgcgaggtggcnttattgagccttctctccgccggcttgcccngaaatgcatctgcgacgngatgatctgccgcaagtgctgtgctcgccttgcccctcgtgctgtcgactgccgcgngaagaagtgtggtcacaccaacaacctgcgtcccgtgaagaaggtcaaatnnggtggttctttccttgaagggcagcctcctgcccaggccccgtggccctggagcctcntgncgtgtccctttcattgactggagc

SEQ ID NO: 619888 - DNA, 81 bp, Homo sapiens
catcctgaagacagcagcttctacatctgcagcccctgggtcaatgagcagttcttcgggccagggacacggctcaccgtg

SEQ ID NO: 619889 - DNA, 821 bp, Homo sapiens
cctgcgctgtgcgagtgtctgggagatggctggggcttcagcacctcgtgcgtcctgggccgcggacacccccgctggggcctggatgcccaacagtgacatcgacttgagcaacctggagctggctggagaagtacctggaagcttctgacctgcatagcctggctgcctggtgcatgatgcatgtgatgtgctgcatgtggccccagacacttgtgttgtgctggaaccctacctgacagaagtaattttccgtggtggaagaaagaacaacgattctccaaatgacgaaagattttgatagttggtggcttgccgtccacaccaaatgtctccctgtgatccccaaacatgctacttgtgaactgtgaaacaatgtgccatccaaaggtgatgcttcggcgtgccaattgttgggaatgatgtgatgctgtgggcttgcacctgaccctacctgccagcatggccaacgttgttccactagcttgtggactggccagttggctgtgggcgctcgacttgcgtgcatgcaacggtgaacaccttggttgtgctctccataactcacacaaatgccaagctgttccttggtggcctttgaaccggtaacttctacttgggggcctcctaagccccggacgatccccttgtttacccacagtggttgccccacccctttttggtcgcccccccgtaagcgtacccctccccttggcctctgctgtcccctaccgcctggtcgtggggtgacgcgcttggacctgacttggccttgtggcttccttggtggccacttgcattggtgcacttcccagccgatc

SEQ ID NO: 619890 - DNA, 385 bp, Homo sapiens
  misc_feature (93)..(93): n is a, c, g, or t
  misc_feature (159)..(159): n is a, c, g, or t
ctcaacctcttcctcttccaggggttccggctggtgccgttcctggtggagctgcgggcagtgatggactgggtgtggacggacactatgtcnttccctgtccagctggctgtgtgtggttgacgggatgccaacatcttcatcatcaaatgcagccgngagacagagaaggttcatgaagatttgcccgttttcttctaaaagttctatagctgtagctctgaagtttcgctctttgatccactttgagaaatacccgcagcccatagggctggagaagaagaagatcgtcaagtacggcgtgggtggccttatcatcctcttcctcatcgccattatctggctcccgctgctcttcatgtcgctggtgcgctccgtggttggg

SEQ ID NO: 619891 - DNA, 143 bp, Homo sapiens
tctagagaatcccctgaatggaagcagcacatatacaacgagattgtgaacatctaaccccattgcccggaaggactcacggcgccggaatggcatgaagctggagggactcatcttgcatggcaccggcgggcaaacactgg

SEQ ID NO: 619892 - DNA, 295 bp, Homo sapiens
ctagagatcccagtacagcgcaggcgtgtggaatggtattgtcggtcatagctttgtgtgtagtacggctctggtagtattttgtagctggagagatggtataattgtgacagcaacaagtattttatccccatttcacagatgaagatataggctcagggaaaataaataaatatccccaagagtcaccgggtactgtgcccaccccaagacacattctaagagctggcacatgttaattttaatgattatctgggtgaatgtattaataaaaggggaaagtggagccggtggt

SEQ ID NO: 619893 - DNA, 613 bp, Homo sapiens
  misc_feature (243)..(243): n is a, c, g, or t
  misc_feature (275)..(275): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (287)..(288): n is a, c, g, or t
  misc_feature (302)..(303): n is a, c, g, or t
  misc_feature (322)..(322): n is a, c, g, or t
  misc_feature (340)..(340): n is a, c, g, or t
  misc_feature (342)..(342): n is a, c, g, or t
  misc_feature (368)..(368): n is a, c, g, or t
  misc_feature (371)..(371): n is a, c, g, or t
  misc_feature (390)..(390): n is a, c, g, or t
  misc_feature (395)..(395): n is a, c, g, or t
  misc_feature (397)..(397): n is a, c, g, or t
  misc_feature (400)..(401): n is a, c, g, or t
  misc_feature (406)..(407): n is a, c, g, or t
  misc_feature (416)..(416): n is a, c, g, or t
  misc_feature (421)..(421): n is a, c, g, or t
  misc_feature (423)..(424): n is a, c, g, or t
  misc_feature (434)..(434): n is a, c, g, or t
  misc_feature (438)..(438): n is a, c, g, or t
  misc_feature (442)..(442): n is a, c, g, or t
  misc_feature (468)..(468): n is a, c, g, or t
  misc_feature (480)..(481): n is a, c, g, or t
  misc_feature (485)..(486): n is a, c, g, or t
  misc_feature (491)..(491): n is a, c, g, or t
  misc_feature (494)..(494): n is a, c, g, or t
  misc_feature (499)..(499): n is a, c, g, or t
  misc_feature (516)..(516): n is a, c, g, or t
  misc_feature (540)..(540): n is a, c, g, or t
  misc_feature (544)..(545): n is a, c, g, or t
  misc_feature (549)..(550): n is a, c, g, or t
  misc_feature (613)..(613): n is a, c, g, or t
cccgggggggaggaagcgccgggcgccgcgcgagaccgcagcggggcgggcggccagccggggcagccggggaagccggggaggacgggggcgggccgggcgggcgggaggcagggcggacggggacccgcggggaggcggcgggagcggccccgggggggaccggggggggcggggaccccagtcgaggggacacaaccggcccgggcaggggggggggcggcggcgcccggcagcaaaagnagcaggggcggaagcggaagaagaagcgagcncagcnanancanngtgtgggggggganngggggcagggggggcgggngcgcggagccgcggggtngngctgagcggcagcagccaccagggcngangcgcgcagaggccctgcgncggcnanganncaagnngccggcgcngagancnntgccggcgangcgncccnctcctctcgcctgcgggatgagggcnttggcatggacnncttnncaganganggganagaagaggggaaagaangggagaggaataggagagaagaanaagnnaaannaaaaagcgcagcgcgcagcgcgcaaaagcgcgcgcaaaaaatgcaaaaagcaaagcttttggn

SEQ ID NO: 619894 - DNA, 367 bp, Homo sapiens
  misc_feature (114)..(114): n is a, c, g, or t
  misc_feature (298)..(298): n is a, c, g, or t
  misc_feature (330)..(330): n is a, c, g, or t
ccactgaaaaagagctccaaattcccccctcaccccagaccctggtaaccactaccttcactttctttctgaatttcccttcacatgagtgggatcaaacaagagttgtcctcntgtgtttagcattcttacttagcaagccatcaactgctcgaacagtcactggggcaactacttttcgcccagtgtcctccagaaaagaaagatctggagggtcaggccactctttttcttaaaaataatggggtgcagaagggtagggatgaacctcttcctcctttgccactttagctttagntcaaaggaactccaactttttattatttgcangagttagctttctttgttttcacatctttggccttgc

SEQ ID NO: 619895 - DNA, 600 bp, Homo sapiens
cgcagtggctcacgcctgtaatcccagcactttgggaggccaaggcaggtagatcacctgaggccaggagttcgagatcaacctggccaacatggcgaaaccctatcactactaaaaatacaaaaattaacctggcgtggtggcacgcgcctgtaatctcagctactcgggaggctgaggcaggagaatcacttgaacctgggaggcagaggttgcagtgagccgaaatcacgccattccactccagcctaggcaacagagcgaactctgtctcaaaaaaagaaagttgggttgtaggctgggagcagtggctcatgcctgaatcccagcactttgggaggctgaggcaggcagattgcttgagcccaggagtttgacaccagtttgggcaacatggtgaaaccccctcttctacaaaaaattagccaactgtggtggtgagtgcctgtgatcccagctgctcgggaggatcacttaagcccgggagatggaggctgctatgaggtgtgattgtaccattgcactccagcctaggtgacagagttgaacacccatctcaaaaaacaaaaggctgggtgcagtggtcatgctgtaatccat

SEQ ID NO: 619896 - DNA, 171 bp, Homo sapiens
  misc_feature (49)..(49): n is a, c, g, or t
ttcctgcattgatgagatccgcatcagcttcgtctttcaagtgggctantgcccaggcccaagactccatattcactttgaagatgaacagtcatgttgggactgatgaagttgctggccagaagaggaatcccaatacccaagttagcgtacatgccgtcctcaaactcc

SEQ ID NO: 619897 - DNA, 346 bp, Homo sapiens
cccccggggtttcccctttttgcttccgggcggttttttggggggaatttggggggggtaccctttttccccggggacccggtttgcccgtttttgggtttttttccgcccccctttgggggttttggcccccggggcccaaattttgggccggggttttgctttttttgccccggggggggggccatgtggggtttttgggccccccccccctttccccccccggggatttgtttttccctggggggggggggtttccgggggccggggtccccccccttccccccccccgggggggcgggggggggccccctttccattttttttttttaattttaaaatccca

SEQ ID NO: 619898 - DNA, 128 bp, Homo sapiens
  misc_feature (1)..(1): n is a, c, g, or t
ntgagaggaatatatttgctcacctgatataatgggacatgtggctggcattgtcctttgctctattccttctaaatgtctttaatgatgacgatgatctgaggtgcagaagccttcttgcaatttat

SEQ ID NO: 619899 - DNA, 103 bp, Homo sapiens
acaacaaaagaagtaggtggatcaccaggtcaggaattcgagaacatcctggcctcctggccagcattgtgaaatcccatctatacaaaaaacacaaaggttt

SEQ ID NO: 619900 - DNA, 314 bp, Homo sapiens
ttagcaggatcttagaacggagctggactgacttaaataagcactacttgagcggggcgtggtcatgctgtaataccagccctttgtgaaggcgagttgggtggatcacctgaggacaggagttcgagaccagcctggccaacatggtgaaaccccatctctactaaaaatacaacaaaaattagctgggcaattggtgtcgggcacctgtagtaccacgctactctggaggcttgcagtgagccgagatggcaccatgtacactcagcctgggcatcgaagtatccagctaccggttctagggtacccaaaga

SEQ ID NO: 619901 - DNA, 121 bp, Homo sapiens
gatcatgccactgcactccagcctaaaagagcaaaactccaagtgaaggttgcggtgagccaagatcgtgccactcactttcagtaggagttgcaccactctactcacttggagggaggcc

SEQ ID NO: 619902 - DNA, 749 bp, Homo sapiens
  misc_feature (660)..(660): n is a, c, g, or t
ttttttgtatttttggtagagacgggggtctcaccatgttgcccaggttcctgttttccagttttctcttctccaagactaccattttcaactcttagctaattctttggtaattacatgtatatattaaataatatgcttggagctaattcattttttttttttttggagatgggagtttggctcttgttggcccaggctgggggtgcaggggtgcgatctcggctcactggcaacctccgcctcccaggttcaagcgattctcctgcctcagcctcctgagtagctgggattacagggtacgtgccaccaagccgtggctaattttggtatttttagtagagacggggtttcaccatgcgggccaggcgggtcttgaactctgtgacctcagggtgatctcccaaaggtgcggggattataagtgtgagccaccggtgccgtggcaggagctaattcttaatttcacgtttaggctttatctatggagcttctcctgggttaagggtaataacggtcgctttatgaatctggttaattctctcctggtaattctggccagtttggctcaaggcatattactcattcttctatcttccaatatacttcacacattttggttagatcgcattcgcaagttgtccgtgccgtttggccccngactttcagggcgggagccgacttttatggccagatccgtttttgacgctccggcggaaccgggcggtcggcaatggcgcccgtggggg

SEQ ID NO: 619903 - DNA, 494 bp, Homo sapiens
ccacgcgtccgagcaaatctcagacctgtatgagatgacttttgtaatttgagtctttttttctttgtcactgtagctaaaagtttgtcaattttattgatcatttcaaacaaatccaacttttggatttattaatttttctgttatttttctattcatttacgtatgttcttcattctttccttctgcttcctttggttttagtttgctcctctctacactttcttaaggtgaaaagttagattattgaattgagatctctttttttaatgtgggcattcatagcaccacttttgttgcctcctataaattttggtatattgtatttttgttttcattcatctgagtttcctagttgccctcgtgatttcttctttgaaccgttggttatttaggagtttgttaatttccatatactggtgaattttctgaatttatttctgtattgatttgtaatttcattccaagtgatcagaggacatagtttgtataat

SEQ ID NO: 619904 - DNA, 401 bp, Homo sapiens
cttgatcagccatttatttataccttttcgctctttccgcttaaaaatttgaagtcatcacgagtgaactgttgaccacgttcaatcttcgctttatcttcagcagcaaacttttcaggagagaatacgcgttctatttttctaatgttcttagtgtgtgacttaccataaaagtcgtcaaacttttgataaacaggcgaaccgttacgtttttgagatttagcttgttgattaatgaacgcttgttcgtgcatttttagtcgctcatcttcttgtcttaactgactagcttccatatacatatagtattcttgcatgtccagtctttcaatatcatcaattctaaagctattaaaatagcgcagtccgtcacccactagtctatggtacgtacctgcgct

SEQ ID NO: 619905 - DNA, 119 bp, Homo sapiens
tccgaccgcctcggcctcccaaggtgcctggcgattacagtgtgtgagccacatcctggctcattcatgatcttggccacaaaggaaggattttccctggtatatgtctgcgttgccca

SEQ ID NO: 619906 - DNA, 1390 bp, Homo sapiens
ctaatttttgtatttttattatagagggggttttgccatgttggtcaagctgggcgcgatctcctgaccttgtgatccacctgtctcggcctcccaaagtgctgggattacaggcgtgagccaccgcgcccagcctttttttttttctttttgagacagggtctcactctgtcacccaggctgaagtgcagtggcacgatctcggcttactgcaaccactgcctcccaggctcaagccatcctctcacctcagcctcctgagtagctgggagcacatgtgtgtgccagtacactcagctaatttttgtatttttggtagaacggggtttcgtgatgttgcccaggctggactcgaactcctgagctcaggtgatgcgcctgtctcagcctctcaaagtgctgggattacaggcatgagccaccatacaaggccaaattttttttttttgaatcaacatagtacctggagtcctatttcctgataaactttttagactagcgtattttgcagagatggttacttcatggccgaaaccctttaccagcagtttttcagcacaataattttaagaacctgcgcaaaatcccaaatgaaccttacttaattgatttttactcaagaaccccactaatcccttcattttcggaggacccttcggcacttagttctcccaaaagggaaccttaccatatagcggaattgagaccgagtctaagtctctgctactgtaccccattgacctggttccgagcctaaccttgggaatcacagtcacttgcttagcggaacccaccttgatctatgagtcgaaatccctcgctgcatgtatggctctttcactcaagtgaccctgtatctgctggacgtccctgcttttttctgcacgcctggtcacgacaacctcaccgctccgttatataacctccgtttactctccttcacgtcgaacgctccccttgtcccttcgccccacatttcgcttcctctttctccctacgtcctccgttcttcgcctctccatcgcattcttcctcctcccttcgtcaacactgtaactccgcttctactcatctatcacgcctgctccatacaacctatgcacactcttctcaacacatcctcgtgtctccacattcgtacataccgtatcgtctctctcacgcgctcacctcgcactcagtgctcctctcacgcggcatatcactagctgcgtctctctcctcttacttctcgatctctgccgcttcacccacactcgtcatcctcttcactcacttcgtctctgctcgaacctctcatctgactcatcgtctacgcttcagcgcgcattacgcactgctttcagcgatccccatctctctgtcatgcgtgtctagcgctctgtccgcg

SEQ ID NO: 619907 - DNA, 319 bp, Homo sapiens
cctccccctacttaccccctcttactttatcaaagaaaacacttcatttgaaacttaacggaagtacattctcccagagaggaaaatccttcaggacaacatttttttttgtttgcttgttttttttgagacggagtctcactctgccctccagcctgggcgacagagcgagacatgagaatctgtcttaaaaaaaaaagaaaattgaccatatatgtgaggatttatttctggtctctccattcagttgattggtctttatgtctatctttatgtccttactgcactccagccttggcaacagagtgagactctttca

SEQ ID NO: 619908 - DNA, 320 bp, Homo sapiens
  misc_feature (38)..(38): n is a, c, g, or t
  misc_feature (113)..(113): n is a, c, g, or t
  misc_feature (150)..(150): n is a, c, g, or t
  misc_feature (244)..(244): n is a, c, g, or t
agcggctcggttgacggcgagtttgagatccaggcggnagatgacgcccgggcccggtagctgggacctggaagacccctgcccaccttccccacctcggtttgcacctcggntgtggagccttttttcgggggggatggtgcgtgcccngaacaagatgaagatgaagtctggtggcttccagtccatgggcctgggcttcccggtgttcaatggcctcatgaagaatgggttcaaggtgccnactcccatcccgtggaagaccatcccggtgatcttgggtggcctgggcgtggtggccctggcccggtcggtcagtg

SEQ ID NO: 619909 - DNA, 1383 bp, Homo sapiens
  misc_feature (265)..(265): n is a, c, g, or t
  misc_feature (822)..(822): n is a, c, g, or t
tatcataatacatatagtgtgggtgtaaatagttgtgtaaaaatcgctcttgtccactacacaaacgttggggtggaggattatatttataacccccgcctaaaaaaaattggggtgataggcacctcttttaatatgacgactgtgtgacacctgtgtcccctctgattttcgtctatggggggaacaattttgtgcggtattttttgctgcccccccccctctcttcacgagagaacctgtggggagttataatgatgtggtnaaagagaaaagtggtatttataacagcggccccccaccttttaataaaggggggcttttttcttccaacagagggtgataacacctttttggttgtatgtgacaccggtggtgttgtccgcgagccaaaaaaaaacacacgcgaattaggccgcgggtgctcgagacagatagtttttgtggacaaagtttatttcccacattttctctgtgtggtgtacacccccccctggggggagcacccaaaacttctctttatttgcgcgcccacgaaaaacacccacatctttatagagaggtgtggcgctcacacacaaatagagatctcttttttatatagggggtataaaataaaaaatatacgacccgccctagaataattgtgtgtatataggagcacgccgctatatttctcaccccaattttttctgggggggcatcccccttttttttagtgtctcccctacatgagagggggtttttcttatatagaagagggtggtgttgtctctctctctgttatatatatcatctctccgagagactcccttttgaggnatataccacacacactgtatagacactttatatatatatatctattaaatagagagaatatatattgtgtcacacacactctctcttctctatatatagatatacgcgacctttttttcgtcacacccccccacacacccccacacccccccccccccccccgctctatttttctctctctctttttttctcctctgcggatattagagagcccacatatttgtggggatgtaagagaagagagagagtatatagagggatctcttagagggccccacacaaatagaaatattatactcttgtgtgaaactcttttgagagagaggatatcctcctcaccactatactactgtgtgcatacttgtgcgtctttatacacacaggtggttataagcacgcgaaaccaccgtgggggtatatatatatgtatggaaagaagtgaggctttttgtcccccagtgggtgaatatcatcttcttgtggtttgtgttatatgtgtttaataactggtgtaaaaacacaccacgcgaccattaaaaaaatattttttttttacccaca

SEQ ID NO: 619910 - DNA, 224 bp, Homo sapiens
  misc_feature (3)..(3): n is a, c, g, or t
  misc_feature (9)..(9): n is a, c, g, or t
  misc_feature (44)..(44): n is a, c, g, or t
  misc_feature (69)..(69): n is a, c, g, or t
  misc_feature (78)..(78): n is a, c, g, or t
  misc_feature (98)..(98): n is a, c, g, or t
  misc_feature (106)..(106): n is a, c, g, or t
  misc_feature (123)..(123): n is a, c, g, or t
  misc_feature (135)..(135): n is a, c, g, or t
  misc_feature (140)..(140): n is a, c, g, or t
  misc_feature (148)..(149): n is a, c, g, or t
  misc_feature (156)..(156): n is a, c, g, or t
ggngggtgnatgagggagtgaagtggattacatcctgggctgangatagaggatttttaagagagacgnctgcagacnaggttttcaagctgggcttngccaagtnccatccaccacggtcgnttgctgatccgncagcnccatatcnnggtccgnaagcaggtggtgaacatcccgtccttcattgtccgcctgggttcccagaagcacatcgacttctctct

SEQ ID NO: 619911 - DNA, 246 bp, Homo sapiens
ccacctcagcctcctgagtagctagaaatacaggtgcatgccaccagggcagctaatggtgtgtgtgtgtgtgtgtgtgtgtgtgtgtgtgtgtgtgtagatagacactcaatatgtcgcccagggtggctctcaaatgcgcgctctcaagccatcttacagagtggtctcccagagtgctgggattagaggtgtgagccaccattcccaccccttatagtgtgtgtacgtagggtatagaagtgt

SEQ ID NO: 619912 - DNA, 260 bp, Homo sapiens
  misc_feature (212)..(212): n is a, c, g, or t
  misc_feature (254)..(254): n is a, c, g, or t
agagtgtgtgggtatctaagtccggcgatgatggtgatctcggtcatgagctcgtctccatgtcagcattcttctggcgcagcctccgagtagctggattacaggccatgcaccatgcccatgtactttttgtatttttagtaaagacagggtttcaccatgttagtcaggctggtctcgaactcctgaccttgtgatccacccaacttggncttccagtgctgggattacaggcatgagccactgtgcccggncctgga

SEQ ID NO: 619913 - DNA, 630 bp, Homo sapiens
  misc_feature (245)..(245): n is a, c, g, or t
  misc_feature (248)..(248): n is a, c, g, or t
  misc_feature (269)..(269): n is a, c, g, or t
  misc_feature (277)..(277): n is a, c, g, or t
  misc_feature (295)..(295): n is a, c, g, or t
  misc_feature (298)..(298): n is a, c, g, or t
  misc_feature (303)..(303): n is a, c, g, or t
ggcgggaagctcgcggggctgcagcccggcggaggccccgggcctggtgttccgcacgttctaaaccgcctgtccccgaggaagtcgggcagggtcgggccggactcagcgccgctggcgggagcgccgtccgccccgaggaccctgcgggcccggaagccgagacagggccgcccacgtcagcgcctggcgcgggcccgaacgtaaatggcgctcctccgcgccgcagccgcagccgcacccgntcncttcccgctccgcagctgcgncctcccgngctcgcttctcgccccgnggnctggnccgtgcgcctccgaggctggccaggggcaccgaggcccggcggagcccaccatcgaccccacaaaccagaagccctggatgtgaccggtccgagagcccggcggaacaatggggaaccccgcagaggcagacagcggcgccttgccccccgaagaaccacggcattgggaagcacgggaaacttgatggcaggacctcccgtatcccgacgaggataccctgactgtaattgtccgcttggtgggaccgtgagggaccgcggtccctgggggatagcccctgaagaaagccgtacggtgctcccccttttcgacggcccggggaaag

SEQ ID NO: 619914 - DNA, 221 bp, Homo sapiens
ctgtacagagctaaggtcgcatactgtcttgctagtcaaattgtgctacatgcagacacaatccgatttccctaccacggctccacactatgggccccgccacaccggagcgcaaacatagtgactcacactatacagtgacattctctactagtcccgctccgcagttaacgtacgttgcagacgagatgtacgagtttctcgctgtaagacctgtatcc

SEQ ID NO: 619915 - DNA, 323 bp, Homo sapiens
  misc_feature (21)..(21): n is a, c, g, or t
gacgtctagaggatcccgaanacctaattacggggttgaatcagagctacagttggcttgtttacaccacagctcacagttctgcatctgcaactatacacagtcacaccaacgctggatccctgaccactgagtgaggccagggatcaaacccacatccctcatgcatactagtcagattcctttctgctgcgccacaacatgaactccaatagtagacactctgatgggtgtgaagtgatacctcattgtggttttgatttgcatttctctaatgattagtggtatgagcttccttttttatgcttgggtaattagggttt

SEQ ID NO: 619916 - DNA, 1278 bp, Homo sapiens
ggcgacggctggctgctcgcgtgcctggcagcggtgcggtccacccctccgcgctggcggtgctggacgcggaactcagcggagaaacgcgattgagagcagtgtgtggattactactatcactggagaaattacgagattgcagaagtaagggagtagactggcacagatgcaggaccgtatgcgttccctgtttaggtgcgcaaacgacgtgctaagggctccccaggagacatggcaacaagcaagcaatgcagaatcatcatccagtcaagttatgatggccagtacgccgtcaagcagcacactagtgagcaacaccatccaggggctggacggtgcttccctagggacaggctgcagattcgggcacacgggtaggcacacgcagccccttgcctcgtaggcctggccaaggtcctgccagtcgggcccgcgggggcctcccgttcctctcttggtcgctagtcgcccaacgcgcggccacgtcttcacccaacgcccgcttatgtccaacgcggcactgctctcgtcttgcctctggggcctccccacctccctgccccctggtggtcgaccctcttctaactcccgcccctctttgtcccctccactccccccgggccgcaccttgggcggcacggccgcaagccgcgtccccgcacgtctaccgcatttcccacgaccgacccctcccccccctccttgctccgccgggggccgaccgcgagctcacggccgcgcccaactggcctgctcaccgccgctccccacgctatgtgcagcgtcttccttttcccgcgttccacatccacagctttcctctccctctctttcgcgaacctctcgccatccccccctccctctcccgtcccccctcgcccgcctttgtgcccccgcctttcggctgcccccgcacccgtcgccccaccccccctcttttcccctgcgcgccccgcccccctctcgtcgccccggcgtcctctcttcgcgcccccggcgctctgcccgtctggcgactgcgcccccctcttgtcgggtgcgggcccaccacacccccgtgcgctgctttctccctccccctgtatgggggcgccccctcttcttcgtgcgcgccccgcccctgtcgtgcttgtgcggccggcgtcccccttggtcgtgggccctctctgcgtcgctttcggtctgcgcgcgtctttcaccccacgcctttctttccccccggggcgggctcgtatcactattccttcccacgtgtgggcttggccggcggctgga

SEQ ID NO: 619917 - DNA, 495 bp, Homo sapiens
atagctaatcaggaaagcgatgaagtgtcatgtggctatcccttccgttagagtgaacgatcaaagaactgctgatcttgatcttcatcgcttctatctagatgacaggatgatgacattgcgttaacatctcaggaagaaagtgtataggagccctcatttctcttacaccattgacagcctcattggcatttccactatttagatattcagtcacaacagtttgaggtagtttaaggagttcttcctttgacggtggtggctttttgctggtcttggcaggcttttgctggataagtggtggattagttttgagaccaagctgaggtgtctgtcccagaggtggtgtttgagtgcgtggtggctgtgcactaggaggaatcatagttatctggggctgaagctttggcacttgatttttattcattaggaacgactgagcaggcctcaggctaatctcatctgcattaagctgtcctttcttagaacaccgag

SEQ ID NO: 619918 - DNA, 669 bp, Homo sapiens
ctctagaggacccccgacactctgagttgttagaggctgggaggatggaggggtaggagtaagataactaagggatgcaaggtttttccttgaggtgatgaacactctgaaatcaactgtgatagttgcacgtatttataaatatactaaaaaccacttaattgcagacttgtgaaaggggtaaattacatgataagtgaactacatttaataaagctattaaaaaatacaatttaaaaagagtgaatgggctggtcatggtggcttatgcctgtaattccggcactttggaaggctgaggcgggtggatcatctgaggtcaggagttcgagaccagcctgaccaacatggagaaaccttgtctcttactaaaaatacaaaattagccagacatggtggcgcatgcctgtaatcccagctactcaggaggctgaggcaggagagtcacttgaaccccagaggtggaggttgtggtgagtcgagatcgtgccattgcactccagcctgggcaacaagagcgaaacttcatctcaaaaataatagtaattgtcaaaaggtggaaacaacccaaatgtccattaatagacgaatgggtagaccaaaggtggtctatccatttgcagagatattattcaggcatagcaaggaatgaagtactgatccatgcta

SEQ ID NO: 619919 - DNA, 470 bp, Homo sapiens
  misc_feature (186)..(186): n is a, c, g, or t
  misc_feature (215)..(215): n is a, c, g, or t
acaaagccctttcagcccccattgagaaaacatctccaaaaccaaagggcaggcccagaaccacaggtggtcacccgccccccttccggaggaaattccaaaaaccaggtcagccttacctggcggttaaagggtttttcccaacgactctcctgtgaggggaaaacaatgggaccggagaacaantcaaacccccccttccggggtgggtccgncgggcctttttttttataaaaaactccccggtgcaaaaacaggtgggacagggggaatttttttatgcccctgagcatagggtttgccaccccctcacccaaaaaagcctttcccttttcccgggttaattagtttgacggccggcaaaccccccctccccggggtttttcggttgcccgaggaagcttgggccgttccccgttttaatattttccagggcccccgcatggaaataaagcccccccccctgccct

SEQ ID NO: 619920 - DNA, 247 bp, Homo sapiens
agctacccgcagctctctcggttgggggcagctctctcggtggggcacacatcaaggtcaagaatggtgaaaccccaatttatgtagcgtatctctgggtccacggtcgggccattctgtcaggttctgctcggtgggtcatatactgagtggcaatacttcccaccaaggggtcggcaggattacagtctgtaagaagtgagcagcatcagccccacagcagcagcagcgtcgggtcaccgcagct

SEQ ID NO: 619921 - DNA, 421 bp, Homo sapiens
acatccttacaaaaaaagtcaaatgcatacttcaaacgttaaacagataagtattactgaaatttaagacaagtttgggttgggtaccatttgtacgacgcagttgattctacacattttcatctgggtgtgctcctaacaaaggcggcagtataaaataacgtcgtcgcgggtagaaccctcgggagtaggcagttttgccatgcaggagaagcaatattaaatattagtttcaaaaaaaatccacatttaaaaatatatagttcaagtcacagaatttttctcagtagagaccccaatgcaatgcataattagctgccttagatggcccgtttgaaaggatgatatcccttcagagtgtaactttactgattttggcacagaaacgaagtcttaagaacatgattcacacagcgggacg

SEQ ID NO: 619922 - DNA, 371 bp, Homo sapiens
ccctgggctctaaagttacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaagagtatagtgcctaccttccaaacaggagatgtttctagttataggtgcttgggtagctggattgctgtgtggtcggagaaaatgacccgtgtgggggccatccttctgaagtggttgggacttggttgttgggtgagtgtgagatcaatgttgtagagtgtgggatgtatgtttagaagagactgggt

SEQ ID NO: 619923 - DNA, 726 bp, Homo sapiens
  misc_feature (111)..(111): n is a, c, g, or t
agcggctctgctctgagctctgttggtcccagccaggagagctcgagtcatgaggtgtgcacccagtgggcagggtgggcagcagtggggccctcttggtagcgcaggagntgacttggcgaagagcgaggccgggccccagcatgctgggcatgatggacgtagttcgcggcatgatcttccagttcctgcgtttccaacccaggagtccttcctgactcggcatctgtggcatctgtggccctggcgccacgtgcccagatgtactcggccttcgacttcaactgcccctgcgctgtcgggcttctagtgcgagcgtacagcgcgggcatcctgctggcgccacccctggtgctctttctgcttggcctggtcatgtaactagacaacgtgtcctatgctgtctcgagagcagtgcgaacgcggcctactcggtgcccgcctgcgtgccgaacgtggaccccagcgtagtgcttgacgcctaccatttgttcttgcatcctaatggtccgcagctgctgcctctcgatgcgctgcctgtcagctctgggctggcctgtcacggctactctgatggcagaatgcttcctctgtggccttgctgctactgccgtgccctgtgagtcgcactgggccaacggcagcctgtgcaccctggccttcctggcccccggagctcgctccgcctgcttggccctgggtgccctgcccctgaggatctacgga

SEQ ID NO: 619924 - DNA, 663 bp, Homo sapiens
atcacgtaatgcctacattcaagtgatcgagttgttggtagaagagccatgctgtatcattgggtccctgtgatgcacatttgctacagtggtacggatgctgatgaatgggataacattcgattgacgatattgacatttgtattcggacttcgaccgctgtgccggtagattacttaagctatctgactgacttcaaactctgctcttagatgcatgatcatcgatgactgctagctagactggctgatctatccttattcatcgcacttggcctgatgggagaacgttcagcgcgtgtaaccacgttcttctgatcggatctagctatactgcttacaggacttggcgtacatagtgcaagcctatactgcttctacatgtttatgacgtgacaatgggtgtcagtcactgaccatattagcctcatggctccctcattgacgctagagagcactgtcatgtgcatacacctatgccccgagctcctgctatcgatcaagcacgacatcagtaccgggttctgctctaaaaaccaacactcgggagatgggcctcgtttggctggaaataatgtgccgctttaggggtggccctagctcaattgcctctacgcatggcgttttacaatctactggccgacgttttatagccccttgtgtg

SEQ ID NO: 619925 - DNA, 397 bp, Homo sapiens
gcacccgtggatttttttccccctcatcacattagttgtatacacgtgggaatgaaaggttagagggaatgaccatacagtgtgactggagaaaagtcgaacaaatttgattggccaagtgaaatgaatattgtcgatcatttttagacgaaatattcatacagaaatatgccatttgaattattagcaagggaataaagatcacagaagtcctatgataattgaatacctgcataaaatcatactgttagacatctgtctgcattgggaggacaatgggccacgtgttttttcaagagtacttatttacccacgcttaccatggaacgacaaactcaaaagataatccgaagttaatgaaacaaaaagcatcaactggtaccaaatgtaattaaaa

SEQ ID NO: 619926 - DNA, 222 bp, Homo sapiens
ccgatatctttctattccactccattcgattaaattcgattccattccattccattcccctccattccattccattccacaggggttgattcaattcctatctgttccattccagtcctttccattcaattccattccattccattccattccactccattcatttcctttccattccattccattccattccatcccatcccattctgttcgtcgacgcgg

SEQ ID NO: 619927 - DNA, 143 bp, Homo sapiens
atgtcggtaccgtaaagcacactgcaacagaactctaattcattgctggtagcatgcaaattgtaatcgctactttggaaaaactgtttgacagtttcttacaaaattaaacatactctacaggctgtggcagtgtgcttccg

SEQ ID NO: 619928 - DNA, 831 bp, Homo sapiens
atgaatcccctggcccaacccgtcatctactcaaccatctttgcaggctacactcatcagcagcgctaagctcgtcactgattttttacctgagtaggcctagcaaataagacatgcgtgagcttgttattccagttctaaccaaaaaaataaacccgtcgttcctacagaagcgtgccatcgaagtatttcctcgacgcaagcaaccgcatccatagagtccgttcgtaatagcgtatcctcttcaacgaatagtactcgtccggacaatgagaccagtagaccaatgctagccaatcaatactcatcattaataatcttatatggctatagcagataaaactatggaatagccccctttcacttctgagtcccagaggttacccaaggactacccctctgacgatccggcctgcttcttctgcacatgacaaaaactagcccccatctcaatcatataccaaatctctcccgtcagtagacgtaaggcgttctcctcactcctctcaagtcttatccatcatagcaggcacgttgaggtggattaaaccagatacccagctacgcaaaatcttagcatactcctcaattacccacgataggatgaataatagcagttctaacgtacaacctaacataaccattcttaatttaactatttatattgatcctaaactactacccgcattcctaactactcaacttaaactccagcaagcagaaacctactactatctcgcaccgtgaaacaagctaacatgactaacacgcttaattccatccaccctcctctccctaagaggctgccccgtaaccgggttttgcccaaag

SEQ ID NO: 619929 - DNA, 160 bp, Homo sapiens
taaaaatccccctttgaatgccccggagctcaggagaaaggtgaaaaattttattggttcatggaaattaaaaaatccatgcccagaaagaagaaaggtcatttgtgttgcatcaacccattttccaaaccaaaataaaaattgaaaaataaaacccata

SEQ ID NO: 619930 - DNA, 307 bp, Homo sapiens
  misc_feature (233)..(233): n is a, c, g, or t
tgtcttctctgggccacccggcctctcctctctttccgtaactctagtgtcgacaattctgtctctaacctctagcgcgctgtatcgtagggagatctggtgtcggcgccccaggtccctgagtcgtctgcccctgtagtatggaatgatgctggaaagcggctctgctcggtgttccctcccctgcacgcgcacacctccttccggtacccctccccctgcattgtgcgtgncgggcccagccgcaccggcccgggcactcagctaggccctatccgccctcccgctggcgagctcccgccgagcc

SEQ ID NO: 619931 - DNA, 625 bp, Homo sapiens
ggcgggcgacgttgttacattcgttgaaggaaccagctgggaatgtgggttgggagattgaatcatgcggtccagaaagtgtggcaataccagtccatgtgtatcacaacatattccaattctaatactctcacaggtagactgactgtgtatgccactatatggaaagcttggcatggatgggtctaatatccaagtcaaggtccaaaaaaaactccagttgtgaaagcaacataatgatttcaccgtgtctagggttcctaaaccctcatctgttaaagtcccatgcgtggagaagctaatgcacctcatcagtgttgatacttcccacgtttgtaccattacatttttgaacgctaaaaaaaaaaagcaacacagcaaaacacacacttgtgtccgccggccccggcctccgaacaaccctttccaacccccatgtctgagcaggcgcccccagcagcttagggcacccctgcgcaccacgggggcccaaggaaacccccggccacgcaagtgctcgtggcttccaccaaaaaaaccccgcgggcaacgcatctctgaaccactcacacggggtcgcggcacacggcccccacggcgcgcacccgaacatccccccgggggg

SEQ ID NO: 619932 - DNA, 307 bp, Homo sapiens
cgatctgactacgcggctctactccagcttatggcaaacattttactgagctgggctttaatcattgttattattacctgagacattcatattctagcactctgggaggctgaggtgtgggtggattgcctgagctcaggggttagagacaagcctgggcaacatggcaaaactccgtctctactaaaaataaaaaaattaggcagggcgcagtggctcacgcctgtaatcccagcattttgggaggctgaggtgggtggatcacgaggtcaggagatcgagaccagccgcgtagtcagatcggggt

SEQ ID NO: 619933 - DNA, 666 bp, Homo sapiens
  misc_feature (13)..(14): n is a, c, g, or t
  misc_feature (27)..(27): n is a, c, g, or t
  misc_feature (54)..(54): n is a, c, g, or t
  misc_feature (95)..(96): n is a, c, g, or t
  misc_feature (112)..(112): n is a, c, g, or t
  misc_feature (125)..(125): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (140)..(140): n is a, c, g, or t
  misc_feature (145)..(145): n is a, c, g, or t
  misc_feature (147)..(148): n is a, c, g, or t
  misc_feature (152)..(152): n is a, c, g, or t
  misc_feature (159)..(159): n is a, c, g, or t
  misc_feature (170)..(170): n is a, c, g, or t
  misc_feature (173)..(173): n is a, c, g, or t
  misc_feature (176)..(176): n is a, c, g, or t
  misc_feature (181)..(181): n is a, c, g, or t
  misc_feature (187)..(187): n is a, c, g, or t
  misc_feature (197)..(197): n is a, c, g, or t
  misc_feature (199)..(199): n is a, c, g, or t
  misc_feature (209)..(209): n is a, c, g, or t
  misc_feature (213)..(213): n is a, c, g, or t
gtcgtccttcccnnggagccgactggncaatcacaggcaggaagatgaaggttntgtgggctgcgttgctggtcacattcctggcaggatgccgnncaaggtggagcaagcngtggagacagagncggngcccnanctgngccanannccgngtggcanagcggccagcnctnggnactgncactgngtcgcttttngnattacctgcnctgngtgcagacactgtttgagcaagggcacgaggagctgctcacgtttcaagtgacccacgaactgaaggcgctgattggctagaccatcaaggagttgaaggcctacatgatgggactggaggaacaactgttcccgctggctggggagacactggcacggctggccaacgagctgtaggcagtgcaagctcggctgggcgcggacatggaggatgtttgtggacaacttgtttaacatctgcaacaggtggaagtcatggtaggtggcagaatcaagctcttggttggaacctgggtacaaccgcgcaagctggttagtcgctcttaggggaaacccctgcccttggaatgaactgacggttgtatgataggcactttctgggaacttgagggggaaggtctcctacgtcagttatggagaccatgatgtaggccctttttttggccttttggg

SEQ ID NO: 619934 - DNA, 296 bp, Homo sapiens
tgtgagcatgcccctgcactcctgcctaggcaacagagtgagaccctgtttcaaaaaaataaataaaaccatggggttccatgctattttggcaaatttgccctttatagcatcactcaaaatactgcctattggctttaaactccatttgaaaactgataactttcattctttccctagagtggaagctttgagactaggaattttgttgtttttaccccagtcctttgaatagtggctacatgtaagatagtcatgtaggatttattggaaataaatatttattggaaaaacga

SEQ ID NO: 619935 - DNA, 106 bp, Homo sapiens
gtaccgttgaaccatcgtgatgggatcgggattgcatatcccatgacgagattccagtagtgcggtcataagcttgcgtgataagtcctgcctttgacacacgaca

SEQ ID NO: 619936 - DNA, 373 bp, Homo sapiens
taagattgatgacaccacggtatcggtgatggacttcacctccggcctgaactggcaggagaaaaccctgaccctgaaaccgacgtcgctgaaaggcctgctgattgctctgccgaaagtggcggaagtggcgcaggaagaagtggtcgaaccgaaaattgaaaatccgcagccggatgaaaagccgctcggcgaaacgctgaaagatctcttttctcgcccggtattgccggaaatgaccgacgtgcatttgccgcttaacctgaacattgaagagtttaagggcgagcagctgcgcgttgacgggcgacacggacatcaccgtgagcaccatgctgctgaaagtgagcagcatttgacggcaatacttaaa

SEQ ID NO: 619937 - DNA, 268 bp, Homo sapiens
ctccagctagtgatcaccattcacataattaccagctagggaaacgcacctctttattatggaacctacaagcgactattgcatccttatcccatacgtccgacaataggtgcctggtgttaatcaccttcccccccacagtcgctcctgcaaatggaccatagagcacatactagttatgctttggcttatagcctctgtaggaaagtgatctgagcgcaaaaagctagtgtgcaacttccgcatgcagtattggcacccaggctga

SEQ ID NO: 619938 - DNA, 360 bp, Homo sapiens
tacctttatttattatatttatagatggcgtctcgttctgtcgcccagcttgaagtgtaatgcgcatgatctcagctcggtacaactatctgcttcttgggtctcagcgcgattctcctgccacggtattttatagtagagccggggtttcaccatgttgcccagcctgtgtcttgaactcctgccctcaggtatccacctaccttggcctcccaaagttctggaatcacaggcgtaagccaccacgcacatctgattaagtttttaaatacccctctcatatgtcaaacccgaggtaaaaggagagtgatacgcaagaccccacctttcacagtatcccctcgtgccgtactcctacag

SEQ ID NO: 619939 - DNA, 85 bp, Homo sapiens
cgaccccacagctgtctcttggaatatccctgacctccggcctaaccccatacgcgatacagattaaccacgcacccacatagac

SEQ ID NO: 619940 - DNA, 234 bp, Homo sapiens
gtcgacttgagaaattagcctgggcaatatggtgagatcctcatctctacaaaaaattttttaaaaattggctgggcttgatggagtgtgcctctggtcccagctgcttgggaggctgaggtaggagaattgcttgagcctaggaaatcaaggctgcagggaaccatgattgtgacactgcactcctgctttggtgactggtctcaaaaaaaaaaaagtcgacgcggccgcgaa

SEQ ID NO: 619941 - DNA, 267 bp, Homo sapiens
tggaattcgtgctctgcaatccacgcattgacaacagagtgagactccgtctaaaaaaaactaaaaaaaaacacaaaaaacaaatcgcctcctaaacataagggagaaatgtgtctaggtttaagacccttggcataattggggggcaaaggccaagcagggataacttgcctaccagcctctgtgaagatacctaataacaaaaagattttgccatgtccagttccgtagggtcatgccaatcatctcagcctccacacgtagctg

SEQ ID NO: 619942 - DNA, 483 bp, Homo sapiens
  misc_feature (403)..(403): n is a, c, g, or t
ctcagtcagggcagcaaaagatcaagggtggaatctcacagtcacaggccatccgtcgacacataacgaatccattctgacatgagcacacagagcacctggtcattttccaacacccaaatctgaccatggtgcttaacttttccatcagggatgcagtccccggtgcaattcttgccaggaggacatcgacaatcatatccgccatccaaatggaagcaaagggtatcatgggcacagcggtgcctccgggtcccacactcatcaatatcttcacacgattctccaggtggtgaaaccatcccatggtcagggtagccatctctgcactcacaggggtaccatccaggcaggttaatgcaattagcaggacggtcacatggaacaaaaccatcagagcatncatcagggtccgttacacagtggggtccagtgaagcctggggggcaggcacacacatgagcggcaatacaggctcctcca

SEQ ID NO: 619943 - DNA, 213 bp, Homo sapiens
tgcggtgcctgagggagatgaaaggggaaagttctatttattcttggtgattggatgcacagttgaaaaacttaacacacaataatagaagtggtcgttagtaaatcacaccctatgtctttcagatgcgttccgtaagctagacgacacttgtcagattttctacgctctgtgttttaacacctgcaacaagcaatgatgcatactgtccgg

SEQ ID NO: 619944 - DNA, 296 bp, Homo sapiens
tcatttgtgactgtaaacaattatttattagcaaacaattgatcccagaagggcaaattgtttgagtcagatatgctctgtcttttctcagctcattactgagaaaagacagagcatatctgtgtatttggaaaaataatgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagtt

SEQ ID NO: 619945 - DNA, 131 bp, Homo sapiens
aggaggctgaggcagaagaatcacttgaacctgggagatagaggttgcagtggagccgaaattgtgcccaccgcactcccagccgggggtggacaagagccaaaactccatctcagggaaaaaaaaaaaat

SEQ ID NO: 619946 - DNA, 486 bp, Homo sapiens
  misc_feature (88)..(88): n is a, c, g, or t
gcactgggagtcacattctgactctgaagggtcctgagctcaactgctttggccccagcctcaaggggctggtgcagggtacaggtgnatggacaggctggtcagggctttgagaaggacctgctgcagttggggaaagatggtgctgtctcattgaggacgccaagggtgtccttaaacagaccctctgctgtaaggacttgagctaggggatgcggggccatattatcccattcaaggcaaggcttcctgatcccaaggtggggtcatggccactcaggactcctgcccttggccagtcccagtgttgcatcacagccgtgtggctgcccatggggcctaatttcagggaccctgtgagatgggcccagttgccctccacagaccctggacagctgcctctgcattcacgaattagcttctaccttgccagaccctactaggctccaagatgatggtgtgaacaacacaggcaaaaaaaaaagc

SEQ ID NO: 619947 - DNA, 89 bp, Homo sapiens
  misc_feature (14)..(14): n is a, c, g, or t
gcaagttatttgcngaatatacgtgtaagggtagtctatattggatgaagtaggtgcgtctggaaggaaataaaaaaaaaatgctgaaa

SEQ ID NO: 619948 - DNA, 416 bp, Homo sapiens
agattattacaattcaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacataatggggtatcctgggtaccga

SEQ ID NO: 619949 - DNA, 233 bp, Homo sapiens
  misc_feature (43)..(43): n is a, c, g, or t
gatcaatttaaccctgacaggtatgtgtgctttcgggcgcaanttaggagaatgtttgtgtctttcctagttgaatacaaccttcagaccaaacccctatgccttggagattactacctggcacaaaatgggtcttcaaggaggaaaaggagttggaggtctcagccagattgctcgtctgccgacttagttgtatcgattccgatgtgactatgtaataggatggaaaaagt

SEQ ID NO: 619950 - DNA, 156 bp, Homo sapiens
  misc_feature (79)..(79): n is a, c, g, or t
  misc_feature (97)..(97): n is a, c, g, or t
acagatctagagagcaggcgagctccggacgtggtgtcatgtagcctctggtcatctctacggcactcagcgctgccgngcgatacacgtatcttgngggcggttccgttcgctgttgaggtgcgatctcctggcagagtctccatcacagacagt

SEQ ID NO: 619951 - DNA, 439 bp, Homo sapiens
gggaccagatcggccgagcccccaccaccgtgtcccctgcaaggtgacaggcccctgcggctctgtgctggtacgcctcaatccctgcagcccacggggcactggcaatcgtctccgcacctgtgcctaagaagctgctcatgaatggctggtatcgagtgagctgctacacctcagcccggggctgcactgccacacctgggcaaacttcgcccaggccaccccttgaagccaacatttctaagaccaacagctacctgagcccccgaccttctggaaggagactgtattcacccagtttccctatcaggagttcactgaccccctcgtcacagacccacacccgagtttccgtgcaacggaatcaggctcccactgtgggtacaacatagggtttttataccaggaaaattaagtgaattaagcgtgttactgttta

SEQ ID NO: 619952 - DNA, 101 bp, Homo sapiens
taaaagtgcactgctgtctccaaagcggagatgctgagatggtgataaatatccaaagccatccgagctcgattaattacaagtggctggggtcatgtctc

SEQ ID NO: 619953 - DNA, 790 bp, Homo sapiens
gcttgagatgaagacgcggtcgtaagggctgatgatattggtccgaatgctcctgctcctgactcaccgttgtacggtctctccgatgaagcaagtcggtcgggaaggccgtcgcgctacagtcatggactttttacaatgagtataccgtgggaataaacgatccgcgatggtacgaaccgcgcacgagtgggtgaagttgcaccggagaattcgagatcatccttaacaagtcgcgaaaacgttatgaatctctttgcggcataaacatggatgtgttggctgatcttcgatcaagaatggcggcaaaaaagataagacggccaatatctcaaagtggaaaggaccgagttcgaatgcctaccacagactttgagaagtcactgactaggaaaagactccgttgtggtgaaggttctatgtagcgtgggatcgtttccacgatgagaattcatcctaagctgactcatgcgacttgcaatcagtccttcgtgagagtgtgtagagcagatcacttccatcagtattggcgccaggagttgaggtggaggtcactcattgcagatgctataagttcaactagtttgattacgttgaggaccagttgtgtactaaagctcaaatagctcttaaacttggtgtgtctgggtcactgatgtcccgaatgtacattatctgggcgaaacccattgcgcgagggcagcatcagatgttcaacccttgcgccacgtggagtttgccaggacaaagccccgcgcgcggaaagggaggctcgggatctcatcgacag

SEQ ID NO: 619954 - DNA, 458 bp, Homo sapiens
tacttgcctgtacatctatggggagaaattgaagatgagaacttcatccatagcatacgggtctggcatcttgtcatggcaaatgctggacccaacacaaattgttcccagtttctcatctgcactgccaagactgagtggttggatggcaatgcatgtggttgttctggcaaatgtgaaatgaaggcatgaatatttgttggaggccatggagctgctttgggtccagtgaatggcaagaccagcaagaagatcaccattgcttgactgtggacaactcgaataagtttgaccttgtgtattatcttaaccaccagatcattccttctgtagctcaggagagacccctccatcccatttgctcgcagtatcctagactctttgtggctctcgcttgcagtaccctttgggttccatgtttcccttgtaccctcccatgcattagatggttaccaggg

SEQ ID NO: 619955 - DNA, 162 bp, Homo sapiens
caacccccttttttttttttaaggacctttttttggcgggggggcctttataaaaaagtattagttttttcttttttttaacggaaaacttgcctttggggaatgggcataactccctttttttttgctctttaaaaaaaaaaattcaagaagctttttcta

SEQ ID NO: 619956 - DNA, 796 bp, Homo sapiens
ggaggtgctgcgtcctggaggctggtatcgaactcatcatcgacgacgatatcaggtccagagaagctagaagcaggaacgcctgggctgctgtggatcccgataaccaaagtccggaagtctctggctcttgcacattagtggatgaggatgtgaagctgaatgatgtctcgactactggccaagtcgtctgatccattggccagaggggactgggctcccgtatcaacagtctttccaggcctcgacgcgctgatcagggtactcacgaggacatgcacagacaggcttgactgctaaccgaggtgcgttcttgacgatgaccaagctcgcgacgaccaggccgaaggcacgtgggcccatgaaggccccgtgaagcctagttacaccgacaccactgccccgtactgtccgagtgcactgttagaccacggtgcgctctgccgaggcgtgaccgaggggcattcgcaggcgtatttccgatgcgagcgaccgacataggcgccgtgcgagctccctgcggccgggcctggaatgctccatggccatcgacattcatcgtggagccctcatactttgtccttggagcggtgtttgacgcgagtgtccacggacgcccttattctcgatcgttatactagggcgtgctttgctggcgtggcccgagggcgcggtcgttgggacatcttgaagcagtctctacgaggtcgcatccgtcgccttgccaggtggtatgctctctctagtctggcaggggccgttcgaccctagaggtctcgaagtggggggtgcgcaa

SEQ ID NO: 619957 - DNA, 119 bp, Homo sapiens
  misc_feature (37)..(37): n is a, c, g, or t
  misc_feature (43)..(43): n is a, c, g, or t
  misc_feature (119)..(119): n is a, c, g, or t
tctacttttttgtcgctagcgcgctatgtgttggtanacgggnattcggcattatggcgggggtatgggaatataaaagtaaagatgaagcgatttaaatataatttgttgtcaaggtn

SEQ ID NO: 619958 - DNA, 339 bp, Homo sapiens
  misc_feature (19)..(19): n is a, c, g, or t
aaaggggggggggggggtncggggggggttttttttaaaccggggttttttttttgccccccggtttgggggggggcccccccccccctttttttccccccctaaaaaaccccggggccgttcccccccccgggtttttcccttggcccggggggggggtactttttttccccggggaccccttttcccccttggccctttttgggggccccttaaaaccatttttttccaaaaaacgggggggggccgggccgggttttcccgggtttttttccccccccggccccggggcctttttggggggttttttttccctttaaaaaatggggggggtcccca

SEQ ID NO: 619959 - DNA, 335 bp, Homo sapiens
tgtacgtctgtggtgttgtaaatttttattatactgggatatgctaataggttatttcgaatccgattcagatgagtagtcagtgtgagctgattattactagtatggttccggacattactgttatgataagggtagtgtagataatgggattaattagtatgggaagggtatgaaccaacattttcggggtatgggcccgatagcttagtttttgtttctcaggattgttttggcgattctgggtcttttgtggttccatataaatgtttggattgtttgttctagttctgtgaacaatgtcatgggtaatttgatagggattgcattgaatc

SEQ ID NO: 619960 - DNA, 299 bp, Homo sapiens
  misc_feature (225)..(225): n is a, c, g, or t
tcacgcttatacttccagagtgcaagaagagcttcacgtgacgtctcccacaagctatatagctagctctcggcaataaacatgacatataatacttgggtgcatttggcgtgtcaaaaatatgcaattttaacatgtcagaaagaatcatgtttcaaaaacagtctcctttggagaagagagttatgcaaacaatatccaaaacctttttggatctcacatttngaagaggtccaacttccgttggttgaaagaaaagtctatgatataatgaaagccttacaactgagggtaccgag

SEQ ID NO: 619961 - DNA, 213 bp, Homo sapiens
atccctttcccagtggtacagtgtcttgattactgtagctttaaaataaatcttaaaatttaataggtgtaattcctctcactttattctcctttttaataattgttttaacattctggttctttgctcccaatataatctggattcagcttgttctatctataaaattccgctgggatttaatgcaatgcatcgatctgagctattgtagga

SEQ ID NO: 619962 - DNA, 144 bp, Homo sapiens
gaagtcagctcgatttgagtaagcctctagttgaccgtgctcttagcctgagtgtggacgttgaaacatatcacttcaggcttggaaagtcagtcaaccttgacgtacagtttagtgacagtttaaaagagtcagactctataa

SEQ ID NO: 619963 - DNA, 1183 bp, Homo sapiens
ggaacccggcgctcgttccccagccccggccggccgcccatagaccagccctccgtcacctcgttcaccgcaccctcggactggcccaaggcccccgaccgacgctccagcgccgcgcagacaccgacgacgcgccgccatctccttagtcgccgcgcatgacgaccgcgatccacctcgcaggtgcgccagaactaccaccaggactcagaggccgccatcaaccgccagatcaacctggagctctacgcctcctacgtttacctgtccatgtcattactactttgaccgcgatgatgtggctttgaagcacactttgcccaaatcactttcattcaccgaatctccatgaggcagcagggaaccatgcatgagaaaactgcatgcaagctgcagaacccaacgcaggtggccagacatcttccttccaggatcatcgaagaaacccagactgtgcatgcactgggcagagcgggctggaatgcaatggcagtgtgcattacattaaggcaaaaaaatgtgcaatccagtccatcactggaactcgcacaaacatggaccactgacaaacaatgaccacccatatagtgatgacttccactgtgagcacacattacctgaattgacgacaggtgaaagacatcacagacctggagtgcacacgtgaccaaaatagcagcaagaatgcggagcaaccccgacactgggcctggcgcgaaatatctcatgtgacgaaagcacaccacagggaaagacagtggatacatgacaagctaagccgacggagcaaatagcacacatagacgcggagagtgcactacccccttcggccaccccaagggcaagctgcaatgacactgatggcacggataactcttgaccacctacaacacacacgcatggtaaccgagaacacaatccacccataacaagttccataaggactcagcgaaccaggtcaacaatcaaacaacacaggacaaatggcagacaacacaacacccaaaacacacacacaagagcacgcgccggcaacagccggagaccaccccactaaggagaccacacaagaaatgacgaacccccaagaatacatagagacacagagaggccccacaccacgacaggagaaaaccaagcaacgactgcagatacacaacaaagagcgcataacccggacaag

SEQ ID NO: 619964 - DNA, 1010 bp, Homo sapiens
  misc_feature (61)..(61): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (99)..(99): n is a, c, g, or t
  misc_feature (133)..(133): n is a, c, g, or t
  misc_feature (143)..(143): n is a, c, g, or t
  misc_feature (149)..(149): n is a, c, g, or t
  misc_feature (157)..(158): n is a, c, g, or t
  misc_feature (165)..(165): n is a, c, g, or t
  misc_feature (185)..(185): n is a, c, g, or t
  misc_feature (191)..(191): n is a, c, g, or t
  misc_feature (218)..(218): n is a, c, g, or t
  misc_feature (240)..(241): n is a, c, g, or t
  misc_feature (249)..(249): n is a, c, g, or t
  misc_feature (259)..(259): n is a, c, g, or t
  misc_feature (262)..(262): n is a, c, g, or t
  misc_feature (270)..(270): n is a, c, g, or t
  misc_feature (285)..(285): n is a, c, g, or t
  misc_feature (287)..(287): n is a, c, g, or t
  misc_feature (301)..(301): n is a, c, g, or t
  misc_feature (310)..(310): n is a, c, g, or t
  misc_feature (314)..(314): n is a, c, g, or t
  misc_feature (332)..(333): n is a, c, g, or t
  misc_feature (336)..(337): n is a, c, g, or t
  misc_feature (351)..(352): n is a, c, g, or t
  misc_feature (358)..(358): n is a, c, g, or t
  misc_feature (362)..(362): n is a, c, g, or t
  misc_feature (366)..(366): n is a, c, g, or t
  misc_feature (386)..(386): n is a, c, g, or t
  misc_feature (391)..(391): n is a, c, g, or t
  misc_feature (393)..(393): n is a, c, g, or t
  misc_feature (462)..(462): n is a, c, g, or t
  misc_feature (473)..(473): n is a, c, g, or t
  misc_feature (485)..(485): n is a, c, g, or t
  misc_feature (520)..(521): n is a, c, g, or t
  misc_feature (526)..(526): n is a, c, g, or t
  misc_feature (528)..(528): n is a, c, g, or t
  misc_feature (565)..(565): n is a, c, g, or t
  misc_feature (625)..(625): n is a, c, g, or t
  misc_feature (984)..(984): n is a, c, g, or t
taattatcaatgaggcagtcctccttgttgtccagttaaaatctacttcctcttgaaaaanaaaaatacactgaaggaagatgcaaananctaaaantngtatcatgattccacagcagtgattgtaagaaantaagccacangaaaangggaaaanntgaaaanaaacaagtatcaggaccaanttaganaagatatgagtagggccatcactagangtgaaaatggagaaacctaagnnaaccagtnttggcatganttntgcaagtngaaaatacatctgtngngggacgggttaganggccctagntctncctccaagtgcttgtttnncgnntttttggggtttgnnattttntagncttncctgtttagccgcctaaccnctccntntttcagcctagtcttgttacgtctagccgttcctttttttgctcatcacctttcctttttctttttgtnttttttgctgnaggtcagtttcntttatttttccctttcctctcctctcttggtttannttttntnaggtttctgagggggctatgggtcagttggcattacngtgggaggggcttattgaggcagggttggcaataggtcttgtcattctgctccctgatantgcccttcgacaactgtgtcaggcagagagcacacacaaagtgctcaggatggaacttgtaccccatggcactgatacaacggccagtgatgggctgcccacacccatggcagagcgttccccggcggtgatggtaatggagctcacagaatggacgtccatccagttcaaagaaggagccagtagaaaaactggtgaagcagtccccacaaacaaagcactctggggtgccagacagtgtccatgggctgaaaggtagttttccaacactggggcgattgcagccaccacacttggggtgagaacatggctaagaaatcctttcggcaatatggcttcttgtccttctcatgaaagcntctgcaccaacactctccgcagtgag

SEQ ID NO: 619965 - DNA, 1104 bp, Homo sapiens
  misc_feature (1104)..(1104): n is a, c, g, or t
gggaggctcgtcatccctctcgtccgcaagggccatgttgtccttccaacaggtcatacgtggtgtcactgcacgatacctggtggcgaagtctacacgtgtgtgagaagaggtttgtatcatcttctactagcctcgcccatagctgcgtatgcgtgatctcgtacccaagactcattatgatctaacttttggatcgctgacacggtgatgcttttagaaccattagaacacacgcctaatccatgatccaataggagatgttaggaatgatcgtcacgcaactagttcgacatcgatttctgagcgcgagataacgtgaggccaaaatgctagcaggacgtaccaagagatcactctagcacgtttccggcacctgatccgatgaggaacctgcaaccccgacaatcatgggaccctgtgggcatgtctgtcaggtgaaaagcttggtgcctttattgctgggccagcacatgggtatgtagcggccgatctaagaggcctgaggtgcgacaggacgagccatgcgtcagatattggacagcatacttgaagcataacagagctttcccaatcgaataggtggggcgtgcgtagagcctgaccgtaaggaaccctctacctcagtatgatgagttcatcgtgctatccagggatacactcagctccatgtgaggcgatagcgatggcacatggatatacattcaccaatgttcgtatcacactgtggagacagtagtaaccaagctgaacaatgagtcttagcgcaggaaaagggaccattgagtatatgccgtgatcaccagtcttcgggttgaaacgtatacaccgtccacagccgtcggatggcgacattgcactcctgcgcaaaaaaggggttcatgatgggcagtccatccaggcagtgagtcggactagccctagtccgaaatttgagttgacacttggattaggacccagatgcattgcgtacgtgccaatcttcctaattggacccctgggcgtttgaatgaatacactggggacaccttgaatggtgttcctccatcctgggggatccagccattcacattgcattcccccatgcgagaatattgcccccan

SEQ ID NO: 619966 - DNA, 206 bp, Homo sapiens
tcccaaaaagggggcccccccccccccccccttttccccaatttttggtttcccccgggggggtttttgggggggtttgggggaaaaaaccccccccccttttcccccccccaaagcccccccccttgggcccaaattttttttggggtttttttttggggggggggtttgtttttttttaaaaaaaatttttttggggcccccca

SEQ ID NO: 619967 - DNA, 455 bp, Homo sapiens
ccatcttgcttcctaatctatggtcgggagacagcatcaggttaagacgacttctatttttttattaactaggagaaccaaatctggaagccaaaatgtaggcttagatggtgtgtggtctcttgagtttgtcgctcatgtgtgcaacagggtatgaactatctagtcgtggtggccccgtacaatggagagactgttggacacggactggacaagtccaggactgccgaaaggccgcagcgcatactcaacaagcagacgtgcatgtgtcacaaggagcaagggccatgctaagaggaccgggagaccgatgacacacgtggaatacgcccggtgagagaagggaaactgcgggaaccagactatcacaaaaaagaggaaatgtaaggagggaggaaggggcactgaagaatacctcagggagaaccacgacccgacacgacatgtgacgccga

SEQ ID NO: 619968 - DNA, 515 bp, Homo sapiens
gttttaggatcacattttaagactgcaaaacgaaattttagtcataaatgttttaaaacatataactagattggaggtgaaaggtcaaccttaggtcttgcccaggttcatttatcaacacaaatatttattgtgagattcaaaatggaagggaaattgagatgtgagataaaattatttgaacattttaatgtaccttgctagttcagtttaaaacataaaacagatggtagcacagcacaactgccctattgcctccctatttatgaacacccatttctaggagtccctaaaaacagggacaatgtccttgagatactgtctaattaagatttattttcttgtggtttatggtttgttttttcagttctgattcctttctgggccctgaattctgaattctcccctcctcacagtgaagatgagattccccttccccttttgggctaccaagagggagactttctgtcattgacagtggtaccaagtaatcagcttcagtgtcaggatgaaag

SEQ ID NO: 619969 - DNA, 123 bp, Homo sapiens
gaggtggggagcagagaccttctcttatccaacatcacatcttggtcagatttgaactcttcaatctcttgcacctccaagcttgtcaagatagttaagcgtgcataagttgcccgccagtga

SEQ ID NO: 619970 - DNA, 476 bp, Homo sapiens
ataaccaataatcttccaccataattataccaaattcctcttaacacctgcatactaagtgtaatcaatacaatttcgtccgtataaacagactgcgaaaaatcgataaatagcaggtaagagaaagatatatctaagcaattactaggatcattcggacaaagtgagtactgtggatattcaaaatatcacagtaacaagaacatgcttgttcctacagtattgcgggccacaaacttacctgaccgcagaagtgtctgggtgactttcctacttaaaatcttggtcctatcatttcaaaacatctgcctcccggtcggctgcatatgctttcctattgatcccacaccaaatctaagaatcacttcatttaaactactgaccgttatcgaatacttcgaacccgaacaggcgacgtgcacccctcattcatgagaaaaccctcaggaaactcccagggtgatgctcggagcagc

SEQ ID NO: 619971 - DNA, 545 bp, Homo sapiens
tggaaatggagttggttgcccaggctggagtgatgggcaaagtctcggttcacgggaacctccacctccggggttcaagcagttttgcgggccgaagcctcccaagtaactgggactacgggaatggcccaccaggccagggttaattttgtggtattttatagctaaagagggggtttcaccagtttctcaaactccgtgacctcgagggcgatccacccacctaagtcgtcccaaaggtgcgtgggcatatatagggtgtgagccacgcgcaccgtggcctatgaggtggctctttaaattaggaacaaatctatgggaaaaggagagtggactgaagtgggcccacaggatgggtgagcggggcagagcctttcatagaagggctggccacctgggagacgccccagttatacgggggtagtctggcagagagtgcacaaaggctttctgggacagctgccggggttgggccaagacctggtctcccctcccgcgggccaaccccaagtccccttccggtctccactggcataacagagggg

SEQ ID NO: 619972 - DNA, 993 bp, Homo sapiens
  misc_feature (90)..(90): n is a, c, g, or t
  misc_feature (383)..(383): n is a, c, g, or t
ggtgggcgaacatctggtcagcatcaatgaaaaatggcacagccatgtgttgccaacaggccccgtgctctactcatggtgcgtccagtncggagactttggtgacgcccgccgtaggccaataggtctatggccgcggcctgatcagtaaggtcctggtactttctgcacgcatgtctgcacttcaattcgctggtacacaacgggaagttgcaaggcttaatgtgtcgtgcattatcccttgggcaggatgtgcaacgtgctccacagaccacacacgatcgtgactaatcccatgcatccgcgcagtgacactgcgagatgcatcggcaggcttggcaggatgtgctcctagctatcctcgtagccgttgccgtgcgggntattagtactctgtctacttccaccaacaattctgcatgaccgatgcactgtctgaccgtgcggagtgcaccgattctgaccgatgagagagtacaactgtgagacggggaaagtagtcacaaggaggagccatcagcgccgctacacgagctcggggcgcaccggtaccggtgggcgcacgtgatcgggaaggcactatatgtgcacctgaatagcctgacatagactcgccagtaacatcaaacaggcagatgagtgatggtcagggcgccaacgtcgaccaaggcacccgtctggacccgttgttgactagaggagccataggactttggtgtccccaatagagcggacgagaaacttcagacatctggccgttcccgggatatttggtagacacctcagaggaagaattgggcgcagatggcaaacaagcggatcaaatgccgttcaaatagttaacccggtttggggcaaggtcgacaggtccaacccgggcaatggccccccatatcccaggtttcaacccgttggggagacccagcatttggttggaaagtgaaggtgcgccccaccaaagggtttggcctggagcacgtggaaggggccccg

SEQ ID NO: 619973 - DNA, 400 bp, Homo sapiens
tccccgcacagtcaccaggattacgtgcgttcgattgctaagtgttttacagtgtctgtacatcaaagagcccatgagccgtgtcatgagactgtctattaccatattcacttctgaattgggcagaggaaatctgaatgtattatcctgtgtgtgtctaggtatagatattggaatgctgccaggggatatcgaagtattgcaacctttataggataactgatggcaatattaagacagacgcctgctttagcgaatcacttacaatactgtcatttccaaagatctgactggggctttcctgattttggtatctaaggcttaggcctattgattgatttacctttggaattgtgctcccaatgtctactgaagcttaaccgaagaactactaaatgga

SEQ ID NO: 619974 - DNA, 93 bp, Homo sapiens
ctaatcgagctcggtcctggtgaggctgcagtgcagtgagccaagatcgtggccatatgatcagcctggataacaagagtgagactccatctc

SEQ ID NO: 619975 - DNA, 194 bp, Homo sapiens
gagaactggatcacgattccgtttaaataaagcataagttttcttattgtggtgaaatgacacacttttggacagcaatcaaagtatttcattttttagaaggtagtattattaactatcattttaccactcccaaaagggtatgttaattattatacagttgggcaatgtggcttctgcctgtaatcccaaca

SEQ ID NO: 619976 - DNA, 952 bp, Homo sapiens
gctgatccgcgggtgtttgctcccccggaggggagggttgggtgccgaggccatggtccccaagatgaggtgacccgatgttgctgtcgcgcgtggtgtccctcccgcgggtgtcgttgggtccccggcgggggggtgtccttgcctcgttagctgtagcctgtctgttgttgcgaccgtgcggtggacgcctcgtgtcccgagtgtttagatatgatctcgttgcggatgcaagatcgctagagatatgcgtgtgattcccccgcggctatagttcgttgacgagacgaggatatttgctctgtgtctgaaagaacccctctccggtttgtcggaggacaagtattccccggcgatcatcttgttcccacagatttgggctactaaaatcaatactaggaatagccatcccctcttgatacttccccctctctcactcttagtatgatcgtctcggcatatattgtgttgtcgacaatagtagagcaatagtttgttacctccaatacaattcattatcctctaagagcccacaaatgcaattattctctcctctctcgcaggagctacagattctctgtttgtgtatgagtggtatagaaatcgcacacaggagcgaccgatcgcctctcgatttttatctctctctatgattgtgatcctcctgagcgacatctgcccccacaaatcttttaccacctttctttatattagacttttcattcgtcctcccctccgagtagtctccctcctcggtcactctcatatcgcccaatagttgtttcgatgacgacgtatctacccccctgtgctattggtgaaggagcccccccacgaagattttactccacgaccacaatattatggtaatcacttctgtttacaaccgcctgtgtcgagaggcacctaatactccccgaaaggccgcattaattctggacccccacaagac

SEQ ID NO: 619977 - DNA, 572 bp, Homo sapiens
tgtagtggctcacgcctgtaatccctgcactttgggaggccaaggcaggcggatcacaaggtcaggagatcaagaccatcctggccaacacggtgaaaccccgtctctactaaaaacacaaaaaattagccgggtgtggtgatgggtgcctgtagtcccagctactcgggaggctgaggcaggagaatggcgtgaacccgggaggcggagcttgcagtgagccgagatcacgccactgcactccagcctcggtgatgaagggagactccatctcaacaaaaaaaaaaaccaacaaagcaaaaagcggtggcatttgagaaaaccgggaaaccaaagaaccaaccaagccttctaaggaggggtgacttaaattttaagcgcaaaagcattaagggtaatcacttctagcttttaaaagatagttaagagtctgggccatattccctagtggtagcaacagtgactatctgtcacaaccaagggcaccgggtacaatatcagtgtgcttctctctgcctccataaaaactcatttggaaacagaccctctggggaccccagaaggtagtgtgc

SEQ ID NO: 619978 - DNA, 639 bp, Homo sapiens
ggaagagggggggaatcaccagtgttacaaaattagaacgattgttttgcccggcccaggctagtcttaaacttctgacctcaagtgatttgcttgccctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagattgcgccattgcactccagcctgggcaatgagtgaaactctgtctcaaaataaaaaaataaaaataaaaactattttgttgactttttgtttttcatcttagtctttcggaaacacgactagtttgccaaaaggtacaggagttaatcttccagcaatataaccttcacaaacttacgcatttgcgtaccccaagaagttgaaccagcgaagaatctttggtcctttggcgaaacgaattccatttatttaaggaattgcccaaagcaaacgggaagaaccccaaactggctgaactttttcctggggttaaaaccccttaatttttg

SEQ ID NO: 619979 - DNA, 176 bp, Homo sapiens
  misc_feature (20)..(20): n is a, c, g, or t
cactctaagatcattacatngtactgcgattgttaacctcaggaggagagacaggtgtgtctggcgacagagagagacaggtgtggacgctcagcaggtcagcacttgtggcggcacatgacaggctcttgaggtaggggaccgttgcacgatgtgagcggcgtcgaagaggggct

SEQ ID NO: 619980 - DNA, 305 bp, Homo sapiens
  misc_feature (259)..(259): n is a, c, g, or t
ggacgacactataggatcccccgaggtgcccttataacttcaccgccacgttattgtgcagaaaggcagcggtatccgcatgatgatggatgaccttgagctgaacatacatgtcccggcacctgagctgcagtcttgcatcatcgccatcacgggcctcgctgcaaacttggaccgggccaaggctgaactgttggagcgtgtgatggatgctcaggccgagcaggaggaccgtgctttaaggagtcttaagctgagngtcactgtagaccccaaataccatcccaagattatcggcagaaagg

SEQ ID NO: 619981 - DNA, 423 bp, Homo sapiens
tccattctgcatagactgtccatctgcattagctcacccctcacttgtccatatggttcctatttacttagtcatcccatgtttatctcaatgcccccatgccttctcttgggtggacggcacagattaggaaactcccctggcaggcaatttcagcatccttctgggaagtgcccacccaaagaagagtcattgctctggacacctgatatccagcaagaagaaggccaagaaagtgcggaggccagtaaggagatcagggcagggaggggggattcctcccaggggtgacatcaagcctttctagccaaagtctgcagaggcagcccccatatgatctgcggaaccgtgcgggcagacaggacatgcggaagcagcctattctcagccactcagcgcagggcctccgctctgctctcccct

SEQ ID NO: 619982 - DNA, 209 bp, Homo sapiens
tgggtccatgtgctgtggcaacactgacccaggagggtcagaatggcttcctgtaggagatgcccagcagtcctgtgaatctgtgacagctcagtagttagtccacgtgacaggctgaagtgggaattccctttcatcccagccaaaaccataggtgtggtgccggagtgggatgtgctcggcgactctgtccagtctgttttgtaggt

SEQ ID NO: 619983 - DNA, 806 bp, Homo sapiens
gcctgtaacggggcggggtagtgtccagacacctgcggggggggcgacccgcggggcgcgagatgtggcccctggtacggcgctgttgctgggtcgggtgctgcgatcagtcaggtactattttagtaaaaccagagtctggtagaactccacgtttggtaatgacacttgtcgtcattccatgcgtttgttactaaatatggaggcacaaaaacactactgaagtaaatacggtaacggtggcaactttagcacgggacgagatatttacacctttggatgggagctcttaaacaaagtccacttgttccccacgtgacttttaggtagtgcaaaaattgaaggtctcgacaattacttaaagggagatgccttctttgacgatggataagagttgatgctgtctcacaccacgaggaaactacgcttgtgaagtaaccagaatttaaccagagaaggtgacagtgatcattcgagctaaaatatcgtgtgttctcatggtttttctccaaattgaaaatattcttatggttattttcccaattttgtgctatactcctgttctggggacagttggggtattaaaaccacttaaatatagatccgggtggtatggatgagaaaacaattgctttactttgtgctggactagtgatcactgtcattgtcattgttggagccattcttttcgtcccaggtgaatattcattaaagaatgtactggccttggtttaatttgtgacttctacggggatattaatattaacttcatactaattgttaggtacagggattggattaactct

SEQ ID NO: 619984 - DNA, 525 bp, Homo sapiens
  misc_feature (22)..(22): n is a, c, g, or t
  misc_feature (127)..(127): n is a, c, g, or t
  misc_feature (153)..(153): n is a, c, g, or t
  misc_feature (517)..(517): n is a, c, g, or t
  misc_feature (519)..(519): n is a, c, g, or t
aattgggcacgaggaaagaaanaggggttccaactaaaagacccagccccccaggttcaaatgtccctcccgaaagaaatgaagtctttcccctggtgaatggtccccctgcccctgtctttcccancatcccactctccccttgtccccccngggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactccancncaaaaa

SEQ ID NO: 619985 - DNA, 822 bp, Homo sapiens
  misc_feature (822)..(822): n is a, c, g, or t
agccccccctgctcactctgacccactaggaacaccacgttgttttcttcactgtgaaagagaagagcttgatattacttcaagttttttgaaagacacctgggattttcatcgcaaaaagatcatcacctaggcacatcgtcgtcaggttatccaaagttaagatgaaggaaagaatcttaagagctgtgagacagaagcaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggcgcttagctatttatttctgtatctattggtgttgctcaaactgttcaagctttggccattgggagctctttcacattggctcttgtgtacttttggcatgccctcatccactttgtatgggagcacttcctctttctggcaccacaggatgctccaggctcatcttgtgatttcttctcctgactcgcgcctagacttagacatttctcctaggagccctcggcccctcttacctttcttatccctctcgcaaaccgcgctttcaaacccacaccctgctgaatggtcgcgtctttgctcccgacgccgacagtgctgcttcccattctcatcggaccgcactccgcattccctagtttcgcccccaccaccctgcttttcacctcccgccatttgtccccgccaccttttatcttgcctaaccatcaccccctgcattcaaccttgatctcgcactctn

SEQ ID NO: 619986 - DNA, 441 bp, Homo sapiens
gatgattgctctcagttggccattgtcaacttctgatggccggccactaagctcttcatcttcaaggctctcgtgtcctttgcaaaacttcctgaaccaccaaatgcattgccaaatgcattgttgatgttgcgagttgtcttcactgctttacaacccgttttgaactcaaataaaaaaattgcttgaatttgctttttgtctaacgtcatttccgtagtctaaaataaatacaaacagcaagttaatacgtcattagcaaaaaaagtgagaagtgtgcattaaaatgatgcataacataaccacattgatttaagaatgtattccaatatcaaacagcagatttcagcaaatactgcagttacttttgcaccaataatttgtccacgtgcaaagttgagtcaggcaagggggcccaaagctggtactcaacgtcctaaa

SEQ ID NO: 619987 - DNA, 282 bp, Homo sapiens
cagtgcactccacaacaggatggacaggatggagctgcgtacgtgtcaccacctcctggcactcttccgacaggactcggcagctcgagcacatttgtcaaaagcgtcgagtattctttctcagtcttgtgttgtcatcagcttggcaccattcccttcaccaggggaaattcacacacctcacagtaaacatcagactttgctgggacctcgtgcttcttaatgggctccacccagttccagggcagggatgacatcttggaggcactttggcggggacca

SEQ ID NO: 619988 - DNA, 464 bp, Homo sapiens
  misc_feature (20)..(20): n is a, c, g, or t
  misc_feature (57)..(57): n is a, c, g, or t
  misc_feature (91)..(91): n is a, c, g, or t
  misc_feature (105)..(105): n is a, c, g, or t
cagcgttcagaccaaattcnttgatatgagctcagctttcagcaagacaacaaagancccctggcccagaagaagtgctgggagaacatcnccattgccagatcntacttggggctagtggtgggtggtagcctgctcatcatcctgattgagcagctggccatctttctccctcagagtgacaccagtaatgccccacagacttaggatgcaggcaccacctcagggcctggggactgacagctggtcctgagggagaagccaaatggctgcactggctggttccggtctccagagaacttgggttttttctcccccccaccccacccaagtaagtgaaaaaaaccacccaaaacaccggcactcttttattttttgtcatgccacagaatggccctcgagggcaccctgccatactggccatgccgggccagccccacctgaagctcagtgaaagctgatta

SEQ ID NO: 619989 - DNA, 134 bp, Homo sapiens
tcagctcggtaccggtacatctgacccagtacaactccagtaggcctgtcaactccagtaggcctgctcttcagcctaatactgctctgtgggaaaacttggtcccatttcccccaggctcctcaacacacacc

SEQ ID NO: 619990 - DNA, 489 bp, Homo sapiens
atctctctctgttgcccaggctggagtgcagtggtatgatcttggctcactgcaacttccgcctcctgggttcaagggattctactgcctcagcctccctagaagctgggattacatgcgcccgccaatacgcccgcctaatttttgtatttttagtagatacggggttttgccatgttggctaggctggtctcgaactcctgacctcaggtgatctgcccacctcggcctcccaaattgctgggattacaggtgtgaaccactgtgcccagcccttggttaaatagttctattgatgtttccaaaagttcagattctttctggaaagggaggactgcactaggaataatcatagaatcaaaactttcatgcacaaaaagacacatgagcatcatctaataaatattccttcttgttacagatgagaaacaggctgggcatggtgactcatgcctgtttacccagcactttacaaggccaagatgggag

SEQ ID NO: 619991 - DNA, 300 bp, Homo sapiens
ccccaatggaatccatctttcagtatgcttgtcggctgtttatctttggagaaatgtgtgttcaattcctttgcccattttcaaattgggttatatgctttttttgagttgtaaaagttctttatatattgtggataatatacctttatcacataaatgatttgcaactattttctcctataagttgtcttttcactttctaggtaatatcctttgatgtgcaaaagttttttatttttatgagttccaatttatctatttttgtggttgttgctcatgcttttggtgtcacatgtaata

SEQ ID NO: 619992 - DNA, 581 bp, Homo sapiens
  misc_feature (581)..(581): n is a, c, g, or t
ggcagtgctcctgtttctgctggtcgtctcttgaggttcccctctatgggggagggaggcgctagaggattctagtggctgttgcctagtcccctatcgttcacatgttcctggtgaaggagtttggcttctgtccactcctgtctctgggacggctacctgagtcctagagatctcatcctgagcctgtctgcttgcggtgtgtatccacagtgcgagaacgagtttcatggcagccggaataggacaacatgtgcctagtataactaaaatgggctttatcaatgttgctcttgtatggaggtgttctttgactgctgaaagacatcatagatgacacaaacaaatggaaacacatcccatgctcatggatgggtagaatcaatattgtgaaaatgaccatactgccaaaagcaagctacaaattcaatgcaatccccatcaaaataccaccatcgttcctcacacagttagaaaaatcaattctaaaattcatttggaaccaaaaagagagcccatggagccaaagcaagactaagcaaaaagattaaatcggagggtatcacactacctgatttcan

SEQ ID NO: 619993 - DNA, 1083 bp, Homo sapiens
  misc_feature (1083)..(1083): n is a, c, g, or t
atcccagcactttgggaggccaagacaggtggactcacttgagcgtcaggagttcaggaccagcctggccaatgtggtgaaagcctgtctctactaaaaatacaaaaattagctggtgcgtggtgtgtgcacacctgtaatctcagctactcgagacgctgaggcaggagaatcgcttgaacccgggaggcagaggttgtagtgagctgagatcgtgccactgcaccccagcttgggcaacagagcaaaactctgtctttaaaaaaaaaaaaacaaaaaaaccaaacaaaaaaccaaaaaaaaccttatttgggctgggcggggcggtggagccttatgcccacaatcccagcatttggggaaggccaagatgggaggatcacttaagcccagaaagtcaggagaaccagcactgggactacagaagtgaaggccccaaacatctacaaacaaaaccttcaacacacattagcccagagggatgggtggcaccgccacgtggaggtcccagcgagcaccaggaggctgaacgccgggagagaaccatatgagacccgggagaggctcaaggctgcacgggacgccaatagtctacagccactggcaacaccatgcctgggcgccaacaatcccgtgatactccacaaaatctaacgccttaccaaagccgtaactctgtatagagaacagccacttcagcactacacaactatcacacaaagcaatgggccccgaggaccggtgctgtgctcaacgtccgggaaaatcccgaaagaaccttctcgagaacagctaggagagacaacggagggagataaccacagaagcgaccagaagaagttccagaggaacaaacgacttgagaccaaaacaagacgagcacagagcagccatgggtacaatcacaaaaacaagatattaacacagaaaacaaagaggcataaaagacctgtgaatagagaaaggacacgcaaatgcgaaagaccccaagggacataatcagcaaacgcataagggccccgaggaacaaatgggccggagaaccccagagaaggacaagcggatagcacgcgaaacagagan

SEQ ID NO: 619994 - DNA, 193 bp, Homo sapiens
tcacacagttcaggagatgtgatggggctgatgggctcatccggataaatccgggctgctgtaaagaagttaaggcttttgaaagctttccagcgcctgctcctggctcacacagatttgcgccttccctctttacttccttcctcctcgcctttccccttcttcttcctcccttttctccgttctcctctcc

SEQ ID NO: 619995 - DNA, 152 bp, Homo sapiens
ctcgtcatccataacctacctacatgtaggttacaagctgctagcccatctctgaaaacgtctcaatttccttatctgtagtggcacatctatcctacaaggaaatcatagtaacagagtaccatctgctatactactactacctcagagaa

SEQ ID NO: 619996 - DNA, 200 bp, Homo sapiens
  misc_feature (49)..(49): n is a, c, g, or t
  misc_feature (86)..(86): n is a, c, g, or t
  misc_feature (139)..(139): n is a, c, g, or t
  misc_feature (173)..(173): n is a, c, g, or t
  misc_feature (190)..(190): n is a, c, g, or t
ctgggtcccgggagctccttctgcatgctggccatgtcgtgccgcacgnctgaggacaggaggtagagggagccctcccgggaccnaggaccccccgtggtggactccgcggcacatgcttcccaaggtggtcccacgnagggtgttactgggcaccagtggacttcggcccnatgggcccgttcaaaanattttgaggg

SEQ ID NO: 619997 - DNA, 259 bp, Homo sapiens
gccaggattctcaaacagagcattcatactgttccccaatcagattaagaaatagatttagagccgggctcagtggattacacctgtaatcccagcacttcgggaggctgagatgggtggatcacgaggtcacgagatcgagaccctcctggccaacatggtgaaatcgccatttctaaaaatataaaacttaactgggtgtggtggcacgcagcctgtagtcccagtctacacagtgacggctgaggcagggagaaat

SEQ ID NO: 619998 - DNA, 172 bp, Homo sapiens
cgaggtttcccaagcttcatcagtgaacaactgaaaaatatagactataaactttcaaggccaaaagatcagatttaagggcataccttttgaatgaaggaaacaggcagtataaagttcctagagaggtattatcatatgcaaatactaatgcccagcttctttcagtaat

SEQ ID NO: 619999 - DNA, 524 bp, Homo sapiens
ctcacatagccctcgttggacagccatgtcatgcgaaccccctgagcttcaaccggccacagtcaatctcataaatcgccccggacttacatcctccttactattctggcctagccaactccaacttcgacgcactcaccgtcgcatcataatcctcttctcaaggacttccaactctgctccccactaataagctttttgaagaattctagccaacctcgcttacctcgccctacccccccctattacctactgggagaactctctgtgctagtaaccacgttctcctgagtccaaatatcactctcctacttatcaacgaactccacatactatgtcacagccctatactccctttacatatgttaaccaccacaccatggggcgtcaactcacccaaccaccttaccacattaaccctccttcaccaaccgagaaacaccctcatgttcatacacctatccccccttttcctcctatccctccaccccgaaatcattaccgggttttcctcttaaaaaaaa

SEQ ID NO: 620000 - DNA, 162 bp, Homo sapiens
gtctgcaactgtcaggcatgcaaactaaggtactggcgcggtggtattacaacgctgcgtgcaggtcgtagctgctccaggcaggctgaggccaggcagaattgcttgagcctgggaggtggcaggttcacgtgcagccaagatcacactcactgcactcca

SEQ ID NO: 620001 - DNA, 971 bp, Homo sapiens
ggtatacgtagacaacataccaaatctacctttagtacctgaaaaattatagtgaatgcatttgtcgaagtaaacgtataggctagcgacttagaatgcgtggacgcataagatatatgatccctgacagattcgctgataaatgcatatatccaacaatgactattcgtcagatgggtgatccgtatcataacttatgaatgttttcttatcatgtatgtatctgggcgaggtagagccatcagggtaagcattccctcagaaaacactagcagtgaggtagctaggaacagctaggtgagctgaaccctgttcttatgtgcgtcgtaaccatgatgggagaatcctgatcgtggtacgagggtgatagacttatcgacactggaaaaacgctggttgtccaaccgtagagttctgagatacaaatctctagatgtgaggtccctgcaggaacactctactgaattctcactcggtaaaggttttaccttgtcgaagtcccgaagatgcgaaactgactctctcggcaggaaggaaaaaaaacccttgttagaagagagtaaaaaatttaacacccatagtaggcctaaaaagcagccaccaattaagaaagcgtcaagctcaaacccatacctaaaaaatccaaaatataatgaattcctcacacccaatgacaatctatcaccctatagaaaaactaatgttagtatagtaccatgaaaacattttcctcggataagcctggtagattaaaacctgaactgcagttacaagcatatttaaatcaacaaagtatattaccttatgtacaaacggctgcctaggacgttaaagaaaggcgggaatttccgcgttcaaaatacttaggtcaatatagagccgcagaagtgtagcgggcaacgcggggaaatccaagggcaacggggtataaggcgagcagcacagcttacagccctacccaaatttactcg

SEQ ID NO: 620002 - DNA, 556 bp, Homo sapiens
cctgacgcaattgctcgcaccattctcaatcgccccagaccacccgccaatcaaaatagatgctcgaacccagcaggttctctggcgttgcatcgcgaataaacccggcaaaacgccgcgcccattcggttcgggacaggcacagctcagggttgccggccatgatattgcccttgcccagggtgaagccgcacagcgcccaggctctggttgatctgctgtgttaggggcagcaagcggccacgaaatctcggcggcctcggcggcgtccttggcttcgaacagaatgccgttgccctggccggaatacagcgtctgctcgcgggggccttcgttgcggaaaaacaaccaattgaacggcacgccggtgtcgcccttgtcagccaaggtcaactcgatgacgcggcacaccgtgttgtcctttgagcaagggtgatgatgttgggtaatctgcgtgaccaagcaccgtgggccagcatgcgtcccaccaggtggccgatttcgccacggatcgcaccaggtttcgaccctgggcgcattggaatggtgcccccaa

SEQ ID NO: 620003 - DNA, 115 bp, Homo sapiens
cgaggagctttacatcaaacccttcttcagcaccacaaacttattctcagcagctgtgcggggttcctttcatcttcgtacttattcttgaattcctccaccagggtttcgatga

SEQ ID NO: 620004 - DNA, 1031 bp, Homo sapiens
agccggggtgtagatgcctgggaccgcagcgcctgccgctcgctcggcgctgtagccgccgctgccgccgctgctcttgagctcggggacgcgggcgggctgctccgagatggctctggtgcctgctggctgctgctctcctccggcgcccggggctgctggccgctcctgggtcccggcccctgtccctggccatctctcgtggtccctgagcccctggtcccgggtacccgcgtcctggccggagagaacgcactcagcatgctacgagccgccccgggctcgcgcccaccgggccatgaagaggggccgtgaggcgcgcgcggagtccggagcgaccgacggagggacggcagggaggccgacggaggagggcgcgggatcgccggaaggatgcacgccgcaggctgctgaccgacgactgcaccccgacggagtcccacgagtgagcctgacgtccagacccgaggcgatggacgcccggcgcctgggccgctgcagactgcataccacgtgcagactatccccggaccaggggttagctgagtgatcacgactccggatgcatggtttggacacgaacagaccttatcgtcccccgacgcctagcaattcccctggaagtgcagaccctgtacagaccccttgtatgcgccgaggtcttgataggcccacaatggactagcagacccactgatgtccactctgccagcctgcgcgcgcgtgcaccaccctcaggtgtgcctgttcggaccatacgcctaacacagggaagcaggtccgctcacatgaacctcaccccccatgtgggacaaacccaagtcccagcatggacagaggtgtgcccaagacctattggaactggatccctggtcaacgcggcacggacagaccccatccctccacattgtgaggaccaccgttgtcaatacacggagcgcccggggaaccatcgccgcgacgcgtacacacgtgcctagtgctccccctgtctctctacccattgcaccgctcggcccatgactccacac

SEQ ID NO: 620005 - DNA, 375 bp, Homo sapiens
ccgggcaagtaactataacgcgtctctaaggtacgcgcaggcctgaggtggcgcctcactcatcatcccagtgggcatcaccttcttcaaggacgagaccaccgccctgtggatcgtgttcaacgtggtctcggaccaccttcttcctcgtggacctggtgttgaacttccgcacctgcattaatgaactcggcacccccgcgctacgaacactgcctccacccgcaacccagcccaaacgaagccacccccaacgcacgagacacccaccgaacacacccgcacgccacaccaaccccacactcacacacaccaccacacacccacacgcaaacacaacaccgcaccaacacacccaaacaaaccacaacacaa

SEQ ID NO: 620006 - DNA, 145 bp, Homo sapiens
cggtattcagaaaggatcatactttacatttaaaagtatatgacgtttctttctagaacatgcctcttcagtcttggttaccattttacgcgctttcgaagtagaatctagttttcatatacaaaatagagttaccttatctgaa

SEQ ID NO: 620007 - DNA, 407 bp, Homo sapiens
aaaagttggggattactggcctaaagagtatagaaaacagtgagattgaatacatcaagccaaaacagcaaaagtaacagtttttggacttcactcaagttaaaagggcctaagaagaatgtattaaaggatttcatagaagcagttggtctgtggttcagttgagtatttcgtagaacacagtttttatttggagctggatgtgcagccatcatgaaaagagtgccccaaggacctagaactggacttagacaccggccaagtagtggaaattcctttgaacttttggaagcccaactcaccaagataagtgtattcaactgggttccttacctaagctcagtatttataatttttttatttgtatgtcatttatccagtaaaattccttagtctttagtaaaaaa

SEQ ID NO: 620008 - DNA, 165 bp, Homo sapiens
ggctgtcatcagatttgatccagacactggctttggtcgcatggacttgcactcagttaggagacaggccatgctttcatgtgcatcagctcactgatttcatcctcagtttccgcactgtgccccaccatagtgtctgtccgacaagcctggcagaaggcagac

SEQ ID NO: 620009 - DNA, 1360 bp, Homo sapiens
accgtcgtttcctctcttctctctttctttcttcttctgtttgctgtctgtggttgttctgtctcacgggagagacactcggacgggcgcgagcgcgctggcgggggcggcgggtacggcgggcactgtcgtggtgtctgacatcttgagtcggctacttacacgacgttcgtctgctaactcggtggctggagggtggtggactctctacatcgtagggttgacgcctactagtttctgcatagtggtgtgtgtggtgtgctcgtccctcctcgtgatgtatattggtactcgttagtttgttggagacgaccaccttttttgctctgttgctcagacacgctactccagccggtgtgtgttgcccccacgcttttggtgcatcaccaggaggtgtttctggcggcgaagtgtgcgcgtttggtgtgcaacctagggggctcgtctgctcgccgccgctgtgttggccacccacgtgggtgtgtgctgtcgcacgctcgttctctagagaacgcccgttgggggtgggtgctcccggcctcctcgccgccaacagggtgggctgcactgtttttggggcacccggtggtttgccccccagctggggcgctggttgtcaagagggagggtttctgtgtaaaaggtcttctccggggggtggctccacccttggggggccggcttatcgccccagcgtgggtgtggccgcctccgtcggcgcccgccgctcggtgggggcacattggtctctctccgctctgccgccggtgggcgggtagaattggtcgtttgtaccgtgcgcgcgattgacccccgatcttgtgtgcgggcccccccccgctcatctctgtcggatatttggggtttcgtggggcgtctctagagagcgccgcggggttgtccctccctgccgcggcggctgtgggtggctctcacgacccgcgccgaggtatgcccgcccacccctgttgttctattataaggggccacgcgtcggcgtgtccccctgctggtgcgtcaccacggggctgtctatcaggctccccgccttgtgcgcccccacctgtgtggtaaccccctcgcccgttctccacgcggtgtgccaactcgcccctcccttttctcccccgcgcgtatgtgggcgcaccacaccgccctcttctatggccccacgcaggtctctctctcggcgggctctgcgtgcgctccaggcggtcactcccgtgtgtaccccgggcgggctccaagggctcccgccaggtgaggggtgggcctctcgtctctctctggcctcctccactccgtgtggcccgcccaggagccctgaactctccctcgccccgacaatgaacagaaacaa

SEQ ID NO: 620010 - DNA, 245 bp, Homo sapiens
actgctgtagccatgattgcggactcagtgaacgtggctgtagagcttgaaaaggttgtctcgcactctctgcctgtaggggatacagtggatgaaggcggttccatcattgcgcatgtggtaaatgagccggcgagagtggttgatggagtgcattcaactgttgcgtggagtgtactggtggcgcctcgaggtgaggagatactctctgtgtgagtggtcccagcactactttcagacataga

SEQ ID NO: 620011 - DNA, 118 bp, Homo sapiens
aagagggagccttggtaaaaaacaagccaaagcccccaaggacctcagcccaggcagagctgctctaggacctgggcctctcagagggcgtatctgccatccttgtctccttaggcca

SEQ ID NO: 620012 - DNA, 142 bp, Homo sapiens
cgctaacattactgtaagccacctactcatgcacctaattggaagcgccctcctaccaatatccaccattcaccttccctctacacttattatcttcacaattctaatactactgactaatcctgacatggtcgccaatccg

SEQ ID NO: 620013 - DNA, 957 bp, Homo sapiens
  misc_feature (24)..(24): n is a, c, g, or t
  misc_feature (238)..(238): n is a, c, g, or t
  misc_feature (287)..(287): n is a, c, g, or t
  misc_feature (291)..(291): n is a, c, g, or t
  misc_feature (306)..(306): n is a, c, g, or t
  misc_feature (313)..(314): n is a, c, g, or t
  misc_feature (319)..(319): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (346)..(346): n is a, c, g, or t
  misc_feature (350)..(351): n is a, c, g, or t
  misc_feature (353)..(353): n is a, c, g, or t
  misc_feature (376)..(376): n is a, c, g, or t
  misc_feature (391)..(391): n is a, c, g, or t
  misc_feature (394)..(394): n is a, c, g, or t
  misc_feature (396)..(396): n is a, c, g, or t
  misc_feature (415)..(415): n is a, c, g, or t
  misc_feature (418)..(418): n is a, c, g, or t
  misc_feature (421)..(421): n is a, c, g, or t
  misc_feature (423)..(423): n is a, c, g, or t
  misc_feature (451)..(451): n is a, c, g, or t
  misc_feature (454)..(454): n is a, c, g, or t
  misc_feature (458)..(458): n is a, c, g, or t
  misc_feature (462)..(462): n is a, c, g, or t
  misc_feature (481)..(481): n is a, c, g, or t
  misc_feature (498)..(498): n is a, c, g, or t
  misc_feature (531)..(531): n is a, c, g, or t
  misc_feature (549)..(549): n is a, c, g, or t
  misc_feature (556)..(556): n is a, c, g, or t
  misc_feature (576)..(576): n is a, c, g, or t
  misc_feature (591)..(591): n is a, c, g, or t
  misc_feature (595)..(595): n is a, c, g, or t
  misc_feature (604)..(604): n is a, c, g, or t
  misc_feature (624)..(624): n is a, c, g, or t
  misc_feature (628)..(628): n is a, c, g, or t
  misc_feature (835)..(835): n is a, c, g, or t
  misc_feature (839)..(839): n is a, c, g, or t
  misc_feature (850)..(850): n is a, c, g, or t
  misc_feature (947)..(947): n is a, c, g, or t
caggaacatcctctactcccagcncccacctgtcccttcccacatgctgagggtgaattagatactttgagatcaccctggggctgctgggagctatgggggatgctgagggcaggccccagtattccggctaaccactcccagcccctgggccggccccctagcccaggacatccaggtagacaggaggtgcctgggccagggcttgcagccgggcgtgcacatccttgatgctgtngcgttgctggggctcccgctgccagcagccccgcatgatggcgtagacntctngtgggcaggcacgtngtttttnnaactnacgtncctncnttatgcagttgatttntttnntnttggagagctggtaccagggctnctttctgtagttaanatntnccagagcaccacgccgaanctncanangttgttttttttttttaatttacggtanatnatgntctngggcggcatccagcgaatnggcagcatggtgcggcntcccacacggtaatagttggtgctgtagatatncctgctcatgctaaaatnaccaatnttgaccaccagttcctggcncactagatagttgcntgtngccaggtcncggtgcacaaaatgcagatncgcnatgtacaccatccccgcagcgacctggctagccacggccagcagctgccccagacccagggggcctggagccacatcctccccaccagccagcagcttggcatcaggtccatgggatcggaggaagcggttgaggtcccgtgccgcatatactcaaagaccatgagcagggggcggcctcggtgcagacgccgaagaagcgcacgangtantggtgctgcanatggtgagcagctcagcctcacgttggaagtctgccgagcactctcggacgcctccttcagtgccttgacagcaccagcatcttgtcctgctcaggnaggaggttgt

SEQ ID NO: 620014 - DNA, 280 bp, Homo sapiens
catcatcatcgtctggagcagtgatctgtgttgaagctggagaataggacagatgcatcacgggtggcttggcgttgtttcagaaaaagtgcaggaggatgagttccgctatcgaatgtaccagactcaggtctcagacgcagggctgtaaccgctgcatggtgacagcctggtcccctgtcaggggcagcctttggcggagaagcagcaaccagtcactccaaatcctattgagatagacttcccaaacctcaggtcctatatttcatgcttctgtgcg

SEQ ID NO: 620015 - DNA, 207 bp, Homo sapiens
tccagtacccgagcatgcttgaatgccttgtcgggtcgacgtgtattcacgctactgcggtgcatgcctccctgtactaagtatccgtcgacacgtgagcaccgtgctgagctccaaatatcgttaagctggagcctggtcgacgtgtattcaccactgcggtgcatgcctccctgtacaagttccgtcgacacgtgagcaccgtgc

SEQ ID NO: 620016 - DNA, 489 bp, Homo sapiens
  misc_feature (54)..(54): n is a, c, g, or t
  misc_feature (82)..(82): n is a, c, g, or t
  misc_feature (191)..(191): n is a, c, g, or t
  misc_feature (224)..(224): n is a, c, g, or t
  misc_feature (249)..(249): n is a, c, g, or t
  misc_feature (386)..(386): n is a, c, g, or t
  misc_feature (389)..(389): n is a, c, g, or t
tttttaagaaagagtgatgcttttgtgcccccttttcccattcggaaagcgganctgtttccggagaaagcccctggcccanaatggagctcctttcctccttccttcacccaccgtcatgcagaacttcccgccctcaagtccctccccagtcaccctaaggaccattgaccgtgtcccccccaaagcancgtggctttgcccacgatccccacgaaactacncccatgagcttccctgccccctgancgagggctgtgccggtgcaggtctggtgggcggggccagggaaaggcggggtcagggcggggttcgcggaagaggcgggtataagaatggggggaagatgcgggaaaggaaggggcgtggtggctagagggaagagnagnaacagaaggggctcagttcaccttgataaggtgcttccgtggtgggatgagaggaaggaaacccttacattatgctatgaagagtagtaataatagcagc

SEQ ID NO: 620017 - DNA, 279 bp, Homo sapiens
cccaaacaaagcccccgggtacaggtccaacttcggagggaaaaaaccttgtgtgggactgttattcccagggctccagcaagcccctccctgggtgacctcgggcaaggccctttttgggcctcggtggcctgtggataaggaggggagacccccccttgcctgcctgcctgcatcccggggccattgtgaggttgggggaaaacctggccgtggagctacaagcttgtgcggatgtcaggggccatttctgttgctaataaagtccaaagtggccca

SEQ ID NO: 620018 - DNA, 448 bp, Homo sapiens
  misc_feature (180)..(180): n is a, c, g, or t
  misc_feature (441)..(441): n is a, c, g, or t
  misc_feature (448)..(448): n is a, c, g, or t
ttttgctaaggttggcatagggatcgtttgccttcaagtccccttctttctcttccttctcttcccctgagccctgctcagccatcctttttgtctctgtccttcccttgctgaggaggctccttttctttagctgtgtcctcctcctcctcttccccttcactgtctgcagcagcaggntttactcttggctttcccttttgatttctcctcctttccctttttactcctgagcccaggaggttcctcagccacggctttattgatgcgattcttctctggcttggcgggcttgagaacacggttttcttcctcctcttcctcctcctcactgtcatcctgaatcagggcttcaaaaacatttccctcgtgccgaattcggagagggcccggccaactgccgccgcctcgggaggtaagcgaagagaggaagcgggagangagccan

SEQ ID NO: 620019 - DNA, 240 bp, Homo sapiens
aaccattctctaccatgcttcatagagaccccatctctcccaaaaaaaaaaaaaaaaaaaaaaaagaaaagaaaagaaaaaaaattagccaggtgtggtagtgcatgcatgtagttccagctactcaggagactgaggtaggaggatcagttgagccaaggaagttgaggctgcaatgagtcatgatcttgccattgcacttcagcctgggcaactgattaacatcctgtcatgagaaaa

SEQ ID NO: 620020 - DNA, 771 bp, Homo sapiens
  misc_feature (44)..(44): n is a, c, g, or t
  misc_feature (78)..(78): n is a, c, g, or t
  misc_feature (112)..(112): n is a, c, g, or t
  misc_feature (130)..(131): n is a, c, g, or t
  misc_feature (150)..(150): n is a, c, g, or t
  misc_feature (152)..(153): n is a, c, g, or t
  misc_feature (159)..(159): n is a, c, g, or t
  misc_feature (214)..(214): n is a, c, g, or t
  misc_feature (242)..(242): n is a, c, g, or t
  misc_feature (260)..(260): n is a, c, g, or t
  misc_feature (291)..(291): n is a, c, g, or t
  misc_feature (296)..(297): n is a, c, g, or t
  misc_feature (365)..(365): n is a, c, g, or t
  misc_feature (379)..(379): n is a, c, g, or t
  misc_feature (444)..(444): n is a, c, g, or t
  misc_feature (449)..(449): n is a, c, g, or t
  misc_feature (489)..(489): n is a, c, g, or t
  misc_feature (506)..(506): n is a, c, g, or t
  misc_feature (535)..(535): n is a, c, g, or t
  misc_feature (617)..(617): n is a, c, g, or t
  misc_feature (755)..(755): n is a, c, g, or t
agtatttattacattttattatagtattattttattatattcangttagtgtatgtgagttctcagtacaagcaggangcagcggctagatgcaactagcacactagaaacncccgtgcgtgtgctctannctttcaagcaaagccattncnntagctnggtcgcagcaatccccaccctcccacctacgggcaaaagagaacagctgaaaacnggcttccctctttaaagggcactcagtnatttttgtccgtcatggncaggaaaaagaaagaaaaacaaaacaaaacnggagnnggtcgttcttgccttgaaagcgggcagtggctattttcttctctctgccaaagcaggacacgttattntttacacagagggncacatcgctgtccctcacaaatacttcagacagttgtcttcaacatcctgtggttcttcgtccgnttccnttttttttttgaggtggggtctcgctctgtcccccccccnggggcgcagtggtgccntcttggcttactgcgacctccacctcccnggttgaagggattctcctgtctcagtccccccaaatacctgggattacaggcgcccgccaccacgcccggctaatttttgtntttttaatagagacatgctttcaccatgttggccaggctggtcttgaactcctgacttcagatgattgcctgacttggtctcccaaagtgctgggattacaggcgtgacaaccacgcccggccccgactccttctttntttttttttttttttt

SEQ ID NO: 620021 - DNA, 240 bp, Homo sapiens
gtcatacggtggtcggggtgaaaaggttgggtgaaagctaaataggttgttgttgatatggttaagaaatagtagagggatgatgctaataattaggctgtgggtgtgatttgtgttgattcaacattatgtgtttttttggaaagtcatgtcagtggtcagtaatatatattgtggcggacgatatagttttagcgattggcagtcaggtttcaggttcatgtacagtatgtctcaggc

SEQ ID NO: 620022 - DNA, 496 bp, Homo sapiens
atctctgaccacgatggcgcttacctttcagacttcattaaacttatgaccgaaaaaaaaaaaaaaaaaaaaaaaaaaaaaaaaaacaagaacatcaaaacaacaaaaaacaacacccaaacaagaaagaaaaaaaaaaaagaaaaagaaacaatgtggctcgccgccgccgcagccgcgccacagagaagagattcactaacacccccgagtgctgggggggggcggcgcccacagatagataataagacacgaactacagcacacaaaatgtatgctcagaaaaaaagacggctggagcaaacgaacaaacgggggggggttctctccccaaaaaaaaataaacggcccgcgggggggacaaacagactgtggttgataaacaaaccacgcgacgaagggcgtgtgcgtgagagtaaatagacgggccattactacagaggggacacacgccaaggttggataaaatgaaaataccccccgccgcgggggggga

SEQ ID NO: 620023 - DNA, 1263 bp, Homo sapiens
tcccgtctgcgcgagtccacgcagctccccaggccctttcaccatgcacatgcagcagcagtgcatggcatgcaatgctgtggatgcagctgcgcagggcaccatccatggtgcagggccatgtgccctcttacttcctgatgaggccctgaccctggcagtgggcacggctcgcttctctgtactgcttgctgcatggtattcgcttctacctccgagacctggcagaacctgggtacactgcacaggctggaccaggctggctaccgggctgtggccattgacctgccagcgtctaggcggcactccaaggaagacagcagcccctgcccctattaggggagctaggcccctggacagcttcctaggacggctagtggtggatagccttgcgagctagaggcccacccgcgtccgtgataccagtccactcacatgagttggcccttgtactccacatgccacttaccatcacgggaccccttggcatcaccaagactaccactgggcatttatgtagccaagtgagaccacccaactgctgcaactggcacacaacatcaaaatgctagcccacacatattgccaagttggtgaacagaactcccagcttctgactagtactcatgcgaagaccagggacccccatggggtcccgagccagccttatgcaggccaccatgacagccagcatgccccaaacccacccgggggaggccatggacacccccgacacgcggcccgagggcaacccccatgatcaacacctaggcacccaaaccacgacggacgtcgggcctaaccaggcgcatgcccggaactatccacctagaacacgggcggcacccaccatgaacgacacacagcacacctaccttcgcacctggacggactcgcggacaagcccattcccgtcaccacatgaaacgcacctctccatttggtacacgcggcacatatacaatactaataccccaaggagatcaattgccaccacggaaccatgccacccacggacgccacccggccaccacagcgcagggccccccagacccaaacagccggcccacaaacgccaccacgcacacccgaccctgctcggccgcacagcacagccgcggcgacacccccccacaaacaacgcgccacacacacacccacaccagacaggcccacaaccaagcacacacgcacacccaacagagcctaagcaccccctcgacgagccaacgaccccaaccaccacacacaaacaaccagccc

SEQ ID NO: 620024 - DNA, 84 bp, Homo sapiens
tggcagaggcagtacggcccaaaacgccacccgttgtaatcaaatctcagcttaaaactcaagaggatgaggaagaaatttcta

SEQ ID NO: 620025 - DNA, 152 bp, Homo sapiens
accatggtcatccccttatagagcggagcgcacctgataatacggcttaccgctctaagattaaaaatcgcccgtagcccacttcttcaccacaaggtcacacctcacacccctatataccccataactagttaattatcgagaaccataca

SEQ ID NO: 620026 - DNA, 226 bp, Homo sapiens
  misc_feature (32)..(32): n is a, c, g, or t
  misc_feature (61)..(61): n is a, c, g, or t
  misc_feature (111)..(111): n is a, c, g, or t
  misc_feature (186)..(187): n is a, c, g, or t
aattcgcggccgcgtcggactgacggctgcgnagaagacgacagaagggggagccacccgncgttcggccagggttctcgctcttgtcgtgtctgttcaaaccggcacgtnctgatccggaaatatggcctcaatatgtgacgccagtgtttccgtcatacgcgaagatatcggtttcattgttgnncttgctcttccttcagaggattatccggggcatctactc

SEQ ID NO: 620027 - DNA, 882 bp, Homo sapiens
aaaaaaaaaaaaaaaaaaaaaaaaaagccctgaggagttgaattggggggaaaacccccccgccccaattttgggggttttggggggggggattttttttttccccccttggggggggaaaaggctttttcttgggcggttttaaatgtccccccatttttggtgtgtgtcgccaatttctgttgacgattgtgcccattacaaacactattaagactgcctgacttttcacacccccgtgggggggggcggaaggcagcgggcgagaattttccctggtgtggcccccctggcaggggtctatttcattttccacacgggaatcatggggggcgcggcaattatggcgacctcgagggggcgtcaacgtggtttaaaaccacgtgtgagaatagggttggtgtaccccgtggctcattttgggagagaagaccacaatgtggtgggggggcgcagcaatttgttcagaaaattcccctttgtcagcaatttttacaacgttggtcatcgatttaacaccttgtaggcgtggtgttcccccacaagaaaaacaatcacaaaaaccaacaaataagacacaaaatactaacatacaataagatcaaaagaaaagatagaaagaaaaacaagaacatagtaaggaagatagcataaaaaaacaagcaagggcggggcggcggggcgacgagaagatttatctcactcgtggggggcggcgaccaccatagtgtccgccccccgttgttttttataaaaaaagcgagccatcaatatattgtgtatagtattatatgaatagcggtgcggctgctcgcgttaaaaaaactgctagcaatcaaagaaaactatcgggtctcctttaggaggaacccccttttgggg

SEQ ID NO: 620028 - DNA, 548 bp, Homo sapiens
  misc_feature (16)..(16): n is a, c, g, or t
  misc_feature (28)..(28): n is a, c, g, or t
  misc_feature (132)..(133): n is a, c, g, or t
  misc_feature (520)..(520): n is a, c, g, or t
cgtacccgggaccaancttttttaaaantttttttggggggcgccccccccccccccccccgggggggcgggacaaacacttcggcccattacggcgggcctttcctcagctagcggtccaaaagagggggnnttttttgtggggggggggggcccccccattttccccccgggggggggggaggggatttcccccccctattcccgaggaagctaaggctgcgtagggtgaggcctcactttccatcccccccccgggggggggggggggggggggccccccccgggggggggaaaaaaaaaaacccggttttaaaaaaaaagggcccgaaccccggcgtaccagagcgagcagccagccctaaacaactttcaggcccccccccgggggcaccccgcgggggggggcccccccaccaacacaccctccccaaaaaaaaactttttggggggggcgggggggggccccttacctagttactaccgaagctacagcctagcatactaactactgggggcnccccccttttcccaaatttttttttccc

SEQ ID NO: 620029 - DNA, 428 bp, Homo sapiens
gttgcgtgtacagatatgttaacgccactttcgtagtcgatgtagtgtcactgtcagttgccccaactcaggtgagtctcagcttgataggggagggggtgatctaaaacactctctacgccggacttctatagccttgggctactcgtgtgacccgcggtggctggcacgaaacttgaccaaccctggaggtatagtatagcttagttaaccctttcgttgatggcataacggtccctccctgctgtttcccgtgggggtgtggctaggctaagcgtgttgcgctgcattgctgcgtgcttgctgcttgtccctttagatcgtggtgatttcgagcgtgtgacctcactggaacggggatgcttgcttgtgtaatcttactcagagctaatagaaaggctaggaccaaacctatgacctgacatgag

SEQ ID NO: 620030 - DNA, 536 bp, Homo sapiens
gcgtgtggatcacctgaggtcaggagttcaagacccagcctggccaacatggtgaaaccctgtcttttctaaaaatacaaagaattagccaggcgtgatggcaaatgcgtgtaataccaccaacttgggaggcgaggcaggagaatcgcttgaacccgggaggcagaggttgcagtgagctcagattgcaccactgcactccagcctgggcaacaagagcgaaactttgtctcaaaaaaaaaaaagcacaaagtcagctgggcacggtggctcacctctgtaatcccagcactttgggaggcggaggcaggcggatcacttgaggtcaggagttcaagaccaccctgggcaatatggcaaaacaaaaccctgtccctactaaaaacacaaaaattattcaggcgtggtagtgggtgcctgtaatcccagctacttgggaggctggggcaggagaatagcttgaacccaggaggcagaggctgccatgagccgagatcatgccagtgtgggtgaccaagtaaaactgcgtctcaaaa

SEQ ID NO: 620031 - DNA, 157 bp, Homo sapiens
tggggtaattccctaattactttttaccctaaggtttcaggaagagtcttggggggatgactcataacttcaaggatgatgatgaagaagaagaggcacaaggaatctcggtcctgggagaagatgattggacggatcatggatctactatatgctt

SEQ ID NO: 620032 - DNA, 360 bp, Homo sapiens
cctggtcgtcactctgggcagggatgccgtcagccttgagggtcgccacccacctgtgtgttgccctctgtcctggcggggaaacatacaccccttgtctcaccaccaaccttgcttgtgtagtcagcagggctgccctgccccaaggactcactgcatgtacccggacccctaggcctggcctttgcagcatagttgggagcttctggattccatctgcacctttgcgccctttgtggtcgggccttcctttcctctcctctccacctcctccattgttgggcaacaactcagccacctgatggcagcctcagaggcttactctaacccatcccagaataaatggagacttcatgtgtt

SEQ ID NO: 620033 - DNA, 985 bp, Homo sapiens
gataccttttcgagcatcagagaatcggcatggaacaagaccagtgtattccatgaaggggtgtgatgatggttttattgccctcttgcccatgaagccacggaggaatcgtgctgcacgagaggaatcctgtcctcttgctgggtcggccattcgatgccttcgtgtggacaaggcttcattacatagctctgcccttaatgagcatatgagacgttcatagggaagatgattatactggagccacgagccccagatggctgagcgaagctcatccatgtcgcaggcttaagccgcgtcaacgtgagtttcagaacgaagtcgagaccggaagagagactcttgagaagtgtagctagtctggtggagaatctttcggtgcgaacccgagcagaacttgcgaagatcgacgttaactgtttcattgagggaatgagccctatgagtaccgggtcctcctatactcacaacgctcgatttcttactgagcccctcaaatggagctagtttccattctatgaatgccaacggagtgtggtagagtcctttattcatatgcagcaggtccgtcagataaactataacggagcgttcatctggaatgaagaagaagaatgatgaagcagggagcagctgcaagaggagcggccaggaagttgaaggcaagagtccatgtccacagagtgagtgctgaggatcagggctgaaacgtgagaggctgtgagccagaaggtgggaggctgcgagccagaagtggaggtggtgagccagaattgggaggtggggccaaaccgagaggttgagggccgaggaaatgctgttcaccccctggggaggctggcccgcctcggacagccggccccatcgggacagggggggccctggccgctcggaacccgagagaaattcactcgggggccactccccccacggatcaccaactgggggggacaacccaagggaaacacggggacacacacacggg

SEQ ID NO: 620034 - DNA, 368 bp, Homo sapiens
tcggcttccatacggaaggtcaggagaagccagtacaggatctttggagaggtctggggtacggtgacgggctccacttgagaggctctgataaacattccagtgctgggtgtgggatgtcaatgatgattttcctgaggaattacccaaacaaaaagacctcatgaaagagtgtaaacactttggtaaagaatctgtacccaataccatgatgttcaggcggtgatcggggctccctgactttctgagagctaaaaaattgtggtgtctcccaaccacttttccatccccagcccttctcatcctgggagcactctgccgctcaagagcgggttggtcacttatggtcagacttcccgtatggttgc

SEQ ID NO: 620035 - DNA, 312 bp, Homo sapiens
cagggtaattaatggtttaggtcagcccaatagtaataattgatttgctgtcatggaaaaaacaaaatcctgttttggaagatcacttggaaccaacacatgtggcagagtcacatgaacgtccgatatggcaaagactctgactgcgcgcgccatctcctttttgtccctttcccaacgcaatcgaaagtgtaacagtgcacgtgatactcagagtaaagactacagtccccgggcaactcgcttgggtcccctgccacactgtggaagctttgtgcactcgctcaacgcaataaatcttgttggtgccca

SEQ ID NO: 620036 - DNA, 426 bp, Homo sapiens
  misc_feature (73)..(73): n is a, c, g, or t
  misc_feature (298)..(298): n is a, c, g, or t
  misc_feature (301)..(301): n is a, c, g, or t
cacgagggcggcgcgccgcaggccgccgcattcagcctcaaagaatggcgcagagacttttgccgtcgctggngcgacggatattgctttcgcgctgatagtccctgacggtcgcgcccttgccgtccaccatgtcggtccgcgcccccgccatgatgatcttgaagatgaagcccggcggctggtcgctcatatgcgcgtacatcagtggcgtgcggcccagcgcatcgcggccgttgatgttgccgccggcatcgcacagggtcctgacgatgtcgagccggccgaccgatgctgnggncatcactggcgtggcgccggtctcgtcgccggcattggggtcggcgccgtaggcgatcaactgctgcacggcaccctgctgacccgacgcagcggccagatgcagcgccgtgaggccgagcgcgc

SEQ ID NO: 620037 - DNA, 222 bp, Homo sapiens
  misc_feature (66)..(66): n is a, c, g, or t
  misc_feature (185)..(185): n is a, c, g, or t
  misc_feature (198)..(198): n is a, c, g, or t
aaatgtctgacccattaactgcaatgccccagcagcaacttttccagcccttaaaaagacccttanattttgattttacatgcggggtacctggcccattgttgtcaaatgcccactctccaacagatgtggtcccccattttcttaaccacaaagtacccctcacttttcaatttgtcctgttnctaaatggtgttncattaaagccctgtgttaagtgtc

SEQ ID NO: 620038 - DNA, 430 bp, Homo sapiens
acagtaatgtagcagtagaggttcactaatgtaacaaagacataccaatgtaagatgcgggaaactggatgtggggtatatggggactctctgtactatcttctcaattttcctgtaaatctaaaactgttttagaaaataagaccaccaggccgggcacagtggttcatgcctgtaatcccagcactttgggaggctgaggcaggtggatcacctgaggttgggagtttgagaccagcctggccaacatggtgaaaccctgtctctactaaaaatacagaattagccaggtgtggtggcacacacctgtaaccccaggtactcgggaagctgaggcaggagaatcgcttgaacccaggaggtggaggtgcagtgagccaggatgcaccacatgcactccagcctgtgtgacagagtaagactctgtccc

SEQ ID NO: 620039 - DNA, 124 bp, Homo sapiens
actaaaatacaggtacagaagaacatgttacataacaccatggagatgcaatcaacaaattcaagcagggcaatgtgtctcacacctgtaaactcagcactttgggaggccaaagcaggaggat

SEQ ID NO: 620040 - DNA, 386 bp, Homo sapiens
cacaagtacaagttagatctgaagtgacacaaaagaacctagcttggatgaagtccaaagccacattctctgagggtgccctactccctgggaagaccctcccaaagtcctcgctatgaagcagatcactggggctgacccttggatgttttaagttttggagtcagggtcaccaaagcgtgagtttcacagttgaacacgattgttcagaagcagggtatagatgaaaggcaggagataaaatcgcacttctcaattgctctgaactctagcttaacttgacatgggacgtgaataaccttcctgtctagagagctgtctccttgaggtgtgacattgcctctctcactaccagaacaccctcgaaggggtacccggctcgaatt

SEQ ID NO: 620041 - DNA, 395 bp, Homo sapiens
ccaccttccagtgtagacacgcgcgacagccttggcccttgagcttcttgaacaacagcccaagcaacgactcgcggccggtattctggttccagtcgttggcgctctggtcgtagagcacctgtgtgtcgtgtgccacagcgccgggtaacgcggtcccggtcctcgcggcgcgtgaagagcgcgcgcacggccaggttacccttccgcaggcgccgcagcttaatgcccggaatggccacgttaatgcccgactcaatgtgcgacgactggtatagctcttgcgcccgacagtccatcaacaacaggcgctcgttgcagagctacatgtgctcgttgagacacgccagtgtcgtgctgatcgacatttcacacgcaaagcgcacgtgtctgag

SEQ ID NO: 620042 - DNA, 371 bp, Homo sapiens
  misc_feature (8)..(8): n is a, c, g, or t
  misc_feature (177)..(177): n is a, c, g, or t
  misc_feature (229)..(229): n is a, c, g, or t
gcttcatnaagcattgacccaggggcgcttacccttcttttcctctcctcaggccttcttgtgtatataacacatggtttgatgttgcccaggcacagtggtcatgccctataatctgagcactttgggagaccatggcggcgggtaaattgcttgagcccaggagttcaagaccancctgggcaacataataagacccccatgtctacagaagaagtacaagaattanccaggggtggtggtgagtgcctgtagttctagctactcaggaagctgaggtgggaagatcaattgagcctgggagttcaaggctacagtgagctgtgattgtggcactgcactccattctaggcaacagagtgagaccctgt

SEQ ID NO: 620043 - DNA, 528 bp, Homo sapiens
agttgtagaagttgatacaagtgtttgtagtgctgttttgcttgggttgtggtgcttttgtcatgaacgtatttcactcgtgtacagtaattgtaaactgtaagagtgttaatgaacgttgttatctttttttttaaagaagcgctctctgttcgtgcattcagcacttctatcggcagtcggattggtttatcatgattggcttgtatttgtttggtcaaactgctgcgtcactgtgattggttgtgatcattgttttcttcaaatggtgatttaagaagacccgtgcttagctttttttttcttctttaatatacagaattgctagaaagtgtttagagatgttgttctcctgcctacaaggaactctctacgctttgtatttggtgattttacaagctgaaaattctcaggttaaaagatgtgttgtggagtcggtggcttctagtgttcgtatatcttaacatgctattttatcaaaaaaaaaattaaaaatgtgtgcaatttttcagcactacagttccaata

SEQ ID NO: 620044 - DNA, 1825 bp, Homo sapiens
  misc_feature (115)..(115): n is a, c, g, or t
tcttctgtgccatgggtggcgtgggaaatgtgggaggtgtgaggtggagtggggtggtgaatgtggcgtgcccctgtactgtgggaggccctgtggggggcctcatacttgggcnctgtggacgtggtcctcctctccagcactgtgtctccacaggggcctctctctgtgagaggcctcctgtgtgaccgcggtggcctgtgagaggccttctcgcgaattctctctctctcctctcacagcgccagagaacacagcggacatctctcagaagcgtgtggagagtgtgcccacgctgtgggccctctctgtgatgttgtgggtgttgcccctctctctgtgtggcacccgcggtggtgtcgtctcagaagaggtcccccgcgagtgtgatgacaacccctctcacagactcatccggagagagtctctatgtggggggggacgtcgtaaagtatgaccacataatcctatgtgaagaaggggagacaaatgagagggggaggggcgcccaccaaaaaaaactcacagagaagacccccccacagaagaaacaaatctaccctttcacacactcggtgatgagaagagggcacagagtgtagattgcggtgggaccccctgctgagagagagtagggagtgtggggaatcaccagaggttcccctcgcggggagaaaacaccgagggtctcctccgcaaatatcttctccggagagaggccacactgtgtcccactggtgtgaacacagagtgggagtcctccacaacaaaccgctcttccgcagtatatgctgagtagcacaagcctgtgttgtataaaacaccacccagtgtagtgggaagctctttaacacacaaactcttagtgtttgaacaaaccctcatccaaagaggggccacactctgtttgttgggtgtagcacactttttgatttacacccccaatgtgcccccccacggagtattgggagacacctttcctattttgaggacacctttgtaaaaccattcttgggcacagaaagaaaaatcagctgggccaagcggagcaacacagacgggtgctggcaccccctctcgagaaagaagtgtcgttgatactctcatcacacaaaaaagcaacacccccgggagaacatactgtggcaagcgaagctggaacacacccacccaaatctgagcacacacacagaagaggagatcatcatacacacacatagataagacgtgacgggaagcacacagagggggcacacacaaaacaaaaatgagctggagacaaacgagtcaaaaacaacaccagcgctcatgatgtgggagtatgtacccaccagccatcccgtggtacagtgaagaataagtcgagggaacacacacaacggaggatagacaaggagtgatgcccaagacaggagcgcaccacaggtgacgcagtaacaaccaacatgagaacgaagacagaaaaaacaccctgctgtcgatcggatgaactttatccccgtctggactacaaggtcaaccatggtcgcttatcacgtgaaggttatcgtagggtcaccatcgactagatgaacgcagcattatcccatcatcacagacaactaagtccaatatcgtcagggctgaacctaatatgtactgacgccacgtcgatgtatgtataggaagaagaaaaagaaaggagcacagacttaatctagtacccagctgaaatgcgtgaacgtaagctacatgcacaagcagtaatggagtgcatcactaccaccacacatagtgtagtatatcaaagcttcaactatcagagagatacaatcgatgcgcagaa

SEQ ID NO: 620045 - DNA, 736 bp, Homo sapiens
  misc_feature (8)..(8): n is a, c, g, or t
  misc_feature (63)..(64): n is a, c, g, or t
  misc_feature (66)..(66): n is a, c, g, or t
  misc_feature (72)..(73): n is a, c, g, or t
  misc_feature (87)..(88): n is a, c, g, or t
  misc_feature (96)..(96): n is a, c, g, or t
  misc_feature (103)..(104): n is a, c, g, or t
  misc_feature (106)..(107): n is a, c, g, or t
  misc_feature (115)..(115): n is a, c, g, or t
  misc_feature (121)..(121): n is a, c, g, or t
  misc_feature (131)..(131): n is a, c, g, or t
  misc_feature (153)..(153): n is a, c, g, or t
  misc_feature (177)..(177): n is a, c, g, or t
  misc_feature (186)..(186): n is a, c, g, or t
  misc_feature (188)..(188): n is a, c, g, or t
  misc_feature (212)..(212): n is a, c, g, or t
  misc_feature (217)..(217): n is a, c, g, or t
  misc_feature (223)..(223): n is a, c, g, or t
  misc_feature (246)..(246): n is a, c, g, or t
  misc_feature (252)..(252): n is a, c, g, or t
  misc_feature (254)..(254): n is a, c, g, or t
  misc_feature (268)..(268): n is a, c, g, or t
  misc_feature (281)..(281): n is a, c, g, or t
  misc_feature (289)..(289): n is a, c, g, or t
  misc_feature (293)..(293): n is a, c, g, or t
  misc_feature (331)..(331): n is a, c, g, or t
  misc_feature (339)..(339): n is a, c, g, or t
  misc_feature (368)..(368): n is a, c, g, or t
  misc_feature (379)..(379): n is a, c, g, or t
  misc_feature (389)..(389): n is a, c, g, or t
  misc_feature (397)..(397): n is a, c, g, or t
  misc_feature (481)..(481): n is a, c, g, or t
  misc_feature (652)..(652): n is a, c, g, or t
  misc_feature (716)..(716): n is a, c, g, or t
caatgganacaaacagttctgagaccggtcttccaccacggattaagagggggggggcagggnngngggggnngggggggggggggnngggggcgnggggggnngnngggggggncgggcnagcgccagcngccggcggggccacggcgtggnggacacccaccgcaactggctggntcatatcangnacagcaaagcgacccaaagggggngaggnggagangcgctcaacacacaggggcgggngagggncnagatcaacaatggnagcatcaccaganggcaagantggngggccagcggccagcgttggaccagaacggcgagcaancttttccntcagcgcagcaaacgggcatgcgatgggngcgcgtggggnaatccaaganaggggcanagcgcggcgcggaggtggcctggatggttcaggataatcacctgagcagtgaagccagctgcttccattggtgggtcatttttnctgtcaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttnagaacaccagtctccactcggccaacaggaacagtaccaataccaccaattttgtagacatccnggagaggcaggcgcaagggc

SEQ ID NO: 620046 - DNA, 261 bp, Homo sapiens
gtgaaccattgttgtatgaaccactagttacatacacctgatcataaacatcctgtgtgtaatagtttttcccaaaacacgtagcacccttcagcaggaccctataaaactttcctccagcccttgcctctttgcaggtagccccttctctgctgagctgcccactgcaacatattttcacaatttctctaataaatctgcccttctttacctacaactatcctggtaaatggctttaccacctgcaaaactgaccctagg

SEQ ID NO: 620047 - DNA, 251 bp, Homo sapiens
ttgaccagagagaaaagactagcgtcatctcacactgaaaaaaaatctcaattcccgtgccgagcgcagctggctcacacctgtgatcaccagacactataagggaggccaaggcaggtaggatcacctaagtacaggagttcgagaccagcctgaccaacatggagaaaccccatctctactaaaaatacgaaattagccgggtgtggtgggcgcctctaatcccagctactctgggggcgggcagaggg

SEQ ID NO: 620048 - DNA, 805 bp, Homo sapiens
caaggtctttcgagtctcaattcccaggattccagtatggaaatgtcaaagcttactgataaggtgcaggccgagtatagagatgcctatagagaatacatttgctcagatgtcccagttagaagggggccccgggttctacaaccattagtggcagatcttctccacatagcaagatagttacatggtgtcagaagttcatccagggggctcgtaatgtcattcgaaaacctagagcaacgaaaaggggaaggatagtgaaccaaagcccgatgatgggaggagagtccttgtctaatgaagaggggagatgtatcgatgtatgtcatcatcaggggtttccagcaacgagtgcttcccccctggatcctatcaggtgaagaagatgaaacaatcgagatcagtcaggcagtaggcttctcccaggcaagaaatcttccgaaagggtcaagccttcttccagacagaattgacagcttaagggacagtggggtgcgctatcaaaaactcccaagtgacgaggactgaatctggcacagaagcacgtcagatacacactgccactgtcaaagatgcacaagacagaaaagcggaagggaacactacgagcagagtgcccgaagtctccagaaacagggtaggagaccgataagaagctcaattagagccaaggagcataactcgggaggggcccctggcaaacagggtcctcgggtcacgaagggcgaccacgggaagctcccaaacaacttctgccaaggacgggcggagaacccaacgtgaaacggcaccctaaaccggaatg

SEQ ID NO: 620049 - DNA, 600 bp, Homo sapiens
  misc_feature (21)..(21): n is a, c, g, or t
  misc_feature (106)..(106): n is a, c, g, or t
  misc_feature (244)..(244): n is a, c, g, or t
accccccttccttccctcagnggttcaccaatttggccccatggggcattagatttctctcccagtcaagagcacatctgacactgagaatttctctggatattcntctgtctgccaaatcagatttcctcaactaaaatcctgcgtgatccacagttacattcaccattctctttagacactgtatctcaattacccagatggtattatggttccggcctctgcagaggagtgtctttgctgncatttggtctccatggcatcgaataccttgcacacttttgtagccactcccatttcatgaccctcaaacctcccaaatgttgaatggtaacttttagaaaactaccaagtaacgtggataacacattccccagcacatccatgaactctcatctgtttgcacccattgttcactctactccaatgctatgcctcactggcatcttcttttgatttggcacttggtgatgaaaaaggtgaaaggttaacccactgattgctcacttaccagtctcacttgctcacttttctgccaggtctcctaagtgatctttcgtgtaaaaagaagtttagaaaatgctttaggataaattgtat

SEQ ID NO: 620050 - DNA, 305 bp, Homo sapiens
gggggggggttttttttttttcccccttgggggggcccccccttttttttgggggaggggggcccccaactttttttgggggcccctttttttggggggggggcttttggggccttccccccgggggttaattttcccccgggttttatttggcccccccctgggggcccccctggctttttttttgtccccggggttttttttagccccaattttggggggggggggcccccccccgggggggcggggccccccccccccccccccccttttttttgtttcccaattttttttttttttttgga

SEQ ID NO: 620051 - DNA, 1132 bp, Homo sapiens
ttttcggacagttgatcagggggtcgtattaatggttaacatgagggggtgacaacttcggggtgttaattaagggctcccgtgtattctttttgcccgtccctggtttcgactgattcatggtctaacatcgatggtcgtaccgcacaaacatctagtcttatgcatgacaccttttacggctgtctatcgaatacaaggtctcccagacgaccgagggtcccaaatgcgtgctaagactgtggtgatcactgggattctagagttgaatccagcctttcaaaatcttctgtcgaatccatcagaggccattacttaacacggcaccaatgcttttaacggctaactctcgaggattatcaagcattggtatttcaccggtaaagtacacgtgatctcgagttttgtggcctcatccagattggggatcgcggtctacaaggctcacccaattgactcccctctacaggaggtgtccgttcaggtctactatagtgccttccgtcacaggagggaggtaacgagagtagatgagtttttcccgaattatatggagcatgttaagcaaagcctgggactgccagctatggcggttaactatcttcgcaactttttactaataggacctcttcagaactgagtctgctaggcttctgcacggaaattatgctcagctttacaccaaatagactcacccagagagcaccaccaatataccaagagtataaatactctttctacagtaaggtgttggattgcgtaacatcaacaaagtccattaacacattaagcacaccaggacttcaggattgaccaccagggtctaaaggtactgttgaacaaaattactcgcaatgataatgaatttggcttattgttttttttcgctttcagaaattggcttggttctctttagagttggagtaaacatgccatgtaataaatgagttccactgaatggtacaacagaattattgcatttctaagaagtatgtgtagtaaaagtcgaatatacacattgatagaatgttctgtcgttcaaaatcgttataccgtaatttgatattatataagaatttggcagcatggtaagtcatgtgtataacaatgttaatagccacgtaaattgtga

SEQ ID NO: 620052 - DNA, 190 bp, Homo sapiens
atatatgggaatactgaaatcttgctgctattgggtatctgaggccccacagacttacagaagaagtggacctccatagacatgtgtagcatcaaaacacaaagggccacacttcttgacggatgccagcttgggcactagctgtctactagacaccccaaccttggatgattatgtatttaattcatat

SEQ ID NO: 620053 - DNA, 252 bp, Homo sapiens
aggtattaaccccgttcccctacaccaatttggtaaattccatatttggtgccttaagacctcaatttcccaatccaataattctaattgcattaattaatttgtgcatcaagacttatcttggttattgaaattattcgaagtcccacgtttcaaagaaaaaatttccacgttgatttttgaaataaaaaggcactcttggggagtgaaatttcactttaggtgattggagggcaagatgaaaaagacctt

SEQ ID NO: 620054 - DNA, 875 bp, Homo sapiens
  misc_feature (28)..(28): n is a, c, g, or t
  misc_feature (242)..(242): n is a, c, g, or t
  misc_feature (348)..(348): n is a, c, g, or t
  misc_feature (397)..(397): n is a, c, g, or t
  misc_feature (435)..(435): n is a, c, g, or t
  misc_feature (492)..(492): n is a, c, g, or t
  misc_feature (623)..(623): n is a, c, g, or t
  misc_feature (675)..(675): n is a, c, g, or t
  misc_feature (690)..(690): n is a, c, g, or t
  misc_feature (694)..(694): n is a, c, g, or t
  misc_feature (700)..(700): n is a, c, g, or t
  misc_feature (705)..(705): n is a, c, g, or t
  misc_feature (717)..(717): n is a, c, g, or t
  misc_feature (721)..(721): n is a, c, g, or t
  misc_feature (725)..(725): n is a, c, g, or t
  misc_feature (729)..(729): n is a, c, g, or t
  misc_feature (737)..(737): n is a, c, g, or t
  misc_feature (751)..(751): n is a, c, g, or t
  misc_feature (793)..(793): n is a, c, g, or t
  misc_feature (798)..(798): n is a, c, g, or t
  misc_feature (863)..(863): n is a, c, g, or t
gggagagggaggggaagggtggggtganaatgcagaggtgcttgcagaatgtaaaagatgtggaccctcccagctggacgtggtggctcacaattgtaatcccagcactctgggaggctgagacaggtggatcgcctgagcccaggagtttgagaccagcctgggcaacactgtgagaccccatctctacaaaacatgcaaaagtgggctggccatggtggcatgaacctgtggtcccagcnactccggaggctgaggcaggactgctcgagccggggaggcaaaggctgcagttagccaagatcacgccactccactccagcctgggcaacaaagcgagacccagtntcaaagaaaaagaaaaaaaaaaaaaaaaagaaaaaagaaattgaccctnagcataaaacaagttttggtggatccagaccatcaaanacaagagaagaaatcctccagggtgtgggatggggtgagatttccttttaggttctnaggttccccactgacagcctcccacccccatcctcctccccacaacaaaacaccagtgcaggccaacttgttcagtggagccccgggacaaagcaaatggaagtcctgggtgcttctgacgcacacctatngcaagcaagggttcaaagacccaaaacccaaaatggcaggggagggagaaangggggtgggaggctnttanttgggnaaaanaagtggagaatnttantttnattnaggccctnctgttttgaacatnagttttttatggcgggagggagactgacccttttttggactncaggnggctggagtaagccctgcccccccctggctccttcccagcctgggcatccttaagttccaaggcntcattcagctct

SEQ ID NO: 620055 - DNA, 371 bp, Homo sapiens
gcaggactttccccgtacgccaaaaaagaagagagtgctaggagttcaggataacctctttctagagaaggctatgcaggcttgaaatgaggcatgccaatctctttttcgactacgcgtgacaggagacgtgaagatgctgctggccgtccagcgccatctcactgctgtccaggttgagaatggggacagtgtcttacacttagcaatcatccaccttacattctcaactggtgagggatctactagaagtcaccaatctggttggatttctgatgaccttatcaccatgagaaaatgatctgtaccagaggcccttggcacttgtggaggtgatcattaagcaggaacgatgtggtggaggattggct

SEQ ID NO: 620056 - DNA, 271 bp, Homo sapiens
ttgacttgggcatacactgttttattattactttttccctcacttcagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaa

SEQ ID NO: 620057 - DNA, 484 bp, Homo sapiens
  misc_feature (415)..(415): n is a, c, g, or t
cttggcaaaatcctattcatccttcaaatcccggtcagagccacctcggtggtgtgaagtctcctgccctcactccccaaaagagctaaccagtcctccctcgggactaacctccctctggagcacattctaatacctgcccatgtgcagcgttcccttctccacagcaaatccttagaggaagcgttcacgatgaagggctggcccatagaagatgctacgcaaatatctgttgcattaaaccgacaaaagttcacagcacttctgagaaccctgggaggtgtttctttcaatcttaagttttttagtaatcaggtgctctgacaatcttcactcatcttaacgtttccatctcctcttatccaagttggggccacccctctctctttaacagatgtattagtctgttctcacnctgctaataaagacatacccaagactgggtaatttataaaggaaagagttttaatggactcacagttcc

SEQ ID NO: 620058 - DNA, 127 bp, Homo sapiens
gcccaagccccagccccccccccccctttattacccctagggtgggggaaaaggttttgcccagcaatagtcctgatttaatggatccttgaagcccaataaacaaatagtatttttgcatgtgtca

SEQ ID NO: 620059 - DNA, 411 bp, Homo sapiens
  misc_feature (49)..(49): n is a, c, g, or t
tgacccatgccagatagtttatgcctaaccaatgtgatttatagtgaanacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctccattcttttgttgtaataaaccataatggtgaataaaacaaaaa

SEQ ID NO: 620060 - DNA, 153 bp, Homo sapiens
tgtaccatattctgtgggttaaattctgcaatcccgagtaaggatgcgaattcactgtgacctggcagaaatgccaacctgcgccatccgcttcagatccgtccctctaccagcacgtgggcactcactcctcgctggcttgctagaatccac

SEQ ID NO: 620061 - DNA, 1792 bp, Homo sapiens
  misc_feature (83)..(83): n is a, c, g, or t
  misc_feature (145)..(145): n is a, c, g, or t
  misc_feature (335)..(335): n is a, c, g, or t
  misc_feature (527)..(527): n is a, c, g, or t
  misc_feature (1792)..(1792): n is a, c, g, or t
ggagagctcgtgcgtcatcgatttcccacctacgagcgagaccagtgcaataagcgaagaacgcatctcgataatccatcctntctaggtcgctaccactttcgagcaactgtaccacttacgggcgccacacgtccgaccgacntaaccatggcggcccagtcgtcgaagtctaactcagacactggccggtcggccagtacgtactacacatatgaaaatccgactctggacatataggattgtagcacgacaggtgacgagcctgcgctcgaaggattggcggcacacagagagttatccctatcaaaggtaactgccacttaggggctcgntacgagtcatacacacagtctgcagacagttctgacaccctgtgtgagacactgcttgaggtcactctcacctaactgtgtaaataactccttagcctctctgatgggtcatataatctttggcattaccgccacgcgacagtaaaccattgtgtgtgccacttacagtcaagtcagacatggtctgccccnagaagaatacacacttaagccagtatacattctctaaatctcaatcaacaatagacagtggacagtcaagaccgggagaggcaactgactctgtcaaagagacactgtgacaatgaatgaacctgtgtccagtgaaacttctgatctggcagtaggctgtgacgcctggataatgcggttgccccattttctggcagagtccatgcgataaagtacattacccaaaggaacattgggtgggactagggaaacctcgcggggaaagaaggcccagttggccctcgtatacctttggggacagtttgagcaagctagctttggcgaagtttgatcgatatattcgagaaacattaaaatatagtttgctgcgaatgttctaaaattccaaacattaatgggggagtaacccctaggcttagaaagacaccaaaggcgccctaacctaggcaccaaaggcaaagataagacaatccacttcgcaagatggcaactcgatttcgctgtgccacccttttgtcggcattctggtgccaagagaccaaactttaattttacacatcttttgcaacagtatagcaacttcttagggggttgtgaaaccaaaaaagcccccccttgcaacacaagacaaagaattaaaggccgacatttggaagcttagacccgttaagaaaactcccatggggtgttgtgcgggccccgctggcgacttgtgcggcaaaggtcagatttggccggtggggaatcgctgcggacggttttgggcttaacgaccaatttgtgttccttttgttggctggtcccccccggggcacattgggcccccatgtgttttcaggcccccgcgcttgtgacgttacttgtggcgacacagtcggtctcacacggtcggtgtcaaggcgcccccttgacgattgttgttcttgctcacgacaggagttccctcggggagcggggtggagcccctctcccccccggcggtatacactcctgatggcacaccttgtgcgatattagacgcctgctttctggggggcggatgtgccgtttttccccccggggtctgtgtctatacaacgaaggcgatcgcggcggagcaatttcggcaccgctatgaagctaccgcctgtgttgtagcctcgggagcagagcagaccctcgcctggtgtcactgaccaaagccccctggggttgtgcgtccgtgcgcgcaaccacattacgtgctcccagcacacgaatcgtacgtcctcacacgcagatagttn

SEQ ID NO: 620062 - DNA, 338 bp, Homo sapiens
  misc_feature (39)..(39): n is a, c, g, or t
  misc_feature (78)..(78): n is a, c, g, or t
tctagctcgcagtgtgttgatgtggtgatgctgctcggnagtctgcgcatgcgtggacatttcccggaaagccatggnagtcatgctgatctgtacttctacgaggtactgaagagatgaaaaagaagagcaggtgctgctgagaaggcagtgaccaaggaggaatttcagggtgaatggactgctcccgctcccgagttcactgctactcagcctgaggtagcagactggtctgaaggtgtacaggtgccctctgtgcctatacagcaattccctactgaagactggagcgctcagcctgccacggaagactggtctgcagctcccactgctcaggc

SEQ ID NO: 620063 - DNA, 362 bp, Homo sapiens
taaaaggaaaaaaaaaaaaaaaaccccgtaaaagccgggagccaaaaaaccaaaaagtgtgagttaaaaaccggggcccaattagtgaaagtactaaatgtttaaaaaccaaaaaaaaaggcaaaagcggttttttttttttttttttttttcgccctttgctgccaggcagggaaggcccccctgtccagtggaaaaataacccatgtgcccttcccaattattggaaagggttcacattccttcccccgccccttttttttaaatccaaaaaaaatcagggcagccgggcatttggggccccaactggtttccgcgttttgggggaaggggtcccccaggcccaggggttttttttttta

SEQ ID NO: 620064 - DNA, 626 bp, Homo sapiens
gctcggtgtcctctctctgttccttctctctctagtctctctcgtgttggttccgtctctggatcccgtgtcgctgtcactgctgtctgtcgctgctcttgtctgctgctggtagttcgtctgtcgtcagtctgtctgcatcttctctgtctctcttactcgtgcgctctggtctgctgtctcactcattctcatccctttctgcgctgcttcgtcttctcttcgctctcgtccttctacttgtgcgtcgcctccgctctgtcgcgcgtgtctctgtcgtgctgcgctcgtctgttgtctctctcgatcacgtgctcgctgttctccgcctctcttctcggtttcgccggcctgtgctcctgtggcgtctgctcgtgtgtctgcgctgtgcctgcgtcgtgtcgtgctcctgtggctcatgcgtctgattcctgctcggtctgtgttgttatcgttgttgtctctccttctttggttgcatctgtgctttcgtaattctttgtgaccctggtacacacacttggagagttatgtggcagatagtcgtggtgttgcagtcctgtgcacttgtggggtgggatgggaatagcaatgtgtgttcagagatacagcgggacttaaacttg

SEQ ID NO: 620065 - DNA, 884 bp, Homo sapiens
gcacgattactatcactaatgacaaagggccggattgatccaggaagacatcgaacgtatggtccaggatacgctgagaagtacaacgctgaagatgaaaatgcagagggacaaggtgtcatccaagaattccactttgagtcctattgccttccaacagtgagacagcacactgttgaccagatgagaccacttcaaggcacgattaaccgatgaggacaaacacgaagatccgtggaacgaagctgtaagttagaagattaatcgacctgcgcttgatctgcaatcaagaactgctcgctaaggcagatatttgaagcaatcagagcaaggacaacgagctggcgaaagttaagcgacatacccaatcatcgacccaatgcatagtaaccaagtagttgcacgagagagcaatgccctaccgaaggaaagtgcgctgcgtgcggtatttctcgtggggtgggatggtacgcatccggtcccccttccttagagttacggtatgcgtgtccccatccaggggcctccaacccaatatagagctgcatgcgttcgaattttacatgcccgaacggcacaatgtgtgtcaagaatagtacatgccatgtagtgatccaacggacggattttgccagatacaccgatcagtcgcaaagtgacccttaaacaagtgatccggtaaagggcacacactcatcttaggttgagcacagtctttacacaaacacggttaacacgcctcgcctacttacgtcacacgtttaacgttgcgagccatatcctccacactactttgacactacttgggacacacttattgccgcacgggggaaacgggacaacactaagcatatagcaccttttcctacgactcccctgagtat

SEQ ID NO: 620066 - DNA, 1136 bp, Homo sapiens
agcgggagagcgtgcggggcgggtgagagcgtgcggccgtgattcaccacaatcatggcagaaatcttttctataaggaaaagtggatgatagcccgttctgctctatctcagatcgtcagccgcgggtgcaagcctcgatggcctctctccactatttctactttggcatccacttcgaggtggcaggccccgtgtggtgctggtggatcgccggggtgcaggcagtgtggcggctcacgttctgctcacccggaagctccgtgccccagtcgtggctgccgtgcgcgtggggattcaccacaagcagagtactgctcctgttgaggaagcgctgcgaagggactgcttaccctggttgaacggaggcggggctcggctgggtacgtcgtacatgtaaaacccaatccggaggctcgaagccaggagaccggagtgtagacccgtttccctgtccagagtcacgcacatactctgtcatcgcaatcaacttgggtagcaaatggtgttggttatccttagtgtgcagagggagattatccaccattccgagaggaaggctcgagggggcgagaaggtgtacctggggaagccgaaaaacagcctcgtgacaacagattcacccaactcaacgatggtcaaagttgtcaatattgaagttgaacctatcagtaaagaccaatttgcgggttaaattcgtagagtcctcctcgaaagagctggtctctcgaaacgtgaactagaacagcgaatttctttcgcttagtctaaagaaaattaggaacctgtgtccccgaaatgatgaagaagttaacaaaaaccccgttcagagccagttcttgggaatcgccgcgcacatgtaagaggggcgtgcactagaacttccctctacggagggcggtgcgagtgccccggggatcaaccgcatttctgtctttcttgttgccccttttaaacgctgagggggcttacagaggaatccagaggaccctagggcggatggaatacaagttgtcatatgtagactttggtatccccctttgttgttgagaaattgtgtcaaatacgcgattcacacaagattcccacaatcaagtatataacaacacaacaagaacaggaggaacaagcgcccag

SEQ ID NO: 620067 - DNA, 250 bp, Homo sapiens
ctctcgcgtatgacagcaactcagctgtccgaggtgcttatggaaaggagaggattcaagagaggaagccagaaggcacatgatccacatcatgttctgtctgggtcaaaccacccggagcagtgctcacagaccgctcagcttgctagttgtacagagagaggataaggtccacctggaacacaagcaactgccaacacccacatctggaccgggagcggggatgggtatccatttgactctccacgca

SEQ ID NO: 620068 - DNA, 351 bp, Homo sapiens
ccccccccaaaaggggggggggccccccccccccccttttttttttccccccccccccctttttgggggggggggggggggggggggggggggccccccccccccccccccccctttgggggggggccccccccccggggtttttccctccccgggggggttttccccccccccttttttttttttccccccccttttacccccccgttttttttttttgaaaaaaaaaaagaaaaggccacaggacaaaaaccaacttcacagaaaaataacaaaaacaaataggtctaataagaagacacaataaaacaagtaagaacatagatcaagcttgtccagtcaaaatcaccc

SEQ ID NO: 620069 - DNA, 117 bp, Homo sapiens
  misc_feature (4)..(4): n is a, c, g, or t
  misc_feature (13)..(13): n is a, c, g, or t
ctgncgatacctnaaccaagccaaaggcagaaaagggaagggtgcatattgctaagagagcaatggaaaatatgtaagctactttcattaattaccctactttcattcctcccaccc

SEQ ID NO: 620070 - DNA, 474 bp, Homo sapiens
actacagccttccgtgttaatcatggcctcagcttcgaaaaccaacacaatagaaccgcggacctattccattggtcctagctgcggaatccaggcgactccgccctgctttgaacactctaattttttcaaagtaaacgcttcgagccccgcgagacactcagctaagagcatcgagggggcgccgagagtcaaggtgcggggacggccagtagctcgcctcgcggcgaacacgccgcccgttcccaagatccaactacgagctttttaactgcagcaactttaatatacgctattgaagctgaaattaccgcggctgctgacaccagacttgccctccaatggaacctcgttaaagcatttaaagtggactcattccaattacggggcctcgaaagagtccatgattgttatttttcggcactacctacccgggtcgggagtgagtaatttgcgcgcctgctgccttccttg

SEQ ID NO: 620071 - DNA, 265 bp, Homo sapiens
taggaacagagatggaccccaaaagccgagactttagttcagcaagcctctcagtgccttagtaagctggtccagatagcttcccggacaaagaggaactttattcttgatcagtgtaatgtgtacaattctggccaacggcggaagctatggctgttcaagaccttctctcggaaagtggctggtggtggtcccataatgacggaagattgcgacgaagagcgctgtagcttgagcgaaggcaagtagcaggcgcacgatgcat

SEQ ID NO: 620072 - DNA, 1555 bp, Homo sapiens
  misc_feature (294)..(294): n is a, c, g, or t
  misc_feature (301)..(302): n is a, c, g, or t
  misc_feature (304)..(304): n is a, c, g, or t
  misc_feature (327)..(327): n is a, c, g, or t
  misc_feature (333)..(333): n is a, c, g, or t
  misc_feature (352)..(352): n is a, c, g, or t
  misc_feature (358)..(358): n is a, c, g, or t
  misc_feature (379)..(379): n is a, c, g, or t
  misc_feature (381)..(381): n is a, c, g, or t
  misc_feature (515)..(515): n is a, c, g, or t
  misc_feature (521)..(521): n is a, c, g, or t
  misc_feature (587)..(587): n is a, c, g, or t
  misc_feature (648)..(650): n is a, c, g, or t
  misc_feature (674)..(674): n is a, c, g, or t
  misc_feature (681)..(681): n is a, c, g, or t
  misc_feature (1555)..(1555): n is a, c, g, or t
gcggatagccggtcccccgctgcagctaccggccagcgaggactgcgcctgcaggaacccctggtgccccatccctggctggcatggcatttgtcaaggaggaggagacggaggctgtcattggagcccctcctactgccactgatgggccctgaggaccaaagctgtgcttatggctcttgcggagggtcatggtgctgagggtccccgctctgtgactcaccctagtggcagcaccagctcagggtgtggaggtgtgtggctcctgagggtacctcagccccaggtggtggnccggganncntggatgacagtgccaccattgcngtgtcngccagaagccaggcgatcnggttangtgcaaccagtgtgagtttgntnccacctggactgtcacctgccggccctgcaggatgtaccaggggaggagtggagctgctcactctgccatgtgctccctgacctgaaggaggaggatggcagcctcagcctggatggtgcagacagactggcgnggtggncaagctctcaccagccaaccagcggaaatgtgagcgtgtactgctgggccctattctgtcacgaancctgccgccacctgcatcagctggctaccgactccaccttctcctggaacagcccggtggnnncctggatctgaccctgatccgtgnccggctncaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcaacaaaaaaaaaaaaaaaaaaaaaaaaaacacagggcggacgaacaagagcacgaaggacacagacagaacacaaacaattggttgcggccgcgcgcgttaagccgcccctccaaagaaggtgctctcccaacacccaccgaaccggggagggcgaggagcgccacaaactggagtagacgccgcacattagggcgtgcgaaccggagttcctcacagcaaacatccggggaaaacgaaacgcggggaggtcccaccaaaaattaaatcaacgcccggggggcgcaacgacgttgtcgaacaaaccccaaggggggatagcagagggacaacgagaggacataccacggagcgcaaaagaggcgacaaaaaaaaccagccgtgcgggaccacgagcgcaacacaacagcacacgtcggagagaacacaaccgcacggagacggn

SEQ ID NO: 620073 - DNA, 139 bp, Homo sapiens
ttagaggatcccgggtctgactgtgacttccttctggctcttccaaacaccatgagatatattctggatctggagtgacctttgtcacaaatcgagataaagttaaaatgtgtattatttaaagccagtgtggagagag

SEQ ID NO: 620074 - DNA, 1564 bp, Homo sapiens
  misc_feature (294)..(294): n is a, c, g, or t
  misc_feature (301)..(302): n is a, c, g, or t
  misc_feature (304)..(304): n is a, c, g, or t
  misc_feature (327)..(327): n is a, c, g, or t
  misc_feature (333)..(333): n is a, c, g, or t
  misc_feature (352)..(352): n is a, c, g, or t
  misc_feature (358)..(358): n is a, c, g, or t
  misc_feature (379)..(379): n is a, c, g, or t
  misc_feature (381)..(381): n is a, c, g, or t
  misc_feature (515)..(515): n is a, c, g, or t
  misc_feature (521)..(521): n is a, c, g, or t
  misc_feature (607)..(607): n is a, c, g, or t
  misc_feature (620)..(620): n is a, c, g, or t
  misc_feature (653)..(653): n is a, c, g, or t
  misc_feature (673)..(673): n is a, c, g, or t
  misc_feature (676)..(676): n is a, c, g, or t
  misc_feature (1564)..(1564): n is a, c, g, or t
gcggatagccggtcccccgctgcagctaccggccagcgaggactgcgcctgcaggaacccctggtgccccatccctggctggcatggcatttgtcaaggaggaggagacggaggctgtcattggagcccctcctactgccactgatgggccctgaggaccaaagctgtgcttatggctcttgcggagggtcatggtgctgagggtccccgctctgtgactcaccctagtggcagcaccagctcagggtgtggaggtgtgtggctcctgagggtacctcagccccaggtggtggnccggganncntggatgacagtgccaccattgcngtgtcngccagaagccaggcgatcnggttangtgcaaccagtgtgagtttgntnccacctggactgtcacctgccggccctgcaggatgtaccaggggaggagtggagctgctcactctgccatgtgctccctgacctgaaggaggaggatggcagcctcagcctggatggtgcagacagactggcgnggtggncaagctctcaccagccaaccagcggaaatgtgagcgtgtactgctgggccccatccctccccaccacaccccccccccccctcccncccccccccgccnccccccccccccccccccctccccccccccccnccccccctcccccccccccnccncccccccccccctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcaacaaaaaaaaaaaaaaaaaaaaaaaaaacacagggcggacgaacaagagcacgaaggacacagacagaacacaaacaattggttgcggccgcgcgcgttaagccgcccctccaaagaaggtgctctcccaacacccaccgaaccggggagggcgaggagcgccacaaactggagtagacgccgcacattagggcgtgcgaaccggagttcctcacagcaaacatccggggaaaacgaaacgcggggaggtcccaccaaaaattaaatcaacgcccggggggcgcaacgacgttgtcgaacaaaccccaaggggggatagcagagggacaacgagaggacataccacggagcgcaaaagaggcgacaaaaaaaaccagccgtgcgggaccacgagcgcaacacaacagcacacgtcggagagaacacaaccgcacggagacggn

SEQ ID NO: 620075 - DNA, 922 bp, Homo sapiens
  misc_feature (214)..(214): n is a, c, g, or t
  misc_feature (296)..(296): n is a, c, g, or t
  misc_feature (370)..(370): n is a, c, g, or t
  misc_feature (922)..(922): n is a, c, g, or t
ccagctttgaaaaagcccttggtgtgcccaaatttatactggggtgtggtcaatgtcgatggatgcaaggagcttctcagaggccttcttgctatcaatgaattgcccttcagggattgcacttgcatttaataccttgtatctctgtttgaagtctgcataaaggattctgcttggaaatcctttcctacagatgcggatgccttccagcacnccgttacacctcagctggtggaggacaagctcatgctccatggccccaggagtttttgtctcattggggatgatacccctcncaaagtgaggatgggtactcctgaggttggtcatcagcttgttcaaattctctctgaaaagggcagaccctgtntggaaaaaagagccctttttctgactcccactccctggtggccccatcccccagttcctcacgatatggtttttacttctgtggatttaataaaaacttcaccagttcaacaaaaaaaaaaaaaaaaaaaaaaaaaacacagggcggacgaacaagagcacgaaggacacagacagaacacaaacaattggttgcggccgcgcgcgttaagccgcccctccaaagaaggtgctctcccaacacccaccgaaccggggagggcgaggagcgccacaaactggagtagacgccgcacattagggcgtgcgaaccggagttcctcacagcaaacatccggggaaaacgaaacgcggggaggtcccaccaaaaattaaatcaacgcccggggggcgcaacgacgttgtcgaacaaaccccaaggggggatagcagagggacaacgagaggacataccacggagcgcaaaagaggcgacaaaaaaaaccagccgtgcgggaccacgagcgcaacacaacagcacacgtcggagagaacacaaccgcacggagacggn

SEQ ID NO: 620076 - DNA, 125 bp, Homo sapiens
ctgttgtagggaatccattgcggtgaatgatctggtagtgcatggcacgcgtatgccagggggcctataattataccaggccatttgaacctgccacgatcaccacccagtgctgtgcctccatc

SEQ ID NO: 620077 - DNA, 633 bp, Homo sapiens
acctttgtggtgggaggacgtgtactagctagctctcttccagggcggctgtgggtgtcagagacacttttttggttttttgttttccgaaatctctgcttgccaggcagcagcccaaggtttggccagcatcttgtaagtgtcaagtcaggcaacaggtttcacagtaaaagggtgggaaccctactaaccttgttcagtatggtgttgcactcagagcagtttgagacagatctgtcttctaggaaacagcagctagcaaaccaacagggtggcaggctaaaagggttgagcattgttgtgggagccatcgagtcctcccaccacgggaggacttagaccccgttggagactctactctgctggttggaacactacccctcgaggggtgggtaaaggggtgcttctttttagagggcagcctggagctccaccaaacaccccacaccagtgagcagcaagggcacagtcctctggtcctcccaccacaaacgtggatccgtgcacgttaacgattactaggactatgcgagaactcttaggcttgcacgttaaccggttcctaggaccatgcgggtccccttgttttcttttgtttgtttgggtgttttttttttttttttgctttttttt

SEQ ID NO: 620078 - DNA, 152 bp, Homo sapiens
acgctaaacataatgagcatgatgctacctggccctgtccccaagcccctggagacagtgaatggtcactgttattgtgcccttagccatcaccaccctctaatctcagcccctgcgggagggagggagggaatgttataggtgttaactgt

SEQ ID NO: 620079 - DNA, 613 bp, Homo sapiens
  misc_feature (613)..(613): n is a, c, g, or t
ccatcccccaggagtgggagtcaggccaccagggagtggggcaccaggagtggagtcaggccaccagggagtggggatggggtgactcccactccctggtggccccatcccccagttcctcacgatatggtttttacttctgtggatttaataaaaacttcaccagttcaacaaaaaaaaaaaaaaaaaaaaaaaaaacacagggcggacgaacaagagcacgaaggacacagacagaacacaaacaattggttgcggccgcgcgcgttaagccgcccctccaaagaaggtgctctcccaacacccaccgaaccggggagggcgaggagcgccacaaactggagtagacgccgcacattagggcgtgcgaaccggagttcctcacagcaaacatccggggaaaacgaaacgcggggaggtcccaccaaaaattaaatcaacgcccggggggcgcaacgacgttgtcgaacaaaccccaaggggggatagcagagggacaacgagaggacataccacggagcgcaaaagaggcgacaaaaaaaaccagccgtgcgggaccacgagcgcaacacaacagcacacgtcggagagaacacaaccgcacggagacggn

SEQ ID NO: 620080 - DNA, 166 bp, Homo sapiens
  misc_feature (7)..(7): n is a, c, g, or t
  misc_feature (22)..(22): n is a, c, g, or t
  misc_feature (57)..(59): n is a, c, g, or t
  misc_feature (77)..(78): n is a, c, g, or t
  misc_feature (90)..(90): n is a, c, g, or t
cggcgcncacgggaattccggnagtcagacagggtacgaccatcttccagcagaggnnnatctttgccggaaaacanntggaagatggtngtaccctgtctgactacaacatccagaaagagtccaccttcaacctggtcttccgtctaagaggtgggatgcagat

SEQ ID NO: 620081 - DNA, 647 bp, Homo sapiens
  misc_feature (173)..(173): n is a, c, g, or t
  misc_feature (206)..(206): n is a, c, g, or t
aaaaacgcatctctggctgcactttccgctaactggcaagctttaaacccgtaatgcctggactcgaagctgaatcacagtttgcattcattgcacaaagtattgtttataaggtgcttttaggagtatcctgcagtgatcttatagggctgagaaagtttgcccatgcaggnaggcagcacttgcttcattttcaagagacgcgnacgtcgggcagcaaccttccctgttagttcattgttgtgtttttagtcacaaaacaggtcctggtgcataataagtctaaataaatatctgttgaataaataaatgacaaagtataaagactaagctgtgttttctcctcatggtagggatatgcactctaggttctctcttcaaatgtgcagcagatttctctttagccattccactcgcaaactggcatctgtctgacaggcgatgtcttaagtcttttcttattgaacgctattttatttcttgatgtttattatggaaagagtagatgatgtttcatgtattattttctgattaataaatgaaaattagattttatgttatgttaaaataacgttaagagattttactgaataatctatgttttgagtagataaattaaccgcaaaataaaaccattttcatttacc

SEQ ID NO: 620082 - DNA, 427 bp, Homo sapiens
acctctaccacgctacagatcgggagatcgcgacgggttgtcctggaggtggaggggagatggtcagtaggacagaatgtacattgatgactcgctcattggtggaaatgctccgtgaaggcccgaggggaaggtacgaaagccagtaatcactggtgtcgatattgtcatgaaccatcacctgcaggaaaacaagttttcagaaaagaaggctaacaggatgtacatcaaagattacatgaaatcaatcaaagggaaacttgaagaacagagacccgaaagagtaaaaccttttatgacaggggcttgcagaacaaatcaagcgcatccttgctaattttcaaaaacgaagcagttctttatttggtgaaaacatgaatccagatggcatggttgctctatatgggtaccggtgggggtaggaggt

SEQ ID NO: 620083 - DNA, 411 bp, Homo sapiens
gttgacctttctgggaaggttcccgttaggttgttcttcaattttgcaagattatatttttttaggctttaggggccctgcgtgggcttatgggtcgggtttctctccctctttcccagtacgggagaccctcctgtccgacaaaacaatgcctcccgcccaggattcattcgggttcagggcccaagaaggcatcccgagtcttgattcccccctcttttgttattttattgggaacctggagcctacctggagcaacaactgtattctcttgcggtcttggcaattggttacaatccagaatggtttgttgggaacagaaataacccagagcccctggaaccaacctgggtcccaatgatcaatacaaggttctacctagttaattgtggatacagcagctgaggagga

SEQ ID NO: 620084 - DNA, 315 bp, Homo sapiens
tgctgcaggtgctctgaggatcccaagctcccacaagatgacaatatcagaaagtagtagtgctgttataaaataaacaaaacaaagtataggttagatacaagtcactgagggtacacgttagataaggagttggagagctgatcactgaataagctgagtactggggaggaacaacccaggatgagggaccaggaaagtggtaaaactctttaagtaagagcagaatttaaagccttatgtggggtgggttattattgaaatgggaaataatgggtaaggatcaggtttaaagtagggcaggttgacagttca

SEQ ID NO: 620085 - DNA, 392 bp, Homo sapiens
  misc_feature (13)..(13): n is a, c, g, or t
  misc_feature (18)..(18): n is a, c, g, or t
  misc_feature (24)..(24): n is a, c, g, or t
  misc_feature (115)..(116): n is a, c, g, or t
  misc_feature (127)..(127): n is a, c, g, or t
  misc_feature (164)..(164): n is a, c, g, or t
  misc_feature (273)..(273): n is a, c, g, or t
  misc_feature (304)..(304): n is a, c, g, or t
  misc_feature (344)..(344): n is a, c, g, or t
  misc_feature (374)..(374): n is a, c, g, or t
ggtagccccgcgnacganctcggncgagggtgcgggctcgcgctccctcggctcctggcgcgggctcggggagaggggtggaagatgtctatggatgtgacattcctggggacgnntgcagcatacncatctccaacccggggtgcctctgctgtggtccttcngtgtgaaggcgagtgctggctctttgactgtggggaaggaacaacagacacagcttatgaaaaagccaactttaaaagcagaattccctcaatttggggttttcagtcngtggaaaagaaacgcccaggtaaaactcaantgcacagaaactttaaagacctttggtgttccaccaggtncctgcctaatgggaaagctgaaaaaatggnatttcctggttgtttctg

SEQ ID NO: 620086 - DNA, 929 bp, Homo sapiens
gggggctagtgcacaagcgccaggtgttcaaggtgggccatcggcgggtgcccacgggcaccggctggatggcctacgacacagggtacactctagcgctgacatggtacgtctcctgacgaacacagcagcagggcgtatgacgggggggttccagtgggccgtgacaacagtggagcaagctggcacgcgaactgagctcgctacaccgcgttgacttgttgatccgtcgcgacggcttgccatgggacgaataacgatgcagtgtgtctccgacacgagacgttcctcggtctccgcaagctgatccgagcacgggaaaccgttagcagctccgagatctaccaccaagtgatgaagccacgggtattcgcctgtgccgcgatgatcgggcgaagcactatgaaggtcgacgcgttgccttggcactttctagcaaggaaatacctcctgagtgtgcccaccgggtagccgtcacatgacgtggacaagtgggtgcagcctccgcggggaaccaggcgggagggactgagtggcccgcgggccccagagaggcacttggtccgcgcccagcgctggacagcacccgaggagccgctgcttcaccggcccgacggcctttgtatcctattatttaaacgctcttggggtcaatgtgcgcatgcattcgttggttgtcgagtacagagagatggtggtctcgggccaggcctccgtctccccgcttctgggaggaggaggtcacacgctgatgggccactggagaaggccagaagaagactcagaggagcgggctggccttccgactggggctcctgtgacgtctcagtcgcctggtcccggcaggcaacgtacccaggaccgaagcatgcattgcctggtcccgccggcagtctacccgcatgggaggtagggatccgcaggagggg

SEQ ID NO: 620087 - DNA, 1101 bp, Homo sapiens
atcgtgtggttctactgtttggatgccacgagctgtgcggcgcaccttgtgacttgtggtctctcatcagggtgcggttcacgggaatgatatgtctcagaagttcatggtcctggtaccttggtacggcccagtggccagtagtcgttccatttggcttcccgttcctagccgccactcagacccattgcgcactcgggcgggtggtcgaagtcgtgttctagtgaacagatggcctgtaggacccatgccgtgatgtcgtgcgtaggcccgttgtgcactatagagttgcagtggcctgcaggggatgggcacctagggcaacgcactacggcagctggtctcgtcgcttggccgtggcattcgggtggtcaagcttcccactgggcatgtgctagggagctctatcaggcgtcgtcctcccgtgacacgattttggaggatgactaggtgatgggttggagcgaggtgccccctcaatatgcagttagggcaatagaggagcaagcggctgaagacccaacaggggccccatgcgtgcctcggcgtcctgtgcctggggacatgtgaagacgtcaaagcagagccccttgtgacccgcgtccctccccggcaggcccatctggagcaccatcgcgcgcagtgcagtgcagtcgctccactcatgctgttcccgaaaacatccgctgcatcaaacggctctagtatttctgtagttctcgttgtgtagattgtgatcctcggggagggggaaggctggcaaggaaatcacttagcgcagcacctggcacatagtgagtgctcagcaagtgtgagccattgcgttgctgtggcttcagtgcgccatccacagtgtactgccgtggtgcccactctgagcagggccccgtcataagggaaacatattaacagcacagcagctacacgcacagggagcgctcactgtgttccgggcactgctctgagcacttttcacccattgactcctctaatcttctcatggcccttgtgctggacactcttcttatccccattgcaacagaggaggaaactgaggcacagagaggctaagtgacttgcagacggtcacacagcattgaa

SEQ ID NO: 620088 - DNA, 486 bp, Homo sapiens
aaggaaacagtgagtggctggcgtgactgcacacagtcaaccgatacccaagaccatcttcatgcttcctcggcgacatggcttcaccagagaggctgcatctaacatgtgtcgaaaccataccgagaaggaaaggtgctcccatgactcacactagcaccgtaaaaggtgagcgttctggtgtctgtttcctccctgttctgctctttcttccgcacgccccccccagggactccatacccatacccgctgacatcagggcgccggtcaagtctaagctgtgggtcgaccctgacatcaacttatgacatatctcactgttttcaactacatgtaaggacttatcctcagcaagaaagtgttccctagaaaggtccttatgtggatttattttaacaagtacaaacattttgcatgtaaatgggggttcaatagttcctgaggacccgttactgatttatagcaggagtgtccatcttttggttt

SEQ ID NO: 620089 - DNA, 125 bp, Homo sapiens
gcagtcaacgaggacggggcctcatataacaaaaataggatgttgtggaaagaactcaagaatttcaccgagaatgcagacgaatgataagagtcaaggcaactcgtctggagaaagtaccgcaa

SEQ ID NO: 620090 - DNA, 105 bp, Homo sapiens
actgagatcacagactaatcctgcttttactgagttacatttttttgttctgaggtgatattaaggccactgatatagaacaatgaacaattaatcataatattg

SEQ ID NO: 620091 - DNA, 187 bp, Homo sapiens
agtggatgattatcgagaccactgtggcacactaagttaggatccggaagatgatagctgctgtaataaggctcaagatgagctgatcactgtagcgaaagcactgagaaggagctatcagtgataatgctgagacattgccgatgatctatctccgcgtgactatttccatgcctagcttggtcgg

SEQ ID NO: 620092 - DNA, 155 bp, Homo sapiens
ctagaggatccttatgctactccacaaacaggtgtgtgtggtgtctgttgctgtgtgtgtttgagttctggtatgtgcatgagtggtgtgtgtgtgtgctgtgtgtgtggtgtgttgctgtatgtgtatgagtgctggtgtgtgcacgagtggtg

SEQ ID NO: 620093 - DNA, 426 bp, Homo sapiens
gagtcaataattaagcaatggaaacaaacagcctaaataaggttgttgaggactcaggagaaggtggctgattaatctcaggctcatagtttgaaatgggagcgcagggtatgggctgtggccccatcatttgctccttgggcgtgtggctgtgtaaagaggtgtggggacccacaagaaggccaaggagcagcactggggtggagagagcagtggggaggcggggacccaagggttaaaaaaaaaaaaaattcctcaatttggaaacatttgcaaaactccagaagaaaaacttttaaaagttctccactcccttccaaacgtacaaacatgcacacacacaattaggaatttcccaaagttttcatctgtctaaaaagaaagtgccagtgcagtcgacgcggccgcgaatttagtagtagtagg

SEQ ID NO: 620094 - DNA, 387 bp, Homo sapiens
gagtcaataattaagcaatggaaacaaacagcctaaataaggttgttgaggactcaggagaaggtggctgattaatctcaggctcatagtttgaaatgggagcgcaggggctgtgtaaagaggtgtggggacccacaagaaggccaaggagcagcactggggtggagagagcagtggggaggcggggacccaagggttaaaaaaaaaaaaaattcctcaatttggaaacatttgcaaaactccagaagaaaaacttttaaaagttctccactcccttccaaacgtacaaacatgcacacacacaattaggaatttcccaaagttttcatctgtctaaaaagaaagtgccagtgcagtcgacgcggccgcgaatttagtagtagtagg

SEQ ID NO: 620095 - DNA, 427 bp, Homo sapiens
tctagaggatcccgacgcattcacagtccactatggcagagctagcatcatgactgaggccagctctccacagcgtcattgagaacctggagatgctcaagtaccagcgaaggcagcagcagcagagctggaccagaagagtgctggaccagggagatgggctcagcacctcagtcgcaggcgttgtcaacggggagagtcttgaagatatcaggaagaatctcttgaagaaacaagttgagactcggacagcagatggcgggagaagaatcacgcctctctgcatagcacagctggacactggggacttctccacggcattctttaacagcatccccctctcgggctccctggcgggcaccatgctctcttctcatagcagtccacaggtactggcactggactccagtacccctaactccttcgg

SEQ ID NO: 620096 - DNA, 340 bp, Homo sapiens
aaggttttctcccaggctgtggatctttgttccagctctaggaaactgtagaaaaccaatgctatgtggcttttcccccccatggtttttaggggggccaatcaaattgtccccctttttcccaaaaccctgttttccaggtgggacagttagctgtcactcagctgcccccatgatgtggcagcaaagagggaaccctacaagtggtttgccctcattccctttgccccatttgaagttttcagcagcccccccttagacttcatgagctaataggaaactttttatggggtaaatgctgtaagactttgtacatacttcagttgttatgaaattttta

SEQ ID NO: 620097 - DNA, 522 bp, Homo sapiens
ccccaatgcacatgttagacaccccccagtgatgctgaaccagactccactgggatattagggggcccgtccgagagatgggttatcagtccctgtgtgaggatgcggttctggactggctggcctggggccatcccagctggagctttctggcagggttcctgggtcttgagtcccgcagcctgcagtgtgtggcctgaatctggcttcttagacacaggccagtcctatcctgcctgggggtgggaataagcctctcacaggttctggtggacagatctgtgccgcaggtcactccagtggtctcgaggcttccagataaggctggttgcctcaagctcttctctgcctcataaatggatccagagaaggctggttgccttatgctcttccctgcctcgggtgcctgagaaacggattaatagccctttatcgtccctggaccgctcctgcggggtgatggcacttggagcgctctggagccctgcccttgatgatgcttagtctcttgagacttgtctg

SEQ ID NO: 620098 - DNA, 816 bp, Homo sapiens
tcgagaacacaccgaatagcgctaggtacgaggccgggtggtgatgtacactacaaacactcagtccacatgttgagccccagtgctggaagggcaggaaggccttacttctgtgttaatgcgtagaggctacagggcgtgagcgctggactaaaggcataccttgtcttttgagtctatacacctcagtagaagaaggatctaatggtggaagatcactgtagtttagttctgttgacctgtgcacctaccccctctggaagagtgtctgctggctattgtctaattccagcaggtcatcaggagtgtcctgcttgatagatagtactagaacagataaacaacagactttcatcgtatctatcctgattgtaatcgtgtgccatggatctgatctgtaccatgaacctacataagggctggatggcaccctcagggctgagggaccccaagtgtatgtgtggctgtgggtgtgggctgggagtcgtgtctcgcgtgagtaaggaacaccgattcttgcaatgattgctaaatgctcaagttcaaggtgacgacattaatgagtaaactcgaggatctgagtcacagaggtccggatttctagcagtgcttgctttggggggtgtgctgacaacttatgctcaggtgccttacatccttttcgtaatcagcagtgttgcgtatgagcctgtcctcactgccctctgcagaagtccctttgcagctgagaacctactgaagtgggtggtaaaaaaggggcctgagtggaggatcatgagtatcacgatttgccggattcccttctgggcttcaaca

SEQ ID NO: 620099 - DNA, 103 bp, Homo sapiens
  misc_feature (19)..(19): n is a, c, g, or t
  misc_feature (86)..(86): n is a, c, g, or t
  misc_feature (93)..(93): n is a, c, g, or t
gatcctcaggactgaccanttaagctggcaggttgtcccagctttttaatcccagtcataataaggtgaccagttttaacccgtgnaaacttngaggggactt

SEQ ID NO: 620100 - DNA, 777 bp, Homo sapiens
  misc_feature (100)..(101): n is a, c, g, or t
  misc_feature (236)..(236): n is a, c, g, or t
  misc_feature (238)..(238): n is a, c, g, or t
  misc_feature (312)..(312): n is a, c, g, or t
  misc_feature (332)..(332): n is a, c, g, or t
  misc_feature (336)..(336): n is a, c, g, or t
  misc_feature (429)..(429): n is a, c, g, or t
  misc_feature (522)..(522): n is a, c, g, or t
  misc_feature (577)..(577): n is a, c, g, or t
  misc_feature (744)..(744): n is a, c, g, or t
  misc_feature (770)..(770): n is a, c, g, or t
tttccgtttgtcacgagcgcgcatgtgtggtaccagggattcggcattaaggcgggcgtggggctatacctatagtcgagggctctgtctcaaatactannttataacctgtcccaacgctcggcataatttaagaactagttacttcttctcttttcacttaacgcaaccctcctaaagtactattttacagatctatttttttatttccggggggggggggaaacacccaactntntaaaaaaaaataaaaaaattttatttaagagccatttcttcccttattatttctttcacattaaccttttaatncatcaattaattttttttanattnctaattccctataaaaaaacttttaataggataattgtattcaatataaaattagagctataattaaaacttaccgctgacccaatataaacncaattttattttttatgtattattacaaattttttttaaccgcaactaaaaaaaagcgttaacttaaaatgctctaattacattaggaataangaagccgtctaaattagaaaaacattggcttatatgtatcctgatacattttagnagtcctcgtctcattctttgggtataaccaatattattttgaagatagaactatctaagaatttataaatagggccaaaaatataaggccggagtgaaaaaaagaataatttaagaattttctttaatctactaaaatttttctcacagatgattcttttcttatangagaatgaaaaaattattgtaactcnctactcc

SEQ ID NO: 620101 - DNA, 296 bp, Homo sapiens
aaaaaaaaaatttttccccttttaattttttttccccccccccccccccaaatttttgaaacccggggtttttttggggggaaaaccggggaatttttccccccctttgggtttttgtggtggtgggggtggtttttttaaaaaaggcgggtttcccctaaaataaattttaaaaacccccttttttgttaaccagggttgtttttggccgggggccccgcccccctgggttggtccccctgggtttgcctttttttttttttgcccaaagtaaaaataaccttttttggggggta

SEQ ID NO: 620102 - DNA, 114 bp, Homo sapiens
tagctggtacctagatgtgctcgcactcctggaggccacctcaatggagttcgagcacatcaaatgcccccactccaagtacgggtgcacgttcatcgggaaccatggacactt

SEQ ID NO: 620103 - DNA, 134 bp, Homo sapiens
agcaagcttggtgacctccgcgcctccgtttctcgctgatcaaataagtagaacaagacctcacagggttcttggaagtattacgtgggaaaacacttataaagtggcaaataataaaaactcattatattctt

SEQ ID NO: 620104 - DNA, 583 bp, Homo sapiens
tcgatctagaggtcccggaggctccattcaggggccacactcttcctaatccccaccaaatactcagccggtttcttccagggcttttctttaaaaggatattcacgggatcactagaaggccaggctctagatgctagagccacagagatatacctttcctaaggggtaagaaatattttatattggagagggagaacagataattatcccctccccggcctccaacatggaaaagcatgcttctggtaagaggcagttaaatttggaaattcggttacattaaacccttaatactcatgagctacccatagacttcagtatgggtttccggggataaaccattatttacttcaggaaacggtatcattagaagggcagccattattccattctgggcataaaagtaaaaggaaagcatgaacagggcacacgataatcaatttaatcggatttataccagggggcaggcaattatggtttggtgaaataaaatatagggcggtggatggattgggtggtgtaatgatagtctgtattttggtaacagttcactttaggtgggacggccttcaatgtggaat

SEQ ID NO: 620105 - DNA, 1479 bp, Homo sapiens
  misc_feature (278)..(278): n is a, c, g, or t
  misc_feature (395)..(395): n is a, c, g, or t
  misc_feature (456)..(456): n is a, c, g, or t
cgcgtaagtcttcacgtggtttgtgctgcctcgcagttaggtcctgtccgactggtaggaaacatggtaactatagactggcaggcccaacagagatgtgagccaactcagtagccatttcaggggcccgagcgatggatggcagctcggatcgccaaggctggatgctagggactcacgcataagtagacctagtaatccgacattcagcgcgctggcacaaaggcatcctagtacgcatgcaattgtctgatcgtgtgcacaccatgctgcgtagntacagggatgcaggaaaactcgcgcgcgcgcatttcgaggctcgtggcgaggtagtgcaccggcactgcgcaagtgcacgtgcaagggcacgatgtcgtaacaggcgccccgctggngctgcggtgcactgaggagacgactacactgagctcaaatgagacaccaggtcttgttggngaggaggttgccacgcaatcgaggacgtcggactgttgggggacaaggaaagagacggtagtgacgctcgagttggcctgcgtcgtggccacgggaggagggcacctaccgcgaaacaatcagactcctgggccctgcgaattagggaagaggacccatcgtggctagccgttgaacccgggggggacaacaactttgtgacaaacttcgcgctgtggtacagacacagggtttcggggactgcccgacacggctcaaaggagggggaccaactcgcttcgatctccgacaaggaaaattggaaaacgaatggcaaaaaagcgcaatggtggttgatttgggaggaagcgggtaccggggtctgcatggttgggggctcaattgatagggcccggtggctggggttgggcgttctgccacagtgcggttatcaccaatggcgggccaggaccccaccggtggggcaaccaggaaaccaccccccaaaaaacgaaagaggtgggcgccatgggaattatgggtaaggcggtctggccacccaagagagggcatactctggcaccggggaaaacttcgcccgatttttggagagcaggttgcaccacccaacggttttccctgagctccgaaatttgccgggggattttgcgatgcggccgcaaagacgaacccgcggatcactggcgcgtttgggacctcgaagggaaaggcctgactggctttggaaattccgcgggggggttcagcaaggtttaaggccctagggggaccccctgcgtggcccgcacaagcccaaaaggaactctgtgaagtttgtttggcgcctatagagcgttctgggcgcgtcgtggtgttatggtgtaaagccgcctgtaaaacacagggtagacaacacgcacacagtaaaatatcggcgaggggggcagcatttgtagcgtccacgactgccactatataggcccaacatgtttgtgtgcgcacaccacgggttgttttcccacactacttggcccctctttaacg

SEQ ID NO: 620106 - DNA, 1371 bp, Homo sapiens
ggttaggattcattactgcaaacctacataatctaacatatttgtttactttagtgtgacaactgatgaacaaaaaatggtcgccatccggattggctttaaataacttaagaagggagaaacggtggtcttctttacatctcttttcggcaaatggtcccacttccctttaaccaaactgtcatatgaactgagatcataatttttaacaggtgggccattccttccactggtattcgacaaaccataggaatggttatttggaggtaattattacaattctttctatttttcacaggagcccattacattataacgggtggaaacaattatggcaccattacaaaatggtaaaaagagatactggttcacacacttaccaacccaaacacaggcccactaagaagtggacaaaaacacagagcacacagagacaatgcggagaccccatacataccacacgggggtcagtatcacgtacacttaactatagctaataagcgactaagccccctatacccacttcaggcacacacataaacacagcacaaattgcgaacgccccacccaatctgcgtacaagccccccaaacgtggcacaaagtgcaaatacactcacgtgcgggacccaagtactacaccacgtgtcccaacacacaacctgaaaaaagaaaaacaactgccggcgacaccacaccaaaccacctaggacgcctacaccaaggagaaccaccacacgcccacgagcggcaacataccacgggtcaaacaaacaacagtaacacaccatcacacatggacaccaaaaattacaaactcacacaaaaacaaacagacacagaaaacccgcagagaaaaaaaagaaaacgacagcagaccacacaccaaccacaacgacagaagaacacgagaacaagcagcaaccacaccaaagagagaaccgagaagaccacacaaaaaacacaaccaaacacaaagagacccaaaaacagagacacaaaacagagagaacacgacgcagcacaacaacacaaggactacgagaaccacaccacaataaaagatacccacgcagagacaccacaagaacggatcataaacaaaaacaaccaagaagtctcagcgacccccaacggcgcaaaaacaaaacgaccacgacgaccaagaacaaataaccacagaagcgggaaacacaggccgaaaaacgaccaaagaaagcagcaaacgacgacacgaccacgcacaaccgaccacatcacacaaacaacacagccaaagcgtaacacacaaccacagcacaatacaagaaagaccgcaaacagaacgaaccccacaaacagaactaaacacaaaaaacaacgacaacagaga

SEQ ID NO: 620107 - DNA, 978 bp, Homo sapiens
  misc_feature (690)..(690): n is a, c, g, or t
ggccgcgtggtgtccgcggtcgcgccgggtccgcttgagtgtggcccgtccgacagtccctcaccccggctgcgctgtggtgactcggcctcaggaattccgctgcggccaatggttgccgttgtgacgaggcagcagtcgcggtaggcgggtggggcaagggttgcccctggggggaaggccggaggcgcgtttcggcaccttccagcattggcgacccgcggtgccgcccttgtggggcttgccttcccccgtgcttgttgtacgcggggacggccgggtccattcccttggggggggcggggcggggtggttcccctttaaaaacttttaaccaggcagtttcccatttttgggctttgcacaggacgtgtgccctcggggcaaaagggcccattgtggccattccacgttggggacccaggaagaaaagcatattcctttagcgccaaagtgtttgaggcggtgcatcttgatggcccaccaatggtggtattttctttctccccaagtacactgtgatttgaggccaggtggttatgggaccattattaggtttcctccactacatttgactggccggttgacgctgtgacaaaagggcgctttagcaggagacttgctgtctgggcgcaaaaaggggaaggacgcgcaacgtgaccttacagagacacggagggtctgaccggngggccagctcatcggggcggcgtaatgggttgtctatgggccgggagtgatgtccttcttttgaaaaattggggcgtggcacccttgcccaaggaagcaggaaggccggagaggtggggcgattgttccgcgagggaattgcccagaagatagcggagcgggccgagtggcggagctgggggacattgcccgccttcctgaacatggtgtccgcctgggactccctcgcgggaaactcgtgtcggcacacgtttagagtgtggcacagctttgctaatagtctcgggt

SEQ ID NO: 620108 - DNA, 117 bp, Homo sapiens
ttataggtgcccgagtagcatcctagtgagccctccccagaagccacacctggccctgaaggtgccactccagtacccaccagccttgtcctaataaaatataagttgtatcattac

SEQ ID NO: 620109 - DNA, 284 bp, Homo sapiens
ggagcgcctacctggcgaagggtgacatcgtggtggaagcatgggctgacctccgcagatgcccctgagcctgaaggagagcctgcctctgtacgtggtcgcggatgtcgacacattgttgaccgtgctggtcggcatcttcttcccttctgtaacaggcatcatggctggctcaaaccgctctggggaccttcgtgacgcccagaagtctatccctgtggggaccatactggccatcattacaacttccctcgtgtacttcagcagtgtggttctcttaggtg

SEQ ID NO: 620110 - DNA, 425 bp, Homo sapiens
cgctgggattacaggcgagagccactgcacttggcctaaatattaataatctaatctctggtcacaacctctcagttgcacagccttattctacagataccttaaatagaccatcaaactattaatctttcaaactccaattttcctcagtctatcaaagaaagtaatagttgacttctttgatgatacgcctacacccatggagtatcatcattcagctgctttcttgctgctaccttcaatgtttaagctcctttttctttgtgccagaagcactcaaccatggatccaaccaaatgccctctctgctccacacttctatggagcctcagacttggcaattcctttgtcagtgtttgttatcaaccagaacatccttaaaggtccttacttgttaaatatcctcccaccctcagacaagaacc

SEQ ID NO: 620111 - DNA, 219 bp, Homo sapiens
ttaggatctctgtagaagctgtcgaccgaagtcgttcttggcgtggtgcaccagcttgtagtcggccgcaccgagtttcgggtgcccggcatatttgcccaggcgcgcgcggtcgatcagcgattgcgggtgttcgatacggaaacccaccgagaacggcttggcttccatgtacacgccacggccgtggaacatgcggaagggatcctctagagtcga

SEQ ID NO: 620112 - DNA, 316 bp, Homo sapiens
  misc_feature (276)..(276): n is a, c, g, or t
  misc_feature (278)..(279): n is a, c, g, or t
tgctgtaatcttgcactatgtcttgatatcgagtagaaggggtctcactccactatcccaccacgttttgctcctctctttcaaaattgttaaaagatttttgtgtacttcattgtttcatattaactttagggtcaatttgcttttgagtttccccaaaatcctgtagatgtattgtgttttaactacacttaatttaacttaccctagggggaactgacatctagaaagtattaagtctcccaagtgtagacggaaccagctttccattgatcngnntcttcaataaagtttgaaacttttaaccttaaaaaaa

SEQ ID NO: 620113 - DNA, 1353 bp, Homo sapiens
  misc_feature (319)..(319): n is a, c, g, or t
  misc_feature (531)..(531): n is a, c, g, or t
  misc_feature (561)..(561): n is a, c, g, or t
  misc_feature (1131)..(1131): n is a, c, g, or t
gcccaggtcagtcagacccacctacctgcgaccacgttcctgcccctcttaacgttctccagggaatcggctgcattcggcaaaacgctcattcttggaacgcgcgtgttgaccgtcaccacgtggtgtgttgaggcgtcaacgtaagaattcctacatgcatcttcgcgccgcctagcgacttaattacgcttcttcacgtctctcgtctacgaggaggaataagtctctcctcgtaatccatgcaattagtagcgactccactatccagctatttgcgtttacgtcttgagtcctatcgcgaaagccctggagaagntccggtaccgtgtcacccatttcgcgtagatgccctcactggctctctcatgccactaatttggggcccatgtactttttcacggttgagcctggtgcctgagtgtgccgtgtctgatggggccatacgccttgctgagcctacgtttgcgcgtgcctttcttctcgtgtgctgtgctgtgcacggcatcttgtgtttaaaccgcgacacancagcagcaccgtttcttctaccactgcggnattcaatgagcgctataggcgacaactgtgagaggcatattgcacgtgtagtatgcgtgtgcggcactggcgacaactgcgcttagcaggttaccttaaacccccaatgctgcacatcagatggctaatcgtacttagtagtatttatccaaatttaaccggtaaattagggggaccgcctaataatcttataaattaccgaaggaggcggacttgaatacttagatacttattttatctatttctcttccattggaaaatccttgttacccccttttacaacttctcttattatccgtgtcccttgggtcaaagccgcaatatgaaggggatgtaaccaacccacatcaaaattacagttctccgccaagcggcgaggcaccaccgccttgagcataggaaggtgtaacttcgattcaccaaaggaaacttatgccaccacaaggtgatggcatggaagcgcccccatattggaatttttgcttatacccccagggaaaagaaaataggcgacgccacccaccgtgggagcgacctttattccaccctttcggttgtcgtatagggtcnaccttttcggccacattccggttggagggggtaaccgaggaattacacccagaggttaaaaccgtaacccgtggtaaatcatccacctagggtttgacttctaaaacacacatcagacaacgaggaccccaaacttttaccaccccaatggaggagaaaaccccccacaatgtgcggaaatgtcgcgaccgcaacattgcgcgcgcccacatacacaccaaa

SEQ ID NO: 620114 - DNA, 308 bp, Homo sapiens
  misc_feature (108)..(108): n is a, c, g, or t
atgctgaggtcgatctaaggatcccaatcgcacgacagtagcagtaggtacgaaccttggtttgcctttattttacattccctcgaagctccagctcgaaatcagaanaatactccaggacagtcttggtctcacgaagacaagtggatcttcagggcttccgcgattagactccattcttgaggctgtgtggactgtatacccaaagagacagtaacggggcatcttcatgtcccaccactccagcacacacaggttctgtgtggatgccaatgcgcaagcgcagctgctccttggtcggggggata

SEQ ID NO: 620115 - DNA, 313 bp, Homo sapiens
gatgcgtgtgatcagttctagaggtatccccgcggagtgcagagagaaagcacaccgtcggactaatgtaggaaacatccaaagtacggagtgtttctggagactttgatcaccgttaacatttctctagcaaagttgtaagcaaaatgagagtgttgttccaaggacatccatcacgactattcgaatggcctgtgccataaaatgtgcttctcttcttcgggatgttgttagctgtctgagtctttgtagagctgttcctgtttcgctgtgagcttctctgctcgcttaaattgttcgttctctctccact

SEQ ID NO: 620116 - DNA, 792 bp, Homo sapiens
tgaaaaatggttcattataaagagggttgggaaccggtctccaacggcgcaaacaagatttggcttgtaaatggaagaatcctttgataggcaaccgtgtgctatcccttagcattagagtgaattgggaaattgaatgcgaggaacagtattcaacctagccatgtcaagtgggaccggagtcttacaagaccgccaaatttattcttattcggtggtgggtagccggaaatgcctctgacgctttaattctgcgatgactcccagctctaggtttttcgcatcccataagggcggcagttcagttcctggcacaatgacaataagacatttaaaggcttctgtgctgaacagtatggatctggtcgctgcattacgagtgctcccgctggccctctcaatgcaggctatcccagggtggcattttctcgcaagcatgtactcctaatggtaatgatagtggcatgatttggtccacttgcgaatcccggtggtcttccatgaccaaacccgctatggaggtcatcccgttctccagactgacaattggagaaggtccgcaacgccacctgggggcatccaaacaggctggaaacgtttaaaacaccgtttcacaagctataaacttttttaaagcgctttatttgtacaaatagacataatgttcttcctattgaacaaagtgctagcaaagcttctcttcattttaagagcacaagactccatgtggcatgccccatatcagtattacggagacgatagtctatctacacgcatttcaataagcttttt

SEQ ID NO: 620117 - DNA, 628 bp, Homo sapiens
  misc_feature (468)..(468): n is a, c, g, or t
  misc_feature (628)..(628): n is a, c, g, or t
gagagagagagagagagagagagagagagagagagagagagagagagagagagagagagagagacatcgagatagagcgagtggtgacctacttccgtaactgtaagtcctaactacgtctgctaatgatctcaacatagcaaactcacctctacttgctggcatagcccatggttcacccagcacttagcccagctgtgctttatctaattctcggcttagtgttaatgatagatcacgatccatctccacaatggctgctagacacttgtggagcatgcgcctagcgttcccgggactgctatgtacgccctgactagatgggcgacaccatcttgtgactgtctgtgaactgtctgaatgctcagctctattcagattatgcccacagtaatgactcctgccgtgccatgtcaagggaacagatgtttatgttgtacttacctcaccacatcctcgggactgttnggagatcgtatccacgaccatgcaacctgtttttagtatactgctttttgatgactcccacgactttttacctcttgcagttcccccatgactgtaaccgggctttcatgtaagctttcccaggcccaccacttaacacctcacctttcgtttcatgttn

SEQ ID NO: 620118 - DNA, 151 bp, Homo sapiens
ttgcgggcctcctgtgtactaggccccctgtcatgcccgggtcctactttccctccctgtcctttaacccggccacaggcggcgggagctgaggagaacccataccatcccgctggaggacgaactgctaacggtagacggatcagaggag

SEQ ID NO: 620119 - DNA, 126 bp, Homo sapiens
cgtatgctcaaatggtatctatcctcatagccttgtcggaggtacgtatatttactccaatatatgaaatcgaagtaattgtctcctgaccagagtcagtttaacagtgagtagtgtcagactgaa

SEQ ID NO: 620120 - DNA, 698 bp, Homo sapiens
ggatcaacgattacatcctgaaagatgcacctaaactagatgaacaccaagtaacattgccctaaccatagagttgctcatttaaagcagacatccagtaacaatcaatacacagagcaaggacacagtgagcgaaattgaagagaaaaaggcgatcagaagctggacaaatatggatttcagaaggatggtcatgatcgaacctgactaacaaattaatagtgtacaagctgaattctctgccatctgaatatgagagtgggtcagcatgccctgctcagactgtgcactacagaccaatcaacttgagcagttcagagaacaaaatagtcaatgttagcctggcagatcttcagaggtggaaatcgccccaatacagggcccttatacacagaggccgatcgaatcatacagagaacaaattcaatgcagcagttggaacagtggattaaaatccagaaggggaggggtcatgaagaagaaaccaggggagtaatatacttaccaaaacatgaccaacgaaagtatgccaagtcacagagcccagaatcatggcccgctacccctgaaaggttcatagaacacatcccaagaaacagcaaggacaaggccgtgaacagtatctgcaggagtaaccccattccactcactgacaagacaattaggacccggaggcggaggagaaaacggaaggtcca

SEQ ID NO: 620121 - DNA, 310 bp, Homo sapiens
ttcccccagttacggagatacttctgtctatcctgaacaacatatatagaaagaaaaaaaaaaatggctgggtgtgtaagtattttctctttcccttctaaaaacggttaaattcatttttgccaggttggtaaaaatagattttcctccccaagtggacctaaatgataacttttctatggaaattattattattttaggagagggggtctcggtattccacccaggctagtgtgcagtgatagaattatggctcagtgcagcctcttcctccggggtacaagcggtcctccccgggatacaggggtcc

SEQ ID NO: 620122 - DNA, 124 bp, Homo sapiens
ctgcacatacacaatgctgctcatctgtcccaaaaccttcatgccttacgaagaatttccgcatctcttatagcgtcgaagttggcagctggtcggatagttccttgagtgacctgagaagctg

SEQ ID NO: 620123 - DNA, 1197 bp, Homo sapiens
gcacacaccgatgcacacacactctctctttctctctctctctctctctcacacacacacacacacacacacacacacacacacacacacactagtgagtgccttgtatgacgcggggctgtgtgtatataggaccctcgtggatctttgctactctttcaggaggttcctatatctctgtcctctccctcttctcgtggctcgtgcgtgtcgtaggatgtcgtggcagcgcgggggtagttgttcagaagggtctctaggcgccgtgtgtctagtagtgtccaggagcacgtggctcgtgccctatcctggtctctctggccagccagatgtccccgtggacggcgacgccagtgctgttttacctactctctatcacgcagaaccacgtctactactttactactcaacatacatgaccctatgtacgaagacgcgtcctccgcaggggaccaacgacttcatgagtgtggtcactccatcttactccctcgttcctgcgagggcgaaacgacgggcagggcggaacaatcttcctccgcgggtggctcctcttgatcaaatgacctatcttcttcatcccagttcccgaagatatcacgatggtggctgcagagtactacttcatttactacttggcgagactagatagagcacgacatctttactagagggagcggatggtagaagtcctacccgcatatagagggcccacaggaggaaacgttggggcctcctacccgaaggtccatacctacatcgttggcttctcacttcgggtgggggcccccaaattaccagatggggccaagctgtcttcctgggcggcccatcaacacaggcgatgtacatcgtgggggaggcacgacagacacacgcggcactacggacggacacgcctcacgccctgaatgtagcacccatattcacacctgggtagttcggcctccatccaggttgtgaggaggtcgaatcatgaccactcacgtgggcgcgacaccacgcacggacgcacgcacgcacgaaggcacgttctgactctttggagtccaccgagacgcactactcatttgaacacgcagggtgagtgggtcaccagaggaacatagtcaataaagaacaaggcacagcaactgtacatacaggcaggagcggcgcacagcctgtggaatgtggctgcctccaagagatgacccg

SEQ ID NO: 620124 - DNA, 107 bp, Homo sapiens
ctcacgcccatgtaaaatccggcagaataatccttcaatgccttactggatcataggaacaaccagagataggttagcaggcttctcaattttctttttgatttttt

SEQ ID NO: 620125 - DNA, 624 bp, Homo sapiens
ggcccattgctttggagcacagatgactctgggggcagaggtgggctctgtttaggagggcagtgagaccacccagccaaattgcttctcaaccctagacaaagccttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtactgaaggaaaccagtgggagcgaaaactgacagttttcacggactggtgggatgtgatttacgacagtgcacactgctcgttagcggcctgctcacctacgggacgtgcgcctctcactggcagcggctggtacacagcaccgtcagtcctagccaaaactgtcttacgaaaccactcacgtctcctggtcccagcaggatggcttctcagcggcactgccacaagctctacaggtcaccttcctgaacgcatgacactgcgcacacgctgccaattctcaagactcatctgcctacgggagcggtcaccacgacggcaggatcgtaccgacac

SEQ ID NO: 620126 - DNA, 176 bp, Homo sapiens
tatacgaatcgaggtgtaaccaggacatctgctatgttgtccaggtcagtctgaatctggaataaagggatcctcgcagattggctcccaaagtgctgggattatagataggtgtgaaccatcatacccagctttattttattttgttgtagagataggggtcccgttcacttgcc

SEQ ID NO: 620127 - DNA, 675 bp, Homo sapiens
agcggagcggtgcagccacccatgctgcgcgcgctcgcgaagaccaccagcgcccagagccccagtctgaggcttggctgccgggggtctgcgggcgaggggagctctctacgtgcgaggggctagcgggagccggcagcaagagggtcagaggagccaaggaaccccaaactgtccggcgccaggcgctagccaagctgctgcgcgccccggcgcccagctggctcggggacagccgctgggtgtcggagaccggagctagcggattgcagcggaatgagcacaagatgtcacactggtatccgttggtgctccagtggtccattaaggtgagaataacgatctctgggctggctggaactatgcctaagactgaagatagcagccatggaccatggcggtatgagcccacgtcaatggtaagctcacaagatgggctatcgcattccatttgagctcaatggcgtctgtggtgtcaaccgaacagcgtcaaaccagacagagtccgtagctatgacctgacgaagcaagtgcagtcctcacattcatctattttgtaggtctgcatcattgggtagtgtggcaacagacttgtcatttatgtcagtcctccgctatgccaagatgaagaccatcaccaagatttacatcctcaacctggccatcgccagatga

SEQ ID NO: 620128 - DNA, 332 bp, Homo sapiens
cacggtggcatcatgctgactatcccagcactttgggaggccgaggtgggtggattacctgaggttaggagttcaagaccagcctggccaacatggtgaaaccccgtctctactagaaatacaaaaaaaaaattagctgggcatggtggcacacccctgtaatcccagctactggggaggctgaggcaggagaattgcttcagcctgggaggtagaggttgcagtgagtcgagatcatgccactgcactccagcctggccaacagagcgagactctgtctcaaaaaaaaaaacttactcaatatgctgttacattaattcaaattgtgcctg

SEQ ID NO: 620129 - DNA, 255 bp, Homo sapiens
ctgcctcccgtgggccctgtccgggttgcacaaccaaaaatgcctttggccctacggatggcccctggctttggtttaaagggcctggggttggtggccatcaaaaaggaaccagtcaggcctgtgagggccgtagaccttgtatataccctgccccaccagtgaccgggcaaagcccaaccccctccccgggggtcccagcacccccttttttaatcatgaatgaacaataaagcccccgctttttgtcaggca

SEQ ID NO: 620130 - DNA, 127 bp, Homo sapiens
ctcattgtgtggctcatggggtggctatttgggcggcacattggggggcacgagggggtctgatgagccaccccatgcgccacccaaggagccacacaaagagccacacaatgggccacacaatgag

SEQ ID NO: 620131 - DNA, 119 bp, Homo sapiens
cattggtccgagagaaattagtgaatgatgcctccaccttcaaagccagtgctcaatccagaaatttttccctctccccaacccttcatgtactgctgctaatttctctcggaccaatg

SEQ ID NO: 620132 - DNA, 459 bp, Homo sapiens
gatctgagcatatggcagccaagctgggttatagcctgctttaagccctgatcaagtcaaattcttagtgtccattttttcatctctaaaatataagtgggtaaaataagaatgtctctaggtccttttctatattaaaattctaaaattcttactatgcataatcaagaagaactagggggataaaaagagatgtaaaatattccagttcagcatacagcacaatagataatccttgctaatctgtacatacagcttaattggaaaattaagaactcagcaatttctataaatggtctagatttacagttatatttatttaggccaagaatgatggtattagggagctaagtattccctcagtgaaaaagttcatagcaaagaggacaaaacagaccactagaaacattgtgtactgtatcttattttagacttggccttgccatatgcaagggtacc

SEQ ID NO: 620133 - DNA, 342 bp, Homo sapiens
tccacagttgggttcatctggaagccagatgggacagcaccgttactgcaggtgtgagcaagggatgctggggctttggggaaaggtgccgtctggtcccccactgccttgaaaaggaagttagtgagggtgcctttcattcgtaacctgagactgccactgcctacctggtaggtcaatccagtcgccattggctgccacgacaaaaagtcactgcatcgttcgggacttgggccttgctgcttcacatggaaggtggcgacacaggtgtccatgaggatatgaggcgcccttgggctgcggcgtcgtactgcctgtccacgatgtctgtgtccgcggccg

SEQ ID NO: 620134 - DNA, 319 bp, Homo sapiens
acaccgccatagccggtatttttttatttttttgcatttttagtacagacgagctctcatcatgtttcccaggctggcaactcctgggctcaagtgatccacctgcctacgcctcccaaagtgctgggattacaggcgtgagccactgcgcccagccattcagtgaacatctttaagcatatcgccttgggttttactggagtgttggagttacttcattgggctacattaccaaatgtggaaatttgtgggcaaatggtataattaactatattgctcttgccgtgtaactattaatattaaaagacaaagggaaaca

SEQ ID NO: 620135 - DNA, 504 bp, Homo sapiens
tgagaaatggaaactcactctgtcacccaaacgggagtgcaagggcaccatctgtggctcactacaatctccagctcccaaattcaagtgattctcctgcctcagcctcctgagtagctaggactataggtgtattataggacaattttaaaaaaatttcatggtaaagacgggattccgctgtgttgcccaggctgcaagtctgggcctcaagtgatcattccacctttaactcttgccctcaagcaatcctcccacctcagactcccaaaaggcggggattatgggtgtgagccaactttcccagcctactagcaggggtctggtaacttattcactgggcatgatttatgtaatttaaaaaaatggttggttttccaaatagaaaagtaaaataccgaatatgctttcccaataacataatccccttctcacttgagaatttccctctaaaaagatatgctagattaattccaggcttaatgtgcctctggtgtgtcccct

SEQ ID NO: 620136 - DNA, 231 bp, Homo sapiens
ccacctcagcctcccgagtagctgggactacaggcatgcgccaccatacccagctaatttttgtatttttagtagagatggggtttcaccatgttggccagcatgatctcgatctcgacctcatgatccgcctgctttgacctcccaaagtgctgggattaccggtgtgaaccaccgccgctggtcgaccctgcctttctttagcccaaactatggtgtggtgtcctagga

SEQ ID NO: 620137 - DNA, 375 bp, Homo sapiens
tgagacagagtctcgctctgtcacccaggctggagtgcagtggtgcaatctcagctcactggaacctcctcttcctgagttcagcaattctcctgcctcagcctcccaagtagctgggactgcaggcagacaccaccatgttcggctaatttttggatggttactagagatgggggttcaccatgttggccaggctggtctcaaactcctgacctcaaatgatccacctgccttggcctcccaaagtgctgggattacaggtgtgagccaccatgcccggcctgcatttctttcaaagggtgatttctaaaaggaagataataaatggatctatgattccattttcagtaaggtagaattctaaatactttccat

SEQ ID NO: 620138 - DNA, 361 bp, Homo sapiens
gtctctagaggatccacatacattgtctgatgacaaggatttcactctcatccctgtacaatatagtgtcagaagtattactggccaggtgcagtagctcatgcctgtaatcccagcattttgggaggccaaggcagacagatcacctgaggtcaggagtttgagaccagcctgactaacatggtgaaaccccatctctactaaaaatacaaaattaaccaggtgtggtggtgcatgcctgtaatcccagctactggggaggctgaggcaggagaattgcttgaacccaggaggtggaggttatcgtgagctgagattgtgccattgcaatccagcctgagcaacaagagcgagactccgt

SEQ ID NO: 620139 - DNA, 657 bp, Homo sapiens
agcggaataattatctattctttggagcaatgggtgaagtatgtcttcatgagcaaatttacctttctctccaagttctcccacattcggaaaccatgtttctgttggcaataacatgtgcatttgtatccaaaacactgtctggatcttatatgaattccatgctcacacaaatagagagagaattcaacatcccaacatctctagttggattcattaatggaagctttgagattggaaatcttttgtcgattatatccgtgagtcatttaggcaaccacactgcatcagacctcatcacatgatctggcattggcatgtgtggttcatggcgcttcaggctgttctcttacacatccactacctcatctcctcatgcaaccactcatgaatatgaatctacagtctcagtttcaggcaacttgtcctcaaacagtttctcgtgtactggcaacatggaacccagattccaagaccaacgcaggatccatcagagtgtacaaacggaagttcacatcatctcacatgtggcgtgtacgtcctagtaggcacatatccgtccgtgcaatgggtgacacactccccatcctgccttcgcgctctcccctatatagaaacatccgcccacattcgcacactcatccttaactcatatcg

SEQ ID NO: 620140 - DNA, 632 bp, Homo sapiens
ctcttcaaaaaatttgcatgtctgctgtgaattttcatctagttccccaatcgatgctctcagggtcatctcggggatcacagggatccttaaatctccattctgtttgtggttgccccctcaacctcccctacaccttcctattctttttcattcttcttgcagttctgggagtaaagctcccagcatatttagataactagggcagggcgaagcaccctctttctttctagcactggcattatgctcacactgctcccttgccctgacactttcttgctaaacttctgtgcccttctgctgctagctacacttcagcacttacacgtaggcacgcaacagaactgtgctgcagctgctctctcctccactttgcctctacctggccctcatcccaacagcccagcaaggcggacgcagcagaaacagcaacttctctctcctatagcaacgacgctgccggccggccgatgcgcgtagcggactttatccaactctaagccctaaccccacttagtgacctcagtgctctccttccacttccttcttactgccctgctcctctcgccttgccacaggctacgcggaactagttccataccgcaggcaccacatgccacaaccacccacct

SEQ ID NO: 620141 - DNA, 393 bp, Homo sapiens
tccttcaacacgagcatatgtttacttgctctaattttggcaaatatattgaatgaaagacattgtaataccttagggaccatctggattgactgcctggattggttggcccaaagacacttattatccagagaatcagagtcagatgctggagcaatgatgaagtttacaaatggctttgagatgcccttaaacctgaggtctgtcaatgcaagtgcataaaaataaattgttacattttcactttaaaatacaggaattggaaagacaatgtcaagagaatgggatgacaagccacagaccaagagaaaatattgcaaaagacacttctaataaaggacctctgtccaaacatacaaataactcttaaaactccacaataagaaaatgaac

SEQ ID NO: 620142 - DNA, 107 bp, Homo sapiens
gtataggtagaggcgacaaacctaccgagcctggtgatagctggtgtccagatagatcttagtcaactttaaatttcccacagaacctctaatcccctgtaaattac

SEQ ID NO: 620143 - DNA, 686 bp, Homo sapiens
atggcagaagggaatgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttgggtagtatatatgcagtacacagataccttgaacaaggaagagctaataaatctcttctttgctgcagtcatctcactttttggtgtctaattgaacacaaaagatttttttttggaagcagtctattgctctggttacccaggctggatgtgcaagtgggtgtgatctcggatcacttgataacctctgtctcccaggtcccagcaattctcctgcctgcagcctccctagtagctggggatgacaggcgcctgccatcatgcctgactaatttgtgtattctgcacgtagagacggcgtcccaccatgtggccaggctggtctcaaaggtcctggacctcaggtgatcccgctacctcagtctcccaaagtgctgggattacaggcgtgatccacacaacctggccttgcaaacttctactttaagggtctgcagacgataagcccaatacactcccacaatcggaacatctgcaacatgaatccaagacaggcaatagtaccttcaatacttagaa

SEQ ID NO: 620144 - DNA, 422 bp, Homo sapiens
  misc_feature (65)..(65): n is a, c, g, or t
  misc_feature (79)..(79): n is a, c, g, or t
cgccccctaagcaggtgcactctgtcccctttgagaagagaccaagggatacaagtgctgggtcntggcgggttgcccntcctccctgcctgtgggggtctcattactgcctcctgcccccaccacaaacacccccttagagaggctttcggaggcaggtactgagccctggggccagggtgccaggagcccaatggcaggtcttgggtgactgctggccctggggcaatggtgagaaagccaggcaggcagctgcaggaaggagctgaggagaaaggcgcagagcctcaaaagctgctggcggccgggcacagtggctcacacctggaatcccagcactttgggaggccgaggcgggcggatcacgaggtcaggagatcgagaccatcctggctaacacggtgaaacccccgtctctacta

SEQ ID NO: 620145 - DNA, 126 bp, Homo sapiens
catcgtagtaatctgaggaggctccagtatataacgagtatatggagtgtcagcagcgggtgctcactgtagtcgacgggaacgttgtacagtgcagtgcatgcacctgcagtggtcgaatacact

SEQ ID NO: 620146 - DNA, 149 bp, Homo sapiens
gcatgcgcgtggggaccactgcagaagagctcaaaggcctggtagaatcgtgacacaagctactgtgactggattgcctctggatgtcgaaacacaaaaacaaaacagacagtccactgtatccacatgaactcaatgaggactgaaca

SEQ ID NO: 620147 - DNA, 247 bp, Homo sapiens
tgcgaccgcagcgctgaaacatggcgcggaagttcaggggctcgtacggagagaagggcatcaagctgcgggcgatgcggcacttgggaaagacgaagtgaggcctccggtggggcaggctgaagggcacgtagtgctaggtatcctggggctaccggctgaagaacctgccctgaaagagctcgtctatgatgctggacgcgcggctgtagtggtcctgcatgacatccagcgttgggacgatgcc

SEQ ID NO: 620148 - DNA, 113 bp, Homo sapiens
ggattgcttgtctgtttccgggttggggggaacacgttggttgggtgggaacgggagccaggttgggatggagggagtttacaggaccgcagacagggccaacgtcgaagccg

SEQ ID NO: 620149 - DNA, 253 bp, Homo sapiens
ccgcgcatagcggcattatgacggggtcagcgtaaggagtcagtcccctggacagtggacttcattgaaatgaacagaggtgagagtatctgaggaaaggggctgaaggtaagaggtcataggtcaagaaggggaggcagaagtgaggccagcccacctgggaggtagtggaggatacggagggcgagggcgaggccgggggggatagggggcaacaggggagattgagggcgttcacttaatgccgctagcg

SEQ ID NO: 620150 - DNA, 162 bp, Homo sapiens
agaggatcccactcgaggctgtatatactggctaccgacagcggtttcttcatcgacaacctcgcggtgctggctctggtctacgctgccgaccagcttgctgtatcactgtttacctgctagtctcgtttttcctgcaccatccctgcgatctacgaggag

SEQ ID NO: 620151 - DNA, 679 bp, Homo sapiens
ggcaccagaatgtgcctcagagctgtgacatttcaacatgatggttcggggttgggttgggtttgtgtcctttttattggcagttttttctgtggcaacagaaaagtggctgtggaagtctaaggtggtatgtaacaaattctttttaaaaattttaaacgcagtattcaagtattcttacctgtgtacaccttcactttaactgtttaccttctaatttctggtatcttggctgtctggtttatggcattttaaaaaaatctgaactattcatgtatggtaactgacatgatgttgatttctgaactgagacagataatggtatggctgtccaacaggggttggcaggggcatttgtagggtcgtataattctagagttcgaaaggggtaatataaaaatgtgctcgtgtgttagccatacgtttttctcaatgcctccattaccagtgtgcaattgtgtatctagagactccaaagctgtgttttaaaaacaaaagaaaaaaccttttctctaataatctcagaaatataaatacttgtcattttcactacttaaggaattcattatacctttttagaacacactggtggaacatttataccgtattaacatgtagctataactatttttaattcccaaggtgttgcagcttcccctttaaatattcctaatattcg

SEQ ID NO: 620152 - DNA, 479 bp, Homo sapiens
tgatgaggtatattttttaaaactcattacagtcatattaaaaagataaaccaattataaagtaggtaaaggatctgaacagacattctccaaagaagatacataatgactaataagtatatgaaaagatgttgaaaatcatcaaccatcagggaaatgtaaatcaaaaccacaatgagataaacacttcacattacagatgaatataataaaaaagacagacaataacaactgttgatgaggatgtggataaactggaattctcatacactgctggttggaatgtaaaataatgtacccacttcagaacagtctgacagttcctgaaaaggttaaacagcattaccatctgacgcagcaattctgctcctaggtatatatccgagaaatatgaagataaatgtctaccaaaaaattgtacaagaatgttcataacagaattattgataatactcaaaaagtagaagcaactcaatctg

SEQ ID NO: 620153 - DNA, 369 bp, Homo sapiens
acgtgactgtaatcccagctactcgggaggccggggcaggagaatcgcttgaacccgggaggcggaggttgcagtgagccgacattgcaccaatgcactccagcctgggggacagaggctgccccactgcagccttgacttaccgggttcgggtggttctccacctcggccttgccactagctgggactgcaggcacgtggaaccaccctggctaatttttgtagtttttgtagacgggattttgccatgttgcccaggctggtctcgaactcctgggctcaggtgatccgcccgcctcagtctcccaaagtgctaggattacaggtgtgagtcactgcactcggctaatagtaatgaactttgaacag

SEQ ID NO: 620154 - DNA, 173 bp, Homo sapiens
agtgctactccacaaacagtctgagagagggtatccctgtcttgtgccagttttcaaagggaatgcttccagtttttgcccattcagtatgatattggctgggggtttgtcataagtagctcttattattttgagatatgttccatcaatacctgtttgtggaggtagcacgt

SEQ ID NO: 620155 - DNA, 461 bp, Homo sapiens
tccgtaccaaaatgttaagagtgagtgtctcggccgggcgcagtggctcatgcctgtaatcccggcactttgggaggctgatgcgggcggatcacggggtcaagagtttgagatcagccggccaacatagtgaaaccccgtctctactaaaaatacaaaaattagccgggcatggtgatgcatgcctgtagtcccagccacttgggaggcttagggaggagaatcacttgaacccgggaggcagaggttgtggtgagctgagatcgtgccactgcccttcagcctgggcaacagagcaggactctgtctcaaaaaaaaaaaggagggggtgtctctgggcattgaaacatggattcccaaaaattccccaaaaattgattttttttcctttaatttccgaattttgggaggtttcccccatggactattgtggtggccctggaaatttttgtctccccttc

SEQ ID NO: 620156 - DNA, 229 bp, Homo sapiens
tggcacacctatgggaattgggggtgggggggtattccctctaatttctatgaggggggtgtggcactttctcttcttgtagccacagatcttggagctggtgcacatcatcaatgctgccttccccccacattcatttcctacctctcctaaccttgtaagtcatgttaggttcttatctgctagagtagggagcaaacttaacttactggtggccttattggatatg

SEQ ID NO: 620157 - DNA, 306 bp, Homo sapiens
ggcacgagcgccagtactgggattacaggcatgcaccaccacacctggctagtttttgtattttttgtagagacggggtttcaccatgttagccaggatggtcttgatctcctgacctcgtgatccgcccacctcagcctcccaaggtgctgggattacaggtgtgagccaccatgaccggtcctacagcttctttttttaaacctcatgaaccagctctgctcacaagcttctggaaataaccccatggccaggcttttgctgtactttgagaatggctagagatggggtctgagtgtctctgag

SEQ ID NO: 620158 - DNA, 556 bp, Homo sapiens
  misc_feature (20)..(20): n is a, c, g, or t
  misc_feature (221)..(221): n is a, c, g, or t
gagctggagcgggaggagtncgggatcttggtcggttgcacaacggccgcttgcgtgcgcgtcccgaagggcttcaccttcagttggtttgacggctaccgcctggacataacccgcatggcctgcgttgacatcaacgagtgtgatgaggccaaggctgcctccccgctgtgggttaacgcgcgttgcctcaacacggatgggtccttccgctggatttnccggccgggatttgcacccccgccccagccgcccccctgtgggcccgcaggggcccgggcctgagccttggcacccgttggccggccatccggggccgcccctcggggccccttcggggaatcctacagcccgcttttgggtatgtgcccggggccgcccgcctggccctggaaaaggggcctccggacgcttggggggtggggggccctgcactggtgccgcctcccccaggccctcccccttatgttggggtcccgggccgggcccaggggccccttttcaagccctttcccttttaaaaaattttccattaaaaaccccctattttttatca

SEQ ID NO: 620159 - DNA, 921 bp, Homo sapiens
  misc_feature (36)..(36): n is a, c, g, or t
ggtcaagatggcgctggtggcttctgtgcgagtccnggcgcgcgttctgctccgcgcgggggcccggctcccgggcgcggccctcgggcggacggagcggggcggcggcggcggagacggcgcgcggcgcttcgggagccagcgggtgctggtggagccggacgcgggcgcaggggtcgctgtgatgaaattcaagaaccccccagtgaactagcctgagccgtggagtttctgtagcgggagctggtcagtcagcctggagaagctggagaatgacaggagcttccgtggtgtcattctgagcctcggaccgctcgggtgtcttctcgggcggccgtggacctgacggagcatgtgtgggatggagccccggccactacgctgggtactggagagggcgttcaggagctgtggctgcggttgtagccagtccaacctgggtgctggtctcccgccatcaacggagcctgccccggtggaaggctgtctggtggccctgacctgtgactaccgcatactggtggacaatcccaggtactgtagttgggactcaattgagacccagttgggcatcatcgccctttctggttgaaagacacccctggagaacaccatcggagaacgggcggcggagcgttgcctgcaagtggggctgctctatcccgcggggggagggccctgcatgttgcgcatagtggaccacgtggtccccggaagaagcagcgtgcagagcactgagtgtcaaccgatagccaagggagggcatccagaacatgtccaaaggtgaccaggccttgagtggaagggcctgcagccgctggtcacacacgcggaagggagtggcaaatgggggatccccaagacccccaaagcctcagagttaagaggcagaaaaagtcaaggggcacgttaccaagcctg

SEQ ID NO: 620160 - DNA, 109 bp, Homo sapiens
agtgtccgactgtctgctagaccagccacttagctgtcccacatgtcctaagctggacacatcttcttcaccaaactggcttccacctccagaccttcccagctttatc

SEQ ID NO: 620161 - DNA, 85 bp, Homo sapiens
cgttcccaagtctctaactttttctgaagagaaacgtcaagagaagattcagactctttcatggtctcccttctgtcgtcttctc

SEQ ID NO: 620162 - DNA, 457 bp, Homo sapiens
  misc_feature (15)..(15): n is a, c, g, or t
  misc_feature (94)..(95): n is a, c, g, or t
  misc_feature (100)..(100): n is a, c, g, or t
  misc_feature (102)..(102): n is a, c, g, or t
  misc_feature (122)..(122): n is a, c, g, or t
  misc_feature (127)..(127): n is a, c, g, or t
  misc_feature (131)..(131): n is a, c, g, or t
  misc_feature (134)..(134): n is a, c, g, or t
  misc_feature (139)..(139): n is a, c, g, or t
  misc_feature (143)..(143): n is a, c, g, or t
  misc_feature (154)..(155): n is a, c, g, or t
  misc_feature (160)..(160): n is a, c, g, or t
  misc_feature (163)..(163): n is a, c, g, or t
  misc_feature (167)..(167): n is a, c, g, or t
  misc_feature (169)..(169): n is a, c, g, or t
  misc_feature (172)..(172): n is a, c, g, or t
  misc_feature (177)..(179): n is a, c, g, or t
  misc_feature (184)..(184): n is a, c, g, or t
  misc_feature (188)..(189): n is a, c, g, or t
  misc_feature (195)..(195): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (215)..(215): n is a, c, g, or t
  misc_feature (249)..(249): n is a, c, g, or t
  misc_feature (260)..(260): n is a, c, g, or t
  misc_feature (274)..(274): n is a, c, g, or t
  misc_feature (276)..(276): n is a, c, g, or t
  misc_feature (278)..(280): n is a, c, g, or t
  misc_feature (283)..(284): n is a, c, g, or t
  misc_feature (287)..(288): n is a, c, g, or t
  misc_feature (297)..(297): n is a, c, g, or t
  misc_feature (306)..(306): n is a, c, g, or t
  misc_feature (312)..(312): n is a, c, g, or t
  misc_feature (314)..(315): n is a, c, g, or t
  misc_feature (317)..(318): n is a, c, g, or t
  misc_feature (321)..(321): n is a, c, g, or t
  misc_feature (325)..(325): n is a, c, g, or t
  misc_feature (327)..(327): n is a, c, g, or t
  misc_feature (330)..(330): n is a, c, g, or t
  misc_feature (332)..(334): n is a, c, g, or t
  misc_feature (341)..(345): n is a, c, g, or t
  misc_feature (350)..(352): n is a, c, g, or t
  misc_feature (358)..(358): n is a, c, g, or t
  misc_feature (363)..(366): n is a, c, g, or t
  misc_feature (371)..(372): n is a, c, g, or t
  misc_feature (378)..(378): n is a, c, g, or t
  misc_feature (381)..(381): n is a, c, g, or t
  misc_feature (383)..(383): n is a, c, g, or t
  misc_feature (386)..(386): n is a, c, g, or t
  misc_feature (398)..(398): n is a, c, g, or t
  misc_feature (416)..(416): n is a, c, g, or t
  misc_feature (431)..(431): n is a, c, g, or t
  misc_feature (455)..(455): n is a, c, g, or t
tatactttgcaaganggggaaaaataaaattaaaaaaattcttttcttttcttttttaatataaaacaatataatcacaataccagaatatggnnctctncngctttatttcctatgggttnctgcnggtntcnctttncgcncgactgtgccnnttccnccntttntnccntggannnctctncccnncccttnttcttcncntncntcnatcngcgattgcgtcactttgctcgctgtcctttgctnccttgcctctncccccttttttccntncnnntcnntcnntcttttttncttggctgnttctcngnntnnttnttcntncgntnnntgtcggnnnnngccgnnntgcccnggccnnnnttttnnttcttntcntnttntggcttttttcncttttcttttgccctctnccctttttttgcttntctgcttccttggattttggcttntt

SEQ ID NO: 620163 - DNA, 347 bp, Homo sapiens
tgctttattttttatttagttcctcattcattcttccccacacaaaacttccccagcgtggcctcaacccattctaccttctcactggtacggggctgaacggtgcccccccaaaaatttacatgttgaagccctaatcctcaagacctcataatgtggctgtttggggaaagggggtctttaaaggagtgactagattaacattaggtctggtgtagtcagcctgactgtgcctaatccatcaggactggctgtccctgtaagaagaggagactaggccactcttccccccaaggcaagatggcttcagtacacagggagaagggggcatctacaaaccaaggagg

SEQ ID NO: 620164 - DNA, 152 bp, Homo sapiens
gatggcagagaggcgaacgggtgagtacatatctcggaacataaccagtcagtgggggatcactaatacgaaaggatagctaataccgcatacgatctgtggatgacagcaggagatcttcagagaaccttgtgctattgaaatggccgata

SEQ ID NO: 620165 - DNA, 152 bp, Homo sapiens
attcttttctccctggtggctggtggctagtagctggaggcggcggtcctctcccccgggtagcaggcagatgactttggcacggggtggtgtggcgggtgctggggttactccgtctgtgcgtcgtaactggctccccccgcttaaactcg

SEQ ID NO: 620166 - DNA, 1075 bp, Homo sapiens
gctgttccccctctaacctatgtctaaggaattcgacataatttgggctggttgcggtaactcatgcctgttaatcccaacacgttcgggagtgctgaaggacaagtgtgactcatctgaggtcgatggagatctgatgaccatcctggcataacagcgggtgaaatccttcgtgctccagcataaaaatagccaatcagaaaatagctgggcactggtgtcatgcgcctgtaatcccctgtagtcccagtctatctcgggaggctaacggcacggagaactccgttgtgaacctcgggaggcagacgcgttgcagtgatggcccgagatccatgtcactgcattccaagcctggagcagacagaggatgactctgtctcagagatagaaataaggagaatagatgaattttcagctttttgcacaaagttcatgctttgttgttactgtcagccctgtgaagctgtttggacaccaacatagggacattgacgagacacttcgtctaaattgttgaaccgacgatccatcagcttcacgttctggaatgtggatccactgtccaggtggttcagatgcttactttggttgaggctcttatgtccagggagacacaggtgcgtccatcactgtggcttcgcccagtcgtgtggagtcccagtggggtgcaatgatggcctccattactctaccctcgaactggctgggcttgagccaatcgggtccacctgtaaggctcctgagataccttagcgacgtgggcaggctgggggcaccagtcagtggccgtaggcgtaaatgggttaccactccccttatctgatagagtcgtcccggagcatatttcctcgaactctattgtcacccactaatttcctggtccttggactcccatggcaggtcataagcgaatattatcccttacattttcagcaagcgtcgagcggacctttttccgaacccaggcatttggggccacggcctattatgccccgcaacatttgggaagcttaaggttgggcaagatccctttaaggtcaaggaattccccccccgccgcggtagcctagtgaac

SEQ ID NO: 620167 - DNA, 335 bp, Homo sapiens
gttcgagcctgggagaaagtgagagcttctcaaaaaaaagtattaggggcctgggtgcatgtggctcacacctgtaatcccagcactttgagaggccgatggcgggcaaatcacctaaggtcaggagttccagaccagcctgttcaacacagtgaaaccccatctcttctaaaaatacaaaaattagccaggtgaggtggcgcatgtctgtaatcccagctgctcaggagtctgaggcaggagaatcacctgaacccaggaagcacacagattacagtgagctgaggtcgcaccactgtactccagcctgggcaacaagagggaaactctgtttc

SEQ ID NO: 620168 - DNA, 408 bp, Homo sapiens
  misc_feature (11)..(11): n is a, c, g, or t
  misc_feature (40)..(40): n is a, c, g, or t
aggcactcggntttcaaccacttatccaaggaatcctcancagcagcccctctttaagaggtaagcactaaggccctaaacatgaggttagagacactattaaaaagcatgttctaggcagggtgcggtggctcaggccagcaatcccagcactttgggagacctaggtgggcagatcacttgagatcaggagttcaagaccagcctggccaatatgtcgaaaccctgtctctactaaaaatacaaaaaaattagctgggtgtggcagcatgcacctatagtcccagctactagggaggctgaggcaggagaatcacttgaacccgggaggcagaggttacagtgagccaagatcgccactgcattctagcctgggcaacaagagtgaaactccatctcaaaaaaaaa

SEQ ID NO: 620169 - DNA, 274 bp, Homo sapiens
aagtcgccttggtcggccgccgagttgtcatcgttacgtggtttgcttccttcccgtccggtcgcagcactgatagccgacgcattcgcaaccgcgatctgtgcccaggccgttggtccgattgaggatttcctggaccggatcgaccttcgaagagtcgatcgcgatcgcgccgagcttggtggccaatgcgagccgatcggcatggctgtcgaccacgaagatctcggatgcgcccttgatcgccgccgaatgtcgccgccatcagcccaac

SEQ ID NO: 620170 - DNA, 575 bp, Homo sapiens
ggctaatcttgaactctcaggctcaagcaatcctgcagactgtgccccccaaagtgttgggattacaagcgtgagccacaaaaacagaaagtaccagaaagcacagaacctcaggttgtcacatttctagtggtgctaagatggatcagtaggtttatggggtgtcaacctgatcctgccattatagggttgcctatcaaccattcaccttatgggtttagcattcattggtgatgattacacggattattatttcagtgatgctcaaactttagcattcatcagaatcacctggaggactagcaacttagaatgttggaccccacccccaggaatttggatttctaacaaggttttaattagtgctaatgttgttagtgtaaggaccacactctgagaaccacaatatgatatcattagaggttgctaatgatttgataggttgcatttcttctgagataagttttttcagtgaagatagtgtatatgtgttatataccagatttctggtgagatatccttttggtttttaggatttgattcagactgttgcagtcatgattgtgtttgtgtct

SEQ ID NO: 620171 - DNA, 202 bp, Homo sapiens
cccccccgaaggggccgggggctggtgtggggggggccccccccccgcgggggggttttttaaccccccttttttggggggggttgcaaaggtttccccggccccggggccccccctgggggttttttggggggttgccccccccgggggtttcccgtttttttttttttggggaaaattttttttttttttttttttttta

SEQ ID NO: 620172 - DNA, 955 bp, Homo sapiens
  misc_feature (1)..(1): n is a, c, g, or t
  misc_feature (324)..(324): n is a, c, g, or t
ngagaggaacgagagacagacagaacacgaagcttcccgaagtgcgcctatctaccgagcaaatcgcccgccgtggaatctggcgggtgttcgaccacactggcgccgttgaattacgccgccgtcgttaacaatgctgaccgccgcgcatcacacggggtgcgcgccccccgccagagccgttgtggaacacaaggggtgaaacccgccaaaaatggggggagaacccacccccactgggtgtggaacccgtccagaaaaaaagggaacaaaccccacacagcaactaaggggggagaacacgcccccccccacagcaggggncgttcaacaccacataacagcccgggcggggaggattaagcaaaacaatttgtttgcagcgcggggaccaagttatcaagagttgtaaaaattccgctccagcctgttccgtaaattgtcccacggcccgtccagatcccctccgtgggattactaaacaggggaacgcccataaatttggggatatgtgttaacgagggatcttacacacccagtatgctgtgggcgcgcagtctacgtttctcccgaaaattccactgcgcgcactgggaacaaacaacagaggaccctctgcacagttctaaaaaaatattcttgaacgccccacacatcttactccccgttattagttacggctaaccattagaataattgctccttatttcactgaaacacaaagtacatcccgatatccaacaccagggtcccgcaggtctatgatataacaagacccctcttggtatatttcctctaaaaacacataaaaaatgtataaaaaaaatgcactggacacactcaagccattattataatacattgccccactaaccacaatatgccgcacattaaagttttggaggaaatacccccggccctcatgagccccaaaaaccccaacgcccacaaaaca

SEQ ID NO: 620173 - DNA, 184 bp, Homo sapiens
  misc_feature (23)..(23): n is a, c, g, or t
  misc_feature (146)..(146): n is a, c, g, or t
  misc_feature (160)..(160): n is a, c, g, or t
tgtggcgcgcgcaagaggcgtgnggcggcaatgtagggcattggatccgaagtgcgagcgccatggtggctcctcctgtttttcagaagtggcggctcagcattggtttcgtttttggaagctttattggaagctggtataagganggccgcagacgatncgaacaagacggcctcccggggtc

SEQ ID NO: 620174 - DNA, 279 bp, Homo sapiens
  misc_feature (147)..(147): n is a, c, g, or t
agagtctttctccttaaaaatatggtggcaggagtgctaacaggtatcatttcttgatcaggaacaagaaactccttcaggaaactcaatttcctgggttcctggttaaccttatcatgtaaattctttttatttggtacacctgtntactaattataattgattgctacttatgccaagggagcatttcccaggcatgcctcatctatttactaacaacaaagtatgcttactttatttacatagtgccacgggtttctcttttttcttctctttttt

SEQ ID NO: 620175 - DNA, 736 bp, Homo sapiens
  misc_feature (337)..(337): n is a, c, g, or t
  misc_feature (345)..(345): n is a, c, g, or t
  misc_feature (373)..(373): n is a, c, g, or t
  misc_feature (376)..(377): n is a, c, g, or t
  misc_feature (408)..(408): n is a, c, g, or t
  misc_feature (418)..(418): n is a, c, g, or t
  misc_feature (438)..(438): n is a, c, g, or t
  misc_feature (464)..(464): n is a, c, g, or t
gatccagtgtcctggtatcaggcctgcggggcctgggcgtggagatcgctaagaacatcatccttggtggggtcaaggctgttaccctacatgaccatggcactgcccagtgggctgatctttcctcccagttctacctgcgggaggaggacatcggtaaaaaccgggccgaggtatcacagccccgcctcgctgagctcaacagctatgtgcctgtcactgcctacagctggacccctcgttgaggacttccttagtggtttccaggtggtggtgctcaccagaatccccctggaggaccagctgcgagatgggtgacgttcatgtcacacaccgntggcatcnagctggtggtggcagacacgcggggccngtnngggcagctcttctgtgacttcggagagaaantgatcctcanagattccaatggggagcagncactcagtgctatggtttctatggtnaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcagtggcagaacctgactt

SEQ ID NO: 620176 - DNA, 325 bp, Homo sapiens
aaaggacgctatcagtcgaaccggtatcgaatcggtactagaactcatggcgggtgtgaacgtgagagattggataccgttccagccattgtttatgtgacgcgcttcacccttgagccggcgtttgatcgtggctggagtacaggccgcggtacccgaggacaatgcattgtaccgaccatgttctttttgcgagccctgtgatcgctgtgtagcgtgacgagggttcacggcccctgtttaaaataggtgcattaatggcaccaacgagaaatttaatgaccgatgttgtgagttatccaaaaggcgacacgcgggttaactt

SEQ ID NO: 620177 - DNA, 207 bp, Homo sapiens
  misc_feature (170)..(170): n is a, c, g, or t
gtagcaataggctataacatataccgaggtataggctacactagctaggttcgtgtaagtacactctatattagcacaacgataaaattaactagtgatgcatttttcagaatgcatccccatcgttaagtgacacatgactgtccctcagtatcactggaggactgggnccaggacctgacctggtggtaccaaaatccatgagcg

SEQ ID NO: 620178 - DNA, 125 bp, Homo sapiens
gcgcggtgcgcggtggggtctcatcccccgcctggtctttctcctgcaatacggtctttgcttgtatgaacccatttttaggcccagtctccagcagtggccccttttgtttacggcttgcttgt

SEQ ID NO: 620179 - DNA, 169 bp, Homo sapiens
  misc_feature (109)..(109): n is a, c, g, or t
tgatagctaggtggagtaaaaaaaaaaaaggttttaaatggagtcaaatttataacaaaaacttagggtgtaatcaaaggcaaatacatacctcaggcatgccagcggnaggcaaaataatggttaatagaaggttattaaaaaataaaagtttttctggaatgatata

SEQ ID NO: 620180 - DNA, 247 bp, Homo sapiens
tcgctaaccaggcaccgcagtgctatttacagacctgcagggctccctcaaacgaaactatttctggcataatatgtctgacttcttttgaggtcgcacgactaggctaatgccatttacgatctgtaaaagctgtttgaagagtccaaggccccatgttaacacgatttctggatcctgtaacagtatgttacgtgctccacaggctgagcttctggaggctcaccgcctcagcaggttgtaaaca

SEQ ID NO: 620181 - DNA, 336 bp, Homo sapiens
atcagaacataggctctgcagaacaagcccaagaaggcggccacgactacatgtgacatcgataaagttgatgagttcatgcaggcccttgctgaccagaaagagcttggggaggagatttcaacagccaattcgaaaacctgtagggttcggagacacgtctgacgaggatgagctcatggcggaatacgaagcactcgaacaggaggaaccaaacaagaatatgctggaagtcagtggccccgacaacagtcactctccccaatgttccctctatagccctaccatcacaacctgacaagaagaggaagacgacgacatgaacgctttggagaa

SEQ ID NO: 620182 - DNA, 388 bp, Homo sapiens
  misc_feature (141)..(141): n is a, c, g, or t
catgatgttcagtggccagcgtctccagtgcttctgacaagattttgtttttttcttgctctcgttccaatttaaaattcctcacctgggccagatccgaggactcccggtgggcgctccaccctgcgctcctcgcaagcntccacggaatgcgctcggcctgctcctccgcctcccccctagtcgagccgaggcgagccgatccgggaggcgcgactcagggcggcccgcaaggtctccctaagtcacctttcggcagtcctcccctggctccggccgggcagcagcgccagccttccccagcgaggtcgggcatgagcgttgtcccgcctacggcccagagacattcccgctgccgtcccgcccgggtcccagaggtctggctgcc

SEQ ID NO: 620183 - DNA, 134 bp, Homo sapiens
aaactaggctcctatgccccctgatctgattaccttcacggaagggaagcggatctaaccacgctatgccctctggttctgtagtcgggggagtcatggccccgggaccagccgctggaccaagaggctcgtga

SEQ ID NO: 620184 - DNA, 200 bp, Homo sapiens
agacctttgttagatgaaggggtaggcaccagattggtctggaatctgtcaagtcaacattcaggactccatcaatatctcacggaagcagtgatggaagacacaatctggactaataaggcggttaaggttagtgtacgttgagcgctcaatatcgaggtttctacgacagatgtcatagatggcctcatcctaccaaa

SEQ ID NO: 620185 - DNA, 750 bp, Homo sapiens
  misc_feature (516)..(516): n is a, c, g, or t
cgaagaacaatgtgttctccagcgggcaacacccgccggagtaaagactgtggtggcaagaaagccacacctgtggggtgaaaaacgcagtgctccccccccgcgcggtgtagtggggaaacacactgttccccacacagagcagtttggcgcgacctatacacagccgtgtggctgcacaaaaatgagggttctcctcgccccccccccccggcttgtcgcctaagtagtgggtgtgctttctcgctccgcttcggcaggcaccgccgttgcaagacaccactttgggcgcacaacggataaacatggggaaaccgaattgctgttcaatgggcgcccaaagtctctttttcctgaagcggttgggtcctttacggttagggagcatggtataggttgcccgcctctcctcggtcaccagatggaagaagggcttgcttctcacataatagatgatgagagacgcgactcgcatacattctctcatactagcgcccgctcgcgactagtaggttntctcacctcgccgcttctgttcgatctatcgccgcctttagacggcttttcgccggcggcccactttctgtaactacgcccggttcctcccttatttcaaacagcttacgtccccgcgtatctaatgaattacgccgcggcgcatattgtcttccaattatggagaattatttctatcgccctatcttccccaataaaaggcgacccaactggaagatcaataacaaacaaact

SEQ ID NO: 620186 - DNA, 280 bp, Homo sapiens
tgaggaccccgtcaaccctacactgaacatcttcaaagcacatcgtatgtacaagagatagactaagaaacaagaatgtgttgacggagatccaaacttcagtgagtgatagtgcctctcacacagtcttccgactgtgtactcaggtaggagccacttcataatcgctgctactggcctatgttgcggaatactttgccaggtacttcctgaaatcgtgtagaaatcgaacgttcacatgtctacatctgaaaataccatcataactatgtaactttga

SEQ ID NO: 620187 - DNA, 227 bp, Homo sapiens
tgtataggaatagccacattgatagtgctacactcgctcctctccgccaatatttttataagatagtagttggttcttctatagggtgccgttgtaagttgaatatatgcctatctagttccgtcaacaccaggcggcattgcttaacctcccttctgtgtatgataattaaagtataggcttcttcctttcacctctgtttcctcctccttctcatgtcatacata

SEQ ID NO: 620188 - DNA, 540 bp, Homo sapiens
  misc_feature (47)..(47): n is a, c, g, or t
  misc_feature (116)..(116): n is a, c, g, or t
  misc_feature (186)..(186): n is a, c, g, or t
  misc_feature (233)..(233): n is a, c, g, or t
  misc_feature (235)..(235): n is a, c, g, or t
  misc_feature (243)..(243): n is a, c, g, or t
  misc_feature (245)..(245): n is a, c, g, or t
  misc_feature (262)..(262): n is a, c, g, or t
  misc_feature (265)..(265): n is a, c, g, or t
  misc_feature (286)..(286): n is a, c, g, or t
  misc_feature (303)..(303): n is a, c, g, or t
  misc_feature (350)..(350): n is a, c, g, or t
  misc_feature (375)..(375): n is a, c, g, or t
  misc_feature (438)..(438): n is a, c, g, or t
  misc_feature (478)..(478): n is a, c, g, or t
aaagctttattgagactgaacaaaggctgaatacagagatccaagcnatgaggagtacataaggggtggggcctataagccaggctcggaaactttccagaaaaacctagaaagcnctactaggaggaagtaaacgacctaatgtataaataagatcccagcatggacaagggcatgaatatagcngtatggggacacgtggctatatatagaaggaaataactgtatagctntngcaatgtngnctgtactcccctaaacnctnaaccaaaggttccaggcccanaagaaaaggccactagnaatccatgcaaaaagggtaaaagcaggacaatacccagccttccatnaaataaaaacattatctataaactnactgcttaaaaaaaatgtataaaccaacaaacctaaaaactgcaaaaaagtatggaaaagtanaaatatagtaaaaaataaaattccaagaaacccataaaanaataaactaatgaactaaagtactaactaatctataaaactttctaagaaaaggcataagta

SEQ ID NO: 620189 - DNA, 1988 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctggaggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 620190 - DNA, 1913 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctggaggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 620191 - DNA, 699 bp, Homo sapiens
taagctgattacatatagaggtttattttatgatctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttaccttttgttatttttgttaatttgttttataaatgtttcaagagttatagcaaattgatttctaattttatgctattacaactgatgtaaatggtagttcagttttgtgagattaaaaaaataaagcacttattctgaatttttttgaatcgattttcaattcattttcatttagaatatagttgaaaaagctgtaatatcagttttgctagtacaaagaccttttttctggtgtgcaatgacgtttcacttataaagcttacctccactttattgagcactacataatttacagatatgcgtcgtatgggcaacaaagcaagtggttcccatatgctaaattaattgtatttccttttgagcagattgatatctgtgtccttataaaattcatactattggaaactacctacttactctttggatggactgggctgtcaatctgtaaaaataggttccatccaagtttattcctcatgaattacggtaacaa

SEQ ID NO: 620192 - DNA, 227 bp, Homo sapiens
gatgggcgttcagaggatccccgcgtaatccgtaccacacacacctgggaagggcgtggacagaaatggaagattcccacacattagtgaccgtcgatgggtgaatggtgggacacctctcggagccactaatgaagccgcctggagagacgaagtgcctgggagttggtgcgagcacttttggccccaagtgagctgcggacaggtgctgggtgatgctggcagaa

SEQ ID NO: 620193 - DNA, 221 bp, Homo sapiens
  misc_feature (30)..(30): n is a, c, g, or t
  misc_feature (32)..(33): n is a, c, g, or t
  misc_feature (36)..(36): n is a, c, g, or t
  misc_feature (39)..(39): n is a, c, g, or t
  misc_feature (41)..(42): n is a, c, g, or t
  misc_feature (50)..(50): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (68)..(68): n is a, c, g, or t
  misc_feature (150)..(151): n is a, c, g, or t
  misc_feature (153)..(153): n is a, c, g, or t
  misc_feature (155)..(155): n is a, c, g, or t
  misc_feature (157)..(158): n is a, c, g, or t
cagtactggtgcctgagctgtccccttctncnngtnccncnnctgcttcntgcttctgccncntnctncttctgcttcctgcttctgccgtctacggccataccaccctgaacgcgcccgatctcgtctgatctcggaagctaagcaggnntntnannactcactaggtgaactgctgttgacgaaaaatattgccatcattgtggggcagaagcaggaag

SEQ ID NO: 620194 - DNA, 1563 bp, Homo sapiens
gtctgacttggtgggagagtttgcgctggcgggcactctgtggtgggtaaagtgttcgttagtcgccggactttttggggttgggcagattccctcggtgttgtctggtaggtgagtggtgttcgggtgtttgtctcgtgtggcgaaccatgcggctcccacgacggcacgggtgggtggctttgagtcggggggacgaccgaggtttggtgtcggcagtgttggagagagcacctttcgtggcggcccgcggtggcgcgccttctctttgagttgttgtaggtggtttcctacagctgttgaagggcgcgcggctatctggtgctgccgcgtggtttgtcccccgcgattttataggtggcttcccgcagagattgtggacaccagtcaggcgctttgttgtcgatcagtaagagaccggctcgatgtgtccgcctttgctgggttttgtgtgtcccgttgtctccgttttgggtcttctcccacacgtgtggggcgggtaatatccccctcgagaagttgtgagcgtgttttcacccttgtctgaggtttctcgcctgttcgaccgtctgggggtgttggagggtgagctgcctcgccttggcaagtcccagcggacgaaatgtttgtgggggggggggcttatataactaacccctgacccgccgttttgatcaccctgctcgatcgtcgtcccagtttaaggaacagagtttaggatatgcacacatctgtatgggtggaagatattaattaggtgtagattcctctagagtttatagttgtcttcatatagcggggctttgctgatattaggagacctccgttcaccgggagccatatgttaccctcgaatgtaatgctctgagagctaggagctttttgtgcgaggaactccacagctttattatgggagttttattttggtggttgcgtccgctatgagctttgtgtgattcctcggggagcgccacactgtggagccacatggcccgcccctttcacgagaccctcttatacgctcgtgtaagtataggcacgttgggctggtatacgccaccacccagcagcccacgtgagcccacgagtgagttacccggctctgtttagggctccacagcctggggccctcgagcgcgtattgtgctgtcccaggagaagtgagactcgaggcccgtatagccggtaactccacgcccacgagcccacagaccgcgaagaagggaaagagagtaccaccacgctctttctggaaagtctataaggcactttcttggttggtatgagaaaagtggtgcccacacaagcctttcactggaacgcagagttattatggttcttatagagttatgtctctcttcttgttctggagttccactaacttgcgctataatataccctgagtatatatacctcggtttttccacatgtatactcgccttctatggagaagaacaaatgtacctgttcacatgctgagcaccacgatatttccgtctgcctggttaaagttttataatcttactaccaaaataatataactgggctggtttataatgggta

SEQ ID NO: 620195 - DNA, 321 bp, Homo sapiens
  misc_feature (250)..(251): n is a, c, g, or t
  misc_feature (253)..(253): n is a, c, g, or t
  misc_feature (255)..(255): n is a, c, g, or t
  misc_feature (257)..(258): n is a, c, g, or t
cttcctgcttctgcctcagggtctttgctcctgacttcctgctgtgaactacttttcctctaactctgcttcctgcttctgccatcagctgtggtttattcaaactgcttcctgcttctgccaaatggctgcttcctgcttctgcctgcaaaatggctgcttcctgcttctctgcttcctgcttctgccgtctacggccataccaccctgaacgcgcccgatctcgtctgatctcggaagctaagcaggnntntnannactcactaggtgaactgctgttgacgaaaaatattgccatcattgtggggcagaagcaggaag

SEQ ID NO: 620196 - DNA, 301 bp, Homo sapiens
  misc_feature (230)..(231): n is a, c, g, or t
  misc_feature (233)..(233): n is a, c, g, or t
  misc_feature (235)..(235): n is a, c, g, or t
  misc_feature (237)..(238): n is a, c, g, or t
tgtgtttgccagttctctctgccaggaatgcagcttcaccttctcaaagtcttcccaggcagccctactgctgaccacttccctccccatctgcactccctgttccctctctactttatatttttgcagatcacatcaaccattctcccctctgcttcctgcttctgccgtctacggccataccaccctgaacgcgcccgatctcgtctgatctcggaagctaagcaggnntntnannactcactaggtgaactgctgttgacgaaaaatattgccatcattgtggggcagaagcaggaag

SEQ ID NO: 620197 - DNA, 1058 bp, Homo sapiens
  misc_feature (85)..(86): n is a, c, g, or t
  misc_feature (139)..(139): n is a, c, g, or t
  misc_feature (171)..(171): n is a, c, g, or t
  misc_feature (509)..(509): n is a, c, g, or t
tggggattttgaatctcgccgcaggactgcacgccgtgaaggtgtcgactcacctcagcacagggcatttggagcttcttcctgnnccccggttcggcggtggcccgggctgcaaagagcaagcggtggccacgctggnggaggcggagaaacggcgccctgcacccggcnctcgggggaggctcgcttaagagaaccaggcagacggcgactaacccacagaaacatcgctgcggcgcgttgggtgggcccaacaggttaacttttttgtggggagaatcccttcgacaaggcccaagggggagaccccctggcagaatcaaccgttgaaggcgcacaaggccctctggttttggcttccctgaggagactccatcatagcggcggccaagaccaggggagcttggtttcccacttaacctcggaaggggaggaatgcctggaggaccacaggggcttgagagggcttccttggccgcccatgtggagggctctataaaccaaatttngtggccaacctcaagaggaggttcccagaaccacctctgcagggaggcagttaagggacaaactaacagggtctccgggagttgggtaacggcttccagagaagggaccgccctggagttgggggacacattcaaagctccaagggacgtgctaccccttctgggccttctggagacgggttccaccagacaggtattgagaaatcctcgtcggacagctttgcgtgtgaaaaacacagggtccacaaacagcccgtgaaacaattaaacaaggtcaacaggggtgccggactaaattagtggagaatgcacagaggacgttccatcaattatggctcgaacacagaagatgacccagacttcggggtgccgagcgcgccacagtggacgccggaaggggcgaccaggggcggtcataccgggggcggaggggccccaggagaccgcccgaagttccctcaaggggcccatgagacgcgccacagcgaggggggacctggggaacccaacacggaggagtagatggcccgacgggggggcgccccacaa

SEQ ID NO: 620198 - DNA, 157 bp, Homo sapiens
gctcttgcactcaccagtagactctgtcgcctcttcttctggcggtactagtgctttcttcacctttattttgctgtaccatcttctctccggaggatcgtaaggttgggacgggcagaccacgagaacacctgagatggaggtctattggagagcc

SEQ ID NO: 620199 - DNA, 215 bp, Homo sapiens
  misc_feature (10)..(10): n is a, c, g, or t
  misc_feature (38)..(38): n is a, c, g, or t
  misc_feature (141)..(141): n is a, c, g, or t
  misc_feature (169)..(169): n is a, c, g, or t
actcaccccnccacacacactcagactgcgaccagacnaccaacaaacctcacctgcacatctttggggcgtgggaggaaaccagagtgcccagaaagctctccgaccgggaggacgtctagacggtgcacagacagtggnccccagccgggaatcaatttttttctcnaatgttataacaaaatgacattgaataaaacgatgctatcaaggaa

SEQ ID NO: 620200 - DNA, 290 bp, Homo sapiens
ttacccgaggcagtgcatccgtagtcatgtcgtcgctagtatccagggtgcagcgttatagagggcgggacactcactcaatatgaaggcaatactgagaggtggaggaaatggctcaggtgccaataagcacatgtagacgagttcaattctgtatcaaagttcaaactatttaatacaaacaacctatggatttctcttgcagtcatgttaaaagactgcaggagcaaaatgccattgacatggaactcatggtgaatgcaaagacttggctggaggccacggaggct

SEQ ID NO: 620201 - DNA, 166 bp, Homo sapiens
cccagcggggacacattcacttttgtagttactacaaagatatagacgattgaatgcatattgcccgagttctccccaaacatatgtttgggggagaaccccccatataacatctcactcgattagatcatcttttcctaatgatttcaatagatagacggtgtac

SEQ ID NO: 620202 - DNA, 795 bp, Homo sapiens
  misc_feature (14)..(14): n is a, c, g, or t
  misc_feature (194)..(194): n is a, c, g, or t
  misc_feature (208)..(208): n is a, c, g, or t
  misc_feature (210)..(210): n is a, c, g, or t
  misc_feature (231)..(231): n is a, c, g, or t
  misc_feature (339)..(339): n is a, c, g, or t
  misc_feature (430)..(430): n is a, c, g, or t
  misc_feature (459)..(459): n is a, c, g, or t
  misc_feature (486)..(486): n is a, c, g, or t
  misc_feature (488)..(488): n is a, c, g, or t
  misc_feature (504)..(504): n is a, c, g, or t
  misc_feature (537)..(537): n is a, c, g, or t
  misc_feature (539)..(539): n is a, c, g, or t
  misc_feature (553)..(553): n is a, c, g, or t
gtgagaatggcggnttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtntgacatggtgggantngacgcagccattgccaatgcntttcgacgaattctgctagctgaggtgccaactatggctgtggagaaggtcctggtgtacaataatacatccattgttcaggatgagattcttgctcaccgtctgggngctcattcccattcatgctgatccccgtctttttgagtatcggaaccaaggagatgaagaaggcacagagatagatactctacagtttcgntctccaggtcagatgcactcggaaccccnatgctgctaaagattcctctgaccccnangaactgtacgtgaacncacaagtgtataccaggcatatgacatgatccncnctggggaaccaggntgatctcttccagagggcactatcgcgaccaggtgcatgatgatatcctcatcgctcagtgcggctggccaagaaattgaactgctcattgctgtgtgtcaagggcattggaaagatcattgcaagtttcacccagtgccacaagcagtaacaggctcttgcagaattcaccctgtttacccggtgaagggaacgcagctaagagttggcaggtcttctacccgggggttccaggggcggac

SEQ ID NO: 620203 - DNA, 167 bp, Homo sapiens
  misc_feature (4)..(4): n is a, c, g, or t
ttanattgaaattgccaactgtaatagtgattgtctatctttactttgcagtactatcagtgttagcctcacatattttgatgctcagctgttagataaatatgtgtttaagatggttgatgttcccttggaagattgacccatttattattatataatgtcccccc

SEQ ID NO: 620204 - DNA, 741 bp, Homo sapiens
  misc_feature (14)..(14): n is a, c, g, or t
  misc_feature (285)..(285): n is a, c, g, or t
  misc_feature (376)..(376): n is a, c, g, or t
  misc_feature (405)..(405): n is a, c, g, or t
  misc_feature (432)..(432): n is a, c, g, or t
  misc_feature (434)..(434): n is a, c, g, or t
  misc_feature (450)..(450): n is a, c, g, or t
  misc_feature (483)..(483): n is a, c, g, or t
  misc_feature (485)..(485): n is a, c, g, or t
  misc_feature (499)..(499): n is a, c, g, or t
gtgagaatggcggnttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgttcgacgaattctgctagctgaggtgccaactatggctgtggagaaggtcctggtgtacaataatacatccattgttcaggatgagattcttgctcaccgtctgggngctcattcccattcatgctgatccccgtctttttgagtatcggaaccaaggagatgaagaaggcacagagatagatactctacagtttcgntctccaggtcagatgcactcggaaccccnatgctgctaaagattcctctgaccccnangaactgtacgtgaacncacaagtgtataccaggcatatgacatgatccncnctggggaaccaggntgatctcttccagagggcactatcgcgaccaggtgcatgatgatatcctcatcgctcagtgcggctggccaagaaattgaactgctcattgctgtgtgtcaagggcattggaaagatcattgcaagtttcacccagtgccacaagcagtaacaggctcttgcagaattcaccctgtttacccggtgaagggaacgcagctaagagttggcaggtcttctacccgggggttccaggggcggac

SEQ ID NO: 620205 - DNA, 152 bp, Homo sapiens
aagcacagagtcagaaagctaaataacaaaaagtcgaaactctcatgtctatcgagtaataacaagatgagagaagaaagagacacgaaacaagacgacccaacgggacattgcagaggatgggtcactgacggagacccagtagcagcgac

SEQ ID NO: 620206 - DNA, 1356 bp, Homo sapiens
tggaaacaaagtctcaccgttcacccaggctggagtgcagggtcgcgatcatgctcactgcagcctcaatctccggggcctcaagtgtgactcctctccgtgccttcagccctcccagtttagctgtgggacatacatggcatgtgcgccaccggtgttcgtggccttcatattctgtgtgcaatgtgaatgtgaaagtgctagtgaggcgcgtgagcgacccacaggaagagtatctttatccaaagagctcttgggtgtcagtgaagaaagaatgcgcggcccgtggtggaacagggaggtttccaaagcctgtggcaccacagcgccaacacaccacatctgtgccacctagtgaatgtggggtcttcccataaaagctcctcggagtctagaaattatttaaatattgtggagatacgtggagattttataaagtgtggtaacacttctagagaactcctcattctcttataactttatacgccgaagtggggcattctctcgcgcgggacacaactggtggccacaaggcgccggaaaacaccggggggcgcaagaagaaaagagccctaacctacaagagaaagcgggaaaagttatggagttgggggcgcgcgcccaagcggtgccaaataccagagatatgggccccccggccgaatatccaacacagagtccgtgattgcggggagcgtacacacagaaataccgtgcccgtgaggttgggacggtgggggaatttctccgtgggcgctcaaaggtgtgtgtactcggtaaaaacacggcatcaatccgaatgtttgtctacaagtgcatcctaatataacagaggtggggttcgggtacccagagaacctctgggtgaaacgacatgcgcactcggggcaccattcgacaggcaacaacccggtaaccgaacagggggtaacagaagttcccaattataggcgcttgccccctgagggccgcaaagacggggggggccaagatggatcccccgagggaacacacgacagcttttttaaccccaacaaaacgctcctaaaaaaatttcgcagacattgtggttaaggggaccaaagcgtggccccacatcagaggtccggtgaggaaaaaggcaccacggggggaagccttggggcgactgctacagaggccgacaagagttggcacccaaggaatttttcagaggacaagaggtcgagaccctttgaaacaagcgccgcagcgaaacttcttgttcccccacaacagtgggtgtgccccccccaacaaaaccacttgctgctggagagaagccgacccacgagctaggaatacggtcagtatatgtaacgcagctacgtcactgat

SEQ ID NO: 620207 - DNA, 216 bp, Homo sapiens
atggtgctgacacggtacttatagagtctggtgaacttaaactagagaaagctgcaacatagagtggttgggagagcatggcaggcccagtgcagaagggctaatagaagcaggtcccttgccctagacccttcaggtagccctattggtgtgaatagcgggacaccttgaggcaggcaggtgacatgggcccagagtccatggcagtgcagcagc

SEQ ID NO: 620208 - DNA, 186 bp, Homo sapiens
gctcaggttgagagaaggaagtctgattaggtgcctgggattggccaaagtgagagggagcagctgagaggtgctgaggtggtcaaacacgggaatataagtgtggagtaaggtgggaggtggaggagatagcgctatctctatcgccctgatctggaggtaacagattccagatgtagacatcac

SEQ ID NO: 620209 - DNA, 360 bp, Homo sapiens
gagcgggtctggtgcaactggtggtgagccggggagtgagggaggtgtgcagcaggcctccggtgagcaaatggacatggacaagcctgacgattctgctgatgccgccgcgacctaagtttggttgtcatctgtcttatgatcgatcaaattttcctgttattgtgtctggtaggtggatgagttttaaaggctacactagcgttctcccaagccatttcgtttgggggttggacagttagattgaggtatgcgtcttgtccagcgttgttttggtctggactaaatccgagtagaaatgttgcatgatcgaattgtaccattggaatctcataatcgaatgttgtggatgattcgacc

SEQ ID NO: 620210 - DNA, 151 bp, Homo sapiens
ggatttgctggtgcagtacaactaggcttaatagggacatggtggcttatgcatgtaatgccaccactttgggaggccaaggtaggaggatcacttgagctcagcaatttgagaccagcctgcacaacatagcaagaccccatctctacta

SEQ ID NO: 620211 - DNA, 321 bp, Homo sapiens
tctagcaggatcccaaacacgcatctcaatttctgcaaaacagactttaaaacaacaaagattaaaaaagacaaagggcattacataatggtaaagggttcaattcaacaagatctaactattctaaatatatatatacccaacacaggaacacccagattcataaagcaagttcttagagaccctaatagaaacttaagactcccacacaataatagtgggagactttaacaccccactgacaatattagatcattgagacagaaaattaacaaagatactcaggacctgaactcagcactggatcaaatatatacacaa

SEQ ID NO: 620212 - DNA, 1462 bp, Homo sapiens
ggacgcgtgggtcgacccacgcgtcgtgttgccggtgcagggagaacccctagtccccggacgaattgctcccgaaaggcgacgcggaagaagcctgaggaggagacttggaggaggactgacgtatgaggagcctagatgatgacccttgtcggagcagactatgggggcctgacggaaattgttcccggtgagaggggtccggctccgcggccggggcgcatttttgatctattcgcctcttgggtggctgcagaaggatgtacgaggttttccagggcatggcttgtgcgatagggaacaggttccctttatgatcctgggttctttcgcgttggtctttgagtacgtgagagagttgcaaagtggacgcacacagcaagcaaactgcaagccaagcaggcaaggaataccttctaaggacgcgtaactactcgggtctcttcagggagagaagtgcccaggtggctcgtaccctctactttccctgggcatcacgatcttagcagtaggtaacttctgcgtggtaaggaggctagtctcagatcgcggataaaggttgcgcacaagttccaaggtggttttggaaactggctggaatgacttgggaatctcatggatcattcaatacacttgtagcgtcaacagtgggagtctgattgtagagacaccgggctgagggcagaaattaagtcacccacaagtgtgtgttcctctgtgggcaaaggactgtctcccttttgcaccgtgtggtggctcgctccacaacaggtaattccatatcaagatttccagtggaacgtcccaagattctgtggaattaccccagggagttggtacagcccaagtggcaggacagggggttattatcgcaagtctgtggtggttacacacaggaagttcgtcctttttcaacgcaccagagatggtggccaccttaaacgtggcacagacactcttcaagggtatcacccccattgttggtgagggtatagtggaacccggatgttggtccacaaatggtgacgaagagagatgacgtttgataccccccttgtgttgaagaactaatataatagcgatagtgagttgatgatgagagggtatgaaatacttacaacgagcaaaaatgaagatgatgttagggaggaagcaggggaaaccagtgtcacccaccgacgagtggtcgtgtacaagcaacgacaaaacatggacggtcatacacacgacgggtgatgaatcaacaagggacgccacccgaagtagacaccaccaggagtatcagaagcaagacagagcaggagacagacctgcgtacaaccaaaccaccaaccaaggaggagggcagcaagtcagagaaaccggaggcacagactactaggcgaagagtgaagggaacgacagcagtggtggttaacaacacaacgagacggcccctccggcagcagaagacacacgacca

SEQ ID NO: 620213 - DNA, 90 bp, Homo sapiens
tctagaggatcaaccgccatttacaactatctgtgtaaaataaaaatgccatttccaacacctttgcgaaaagtaattgttaatgcaggc

SEQ ID NO: 620214 - DNA, 479 bp, Homo sapiens
agcctgaccttaggtgagactaaacacaagatacacaggaaggcaatacctcacagtgacacgaacagcaagcccatcggaaacagaagacagattcctaggaagaaactactttgaaatatcgtgaccctgtatgcataaaaaaaaacacaatagaaacagtagttgccaaaaacagttctatcaaatgcgcagttctatcatatgttctatttattacaactttttatttgagacggagtctccccctgttgcccaggctagtgtgcagtgtcgtgatcttggctccctgcgacctctgcctctgagtttcaagctacttgggaggcagaggtaggagacttgcttgaacctgggaggcggaggttgcagtgagctgggatcacgccactgcactcctgcctgggcaatacagtgagactccgtctcaaaaaaaaatttctgacactaaatagatcaagcccattatctaaacttga

SEQ ID NO: 620215 - DNA, 197 bp, Homo sapiens
taaagagacgactcaaagaataagtaatatataggaaactcctccagtaaataaagattatacatgcaaaagcacacagcataaccatcatactagaatggtgaaaaactaacaatcttttccatctcaggatccaggcaatacagcatagccaactatctactatcactgcccacattctcattcacccagcagca

SEQ ID NO: 620216 - DNA, 399 bp, Homo sapiens
cagaaatcggaagcacataacttgaaattgagaagttctaaatcagtgactttctaaactatacgaatttttcattatcctccatgtcacattgtaggaaatctttatagtatttgagagagaaaattctgggccatagggtgatttgtggatggaaaagccaagttagttgaagtagttttgcaagtcagctttcctggtcctgaagtatgtcctatttcagaattatgctccttaaatgcatactacaggctgggtacaggggctcatgcctgtaatcccagctacttgggaggctgaggcatgagaatcgcttgaacccaggaggctgaggttgcagtaagccgagatcaagccactgcactccagtctgggcaacagagcaagactctgtctcaa

SEQ ID NO: 620217 - DNA, 170 bp, Homo sapiens
ccaccttgaaccaccagaccacgacctgatcttcaaaaaattattattattaatttcgaataaatcatggcacctatgtgacgatttcatatcccagtcttattgatgtttgttggccaaggttagataaaaagatgttagatgaaagacatattttaagtatatgtaca

SEQ ID NO: 620218 - DNA, 350 bp, Homo sapiens
gctcgactccatataatggcagatctgatgatgcgaaggctggacctcttgcaactagccctatcgacgtggacagagcattcctagcctaatgataatgtacactgagcctatgagtctggattcatggtccacgatctcactgctactatgatgcgtagctggatgcagctaatgaccttgcgcacatacatagtgttagcaggctaatgatctgcacttactcaggggccgaacgacaggagtatggactgtcccaaccgactaggaccttatactgtacacacgatggcttcttccattctaactgaagggcctcatgtactgacgctggcctatactgctcctcg

SEQ ID NO: 620219 - DNA, 336 bp, Homo sapiens
gtaacacaccttccacaaacatgtcatacgtgcacaagtacacatgtccacaaacatgcacacatgtgcacacttcacacatccacaaacatgcacacgcatgcacacacatacacctccgcaaacatgcacacatgcatgtgcacacatacacacacctccacacatacacctccacaaacatgcatacacacatgtacacacacacacctccacaaacatgcatacacgcacgcgcacacacacctccacaaacatgcacacacatgcacacacgtccacaaatgtgcatgcacgtgcacacatacacctccacaaacatgggggatcctctag

SEQ ID NO: 620220 - DNA, 170 bp, Homo sapiens
cacgaggaggacccagagctcgctacgttgacctcctgagaccatgtggcaaccaccggagcgacccgggtctcgctcatgcggactttggcgctccactcgtgacactcgcaattctttctattttgttcgtgccacgcccagatgcatatcaaccataccttccagac

SEQ ID NO: 620221 - DNA, 221 bp, Homo sapiens
gcttaagacaaaaaataaggagagggtcatggaccccatcccagcggttagagaatctttcttaggttatatacgaactggaatgaaataactggcactttatgaggtaaaacacagacctttaccaccctatcaaaggttgagtggcccaaagagagcccccgcatggcccccaattattagagagcctcaacccatttttctatgttaaccccagattg

SEQ ID NO: 620222 - DNA, 861 bp, Homo sapiens
  misc_feature (115)..(115): n is a, c, g, or t
  misc_feature (142)..(142): n is a, c, g, or t
tgggcaaacacccttttctaagggttgataggacacctttcccgtgcggttttttgaagccccccccttggggggtgcaccaagtgatgttcgccctgcgcccccctcttttggnaccgcccctgttgtgcccacgcccagngtgtacctggccgccgcccacgcgcccctttgttggggtgtactacccccccggcggtctctcccccgaaaacggggcaataccccgccgctcgccgttttgtctccccccgacggttatcgccctccttccaacttatcgagtctccgcgacaatgttccccccgtcccgtctcctcctccgccacgactgcttgatttgcttcgtcgaccccccccgggacggttttcaagctttccctctcaccccccgggatctttagttgggggatgtccccaccaccccccggttcttctgggaaatcggtgtattaatttcgcgtccctcgactacctgtttcagtgctctcggttattcggcgccacagagtcgctggcatcaccccctcttgtagaaacctggcctctgggggacgactgccctcctgaaggcggccgctggcgggatccaacacgtcggcctggctaggacgggcgggttgaccccccccgcggagccccctccgaagagaacctacgcgccccccatatcaggcaatcgctaagaggggatgcaccacgaccgcaccaggtgcgaaatagcctccaccccagagacagaatgcagtatggccccgtggcgatacgaacgacgacgccacaaaagcacacaggtgcaacaacatacttcctgggcgcccctaaccgaccctaagctccgcgcggcgttccccaaaacac

SEQ ID NO: 620223 - DNA, 423 bp, Homo sapiens
ttaatagaaatcgacctggaaagtctggtctgcagtcagatcacgtaagacttgaatcgtttgaacaaatgaaccttaaatagcgggtgcagcatcgggatgtcctgatccaacatcgaggtcgtaaatccctattgttgatatggactactagaataggattgcgctgttatccctatggtaacttgttccgttggtcaagttattgaatcaattgaatataatatttcgctttgactgtttgaagtctaatcatagtactgctcggaagttggattctcgctccaaagtcgccccaatcgaaatttaaactagccgagtttggtaaataaaggcctgtgggtatgtaacgtactgttctagcttaataaattaacacggtccattgggtcttctcgtattggtgtatcatacccgtctctt

SEQ ID NO: 620224 - DNA, 843 bp, Homo sapiens
gccctggaaaggaaaactttcggaaagctactggtagagcaccaagcaatatcatttatgctggctgaaatggcaatgaaagtgaactagctagaatgagttaccagagagcagctgggaggtgattctggtcgtcgaaatacctattatgcttctatggcaaaggcattgctggagatatggcaaatcagttagctactgatgctgtgcagatacttggaggcaaggattttaatacagaatatctggtagaaaaaattatggagggattgccaaaaatctatcagatttatgaaggtacttcacaaaattcaaagattatgtagcccgtgaacacattgacaagtacaaaaaattaaaaaaaattactgtagaaatatgtgaataatagaacacaagccactgtttcagtccagaacaaaagaagggggtttaacgttttttccagtgaaaacaaatcctcttatattaaatctaagcaactgttatcatagtagttatactttggttaactctggtatgtctccttaaggcaggttggtctattaaaatgaggggttctttagttaccatttactgaatttagttaacttaaaaataaatagtataggactttagaataggtgagaaatctggaattatttgggcatgagaagggataaagtttcaggaggtcaaattccttgacaattgtattgggatggctgggaggaagtaattgggtaaacgtatctggcggaacatggaatgtgggtaaacgaatggtgatttatgagaaaagtgaacgatagggcgtcaaacagagcttgggcgagataatcatgaataactagatgggattaa

SEQ ID NO: 620225 - DNA, 202 bp, Homo sapiens
tagtcgacggggattacagccgtgagttatgcatccggccagaaatcagtgtttttaactggattattttattattttaatgagatggaggtctcactctgttgcccaggctggagtgcagtggtgcagtcatagctcactgtaaccttgaactcttaggctcaaatgatcctctcgccatgactcaagaatccccggtcga

SEQ ID NO: 620226 - DNA, 1045 bp, Homo sapiens
gtgctcaggtgtcgcatgagcgaagatgtgtactgatctccagtaatggggagtgcatgattcatgagtcttgtctgctgatagtgtcgcgtgcttgttatgatcctgtgtgagaagtggtcaggtgtctcgagtggtggtagctcagtattgttctcagattattggtagctccattgaatatgtccagatcatggaagattatttacagtcagaatggatattctatgatgctgtcaaatcgggtgatgtatatacagggaattatagatctctcaattaaataataaagtggcactaatatctcacaatacttgcttcagacaggatcacttagtaataaattgtccaaagtagagcatgcaagaggagggtactgacctataaataaagactcagtggtattcacgtagtagctaaagtctgtaacagtagctccccggagatgctgcgatgaaacctatgaatggtccctcctgggcaggtacgggtcagctcactgctcttgttacttgcgtatcctgccattgatagtgtgtatgcagtctgctcgtagttagtaaggtgtgactcggccttgggttggtcgcgccatgtttttgcggagtggctgatacctcgaggctcggccctttctatcttctcggcattcgtgctgttggtcggcttcgatctctctggcttgtgtgtccacctggtgtgtagcgctcatgctgggtgtctatgctagagcaacattctggtgttctgcgttcaagcatcctggaccgaggtcttccaggtcagtctcttgcccccgtcgttgcccaggatacctaccactaactggccttcagctgcccgccggagggctcatacttctttcccgaggtccccggatcgttctgagcttgatgttcttctcaccggggagccctgagagttccagcatattccaaggccatgcgttgggatgaaccgggggctggaggccatggattccttctcaggcggcaacccccccggcgggagaatgggaaagcgccccgatggccgggagacaacg

SEQ ID NO: 620227 - DNA, 389 bp, Homo sapiens
ctctatccttaatctgtcctgatagcctacatttgaccgcagttataataacatctgtaatttcaagtacaatagtacattcataataattttgaagaacgtatgacctaggaccccataatgcaatccaatatacaatttggagtatggattactttttagtgaagtttaatactaattgaagttctaaattgatcatggccagttctctgaagttctaatctcaagtatttgatcccatgtaagatacagaagggaatttttaaggcttttttggtattccaaaatattggggatctatcttatttttctattattcccctcaagtctcaattgaatattctcattttttaaaaaaaggggatttttcttaggttttttcctcacta

SEQ ID NO: 620228 - DNA, 893 bp, Homo sapiens
  misc_feature (893)..(893): n is a, c, g, or t
acgcagtgtgatcaacgcagagtgggtattacggccgggcgaatgtatgacttgcatgacctttccaaagctagaactggcgactcagcaaatatgctggaatgtgctactgggaataatggatgtgtgattacctggtcggtgaagaaagacggatggcagaactgatgccggtggggataacaacttttcagatagtgaagaaggagaaggacttgaagaagtctgtgatatacaaggtgaacctcatggactggaaaacatggaaactgagaagtttggaactcagcgtcgtagaacctcagcctgtatttgaggcatcaggtgctccagatattacaggttcaaataaagatcttccccctgaaacacctggagcggaggacaaaggcaaagagctcgaagaccaaaccctttcgctgtaaagccatgccaatatgaagcagaatctgaagaacagttgtgtgcatcacatcagagttcacagtgctaagaaaatttgtgtggaaaggagagtgcagagaagcaggcaaaagccagggaatctgggctctttccactgcaagaagaggagattcttccaagggcccattcgctgtgacgctgcggtacaatactaatcgatagatcactatacaggaactgaaaacaaccagagctggataatgagcgacgtcagggttcttgccctatcacacacgtgcgcggttctggggaacttaaaccttccgagagatcaccgtggagcgcttttcgcggcaacatgttgcctttgactaccgaagccaataatgtgtgccatcacacactaaagtttccgggcaagtaggtgtctataacacgcacgcattctgtaaagtatctgttcatcttctaaattaatcaacactgcn

SEQ ID NO: 620229 - DNA, 137 bp, Homo sapiens
gtataaaacccatttgcatgcattaggaagttttttttgggttttattcatcctgtagtgatggatttgtgcccccaacgagtaggcccttttgtactggactggttttttaaagttttttttatcccgccccccca

SEQ ID NO: 620230 - DNA, 939 bp, Homo sapiens
  misc_feature (1)..(1): n is a, c, g, or t
  misc_feature (170)..(170): n is a, c, g, or t
  misc_feature (514)..(514): n is a, c, g, or t
  misc_feature (556)..(556): n is a, c, g, or t
  misc_feature (574)..(574): n is a, c, g, or t
  misc_feature (598)..(598): n is a, c, g, or t
  misc_feature (607)..(607): n is a, c, g, or t
  misc_feature (623)..(623): n is a, c, g, or t
  misc_feature (646)..(646): n is a, c, g, or t
  misc_feature (650)..(650): n is a, c, g, or t
  misc_feature (653)..(653): n is a, c, g, or t
  misc_feature (675)..(675): n is a, c, g, or t
  misc_feature (685)..(685): n is a, c, g, or t
  misc_feature (687)..(688): n is a, c, g, or t
  misc_feature (691)..(691): n is a, c, g, or t
  misc_feature (726)..(726): n is a, c, g, or t
  misc_feature (728)..(728): n is a, c, g, or t
  misc_feature (788)..(788): n is a, c, g, or t
  misc_feature (813)..(813): n is a, c, g, or t
  misc_feature (827)..(827): n is a, c, g, or t
  misc_feature (839)..(839): n is a, c, g, or t
  misc_feature (842)..(842): n is a, c, g, or t
  misc_feature (901)..(901): n is a, c, g, or t
naaaaaaaaaacaagcggacccccccaacccccagcccccagagaaaaaagggaagaacaaaacacaacaagaaagaaggaaagcacgggggagggaaggggcgaaggcacccaagaaacaaagaacacagagagaccaacaggacgcaaggcagaacggcaaagaagancgcccagggcgcacggcaggaaggcgcaggaaaacagaaaaccccaaagcggggaaaagcgaacgggggggccacaaagaaaaccccgaaaagggagagagagggcaaaaagcagaaccaaaagggggaggggcaaaggcggcgcccaaacagaggggaaaaaaaccggaaacaaaagggcgccggcgcccccccccggccgccagcaacggggaaacacggaagaaacggaaaccaccgggagcagggcagaaaggagaaaggcgggagggggggccggccccgcaaccgggaccccaaacaacaacgcgacgggcaaaaggaaccaggcgacgccgcagcgnggaaacccagtaaggaacaccaagacaagggggctcaccgcnaccagacagaaaccagcngtgcaaaaagatgcaggaatccgnggaaaaaanggagagggagagccgnaagacacaggaaacccaaaacgnaagnacnaaagagaaaaagaaaacacccntcactcaacnanncantataaaggaaagagcaaaaagacagtcaaaaccancngcgtcgagcagcagcacagcccagcaaaacaggcataccaacaaaccgaaagcaaacacncaggaaagagcctctgggcccctcncaaaagagaccccncccagaccggancgngcccccaaaggagagaccaaagcaatataaccacagagacggggacccccgagggaggngagagggaagggccaagaagacacaaaaaacaagaccg

SEQ ID NO: 620231 - DNA, 390 bp, Homo sapiens
gccccgtcacaattttaaaaccccccaactgaaaatgtttacaaacccccctgaggattctgaaagatgtgaaggcatgtatctgtacaaaaaaatccaggttctgtttgaaagaaatgcgtctcttcatccaaaacggttcaccccagaggccatgccaactcacagaaatttatgttttctgaagactccaggaaaaccagtttccatgccacattttgtacaggccacatttagaatgattgccgcagaaagttctacggagcttaaggagtgtgctgaaccatcaacaagaaagaacttgatgaattcttttgaacaaaagataagtcgtttgtaaaaacaaagaaaagagctcctgaaagttaaccagcattggtttcggcaatt

SEQ ID NO: 620232 - DNA, 568 bp, Homo sapiens
  misc_feature (131)..(131): n is a, c, g, or t
  misc_feature (280)..(280): n is a, c, g, or t
tatgctgtctcagtacacgatgggtagttgagtcaacataggagtcaaacataccatgtgcttgagatgaatgtcagtgctggtctctccagcaacacaatagacccaacgttaggctaagatctaagatnggctcttctctgaaaaaggcacacagtgttaccacgtagagagttctagggctcactgtgagattcttagaaagcaaggccatcagtgacccggctcattgtgtcctgtgagttccgctcccattcacctgaatggcaagataaatgcnagactatggagccctcagttaaatgttggccatgcaattaccaaggtgggacgaggcgggggagcctcgttggaattccatcctccaatccgcctggctgagagatggcaggacaaaaagatatggaaagggaaagaaaacttggttgcaggcatggaagacataccccaatagtgttattggcttttcaaggtgtttttacctacaagaaaggaagtacaatgggaagcattaaaccaggaactccagggccaaaaagtgctgggctggaatccccgctttgtcatt

SEQ ID NO: 620233 - DNA, 630 bp, Homo sapiens
tgggggaatggggtgttttttctagccacttgtgttttgggaaaacctgtatggcagggatttattcatatattcctgtccaaagccacactgaaaacagaggcagaaacttgtactcgggtgtgatctcttggtcctcaggtgtctcttcggggctccgtggtccctctgtggctttatagctagctgcccggggaccaaggtacaggtgaaagcaaggtagcagcttgcgggaggaggcctgtctggcttaccagtctattacacgtggtggcctcaacctctcccagacagggcagagaactggtgggcagcctcgttgggtttctaggcgtggctggagagggtgggagctcattgtgatagactcattgagtggaaactatttttgtgaaacaggcttcctccttcgaggagagatcagtgcggactaaactgggagcaattccaggtgcaccgtggcaggtgattccttttcttggcaaagtcacgggctcttgggtcccagtaagtgggaccaccacttgacatcatttccccgggaaccgggtcctgactaacacagacaatggggactccagagcctcaagagccggagagggcacgtcactccagagggagtcaaatggg

SEQ ID NO: 620234 - DNA, 132 bp, Homo sapiens
  misc_feature (37)..(37): n is a, c, g, or t
  misc_feature (61)..(61): n is a, c, g, or t
  misc_feature (110)..(110): n is a, c, g, or t
gcaccctgtcacccagcatggagtgcagtggtgcaancttggctcaatgcaacctgggaantggaggttgcaatgagtcaagatcatgaactgcacttcagcctgggtgncagagtgagactccatctcaaa

SEQ ID NO: 620235 - DNA, 356 bp, Homo sapiens
tgttggagtgcttgtgaggatgtggagaaattggaaccctcatactctacaggtaggaatgtaaactggtacaactgctttggaaaatagtttcgccgttcctcatttgaaagttaaacacagaattacgatacaactcagcacttccaatcctaggcatatacctaaaagaagtgaaaacagatactcaagcaaatacttgtacatgaatgtgcatagcaccattactcaatataacagtaaaaaaaatgcaaatctggccaggcgtggtgctcatgcctgtaatcccagcacttcgggaggccgatgggtggatcatctgaggtcagaagtttgagaccagccttgccaacatg

SEQ ID NO: 620236 - DNA, 176 bp, Homo sapiens
tgaattgactcccgtgtccaatgtcttcagtgtgggggccccgctcttgggtcccctcctctgccatcactgaagaaccccacgccaaacactgaatgtcacctgtgcctagcgctcggtccaccttgcgtgccgtgtttgactcaactcaactcctttaacgctaatatttccgg

SEQ ID NO: 620237 - DNA, 192 bp, Homo sapiens
tccgtggctcaggacgttgccagcgccatcaagctctttcgtggcgagctgttctatgacacggaaaaaggcataccgtactggaccgatggtgcttggccagttgccgccgctggcactggtgcgcgagcggctgcgcgccgcggccttgaccgtgccggacgttgccgacgccgtaccgactatcaccgc

SEQ ID NO: 620238 - DNA, 252 bp, Homo sapiens
tggttatggagccgccttaaaaaagaatgtcgaacccaagtccccgagtaaaaaccagaaccgccagtccttccctccaacacaacagagcacaggcaccggaccggtgatgagcccgaggagctgaggccgctgggaaggacagctgacgctggcggctgccgtgtggacggagagccctctttggaatgggccgagtggagccacctagcttcccctgcacacctcattaccactgctaaggcttcaagg

SEQ ID NO: 620239 - DNA, 514 bp, Homo sapiens
aggatgttctgtgatgttcataattagaaaagttgctcggtacattatagaaccttggcaaggctgatggggaagcagtccagactaggctggactctgaaagacggcccacagcaaggaaaggaacggtggcgctggcggcggtggtgttctaagtcccagggcaggacagctaggaggggtgctgactcaggctggagtgtaatctggaaacatgatgtttgcccagttcctgaagggctggggcccactgggccagtgttcccaaggctgtcagacatctttatgaagttctccaggatgataggacatgcagggcccattctataggggtcactagtctttcggcaggtcctcatgcccaaacgaggatggcatcaattcatgcaccggcgtgacagtgtacgttccaaacagcttggacatgtacacggtccagttggagacatactctatgatgacttgcctggaggtgccacactgctagagaacatcatctcgcatttcactggcg

SEQ ID NO: 620240 - DNA, 232 bp, Homo sapiens
aagttgaaccaataatgacgtgaagtccgtggaagcctgtggtacaaaaaaatgttgagccgtagatgccgtcggaacatcatgcagggagactcgaaatactctgaggcttgtacggagggtaaaatagcagcaccagtaaacttgtccataagcagtgtatgaaaattctttggtttcggttgtatatctattcagactatgagtagcagctcaggtgataagcatactc

SEQ ID NO: 620241 - DNA, 250 bp, Homo sapiens
gagcggtctggtgttggaatcagaagattcagctgacagttcttcgtaagttatttgtgttacgtttcttgttaattgggtgagtggtcacagtaccagagtagtgacatttatgtgagacaaagcttagttttttagaagaattattgtaaacatttgatgttaattccaatgtcttcaaataggataaaatataaaggtagcaaatttggggagtaggaaaaaataagtgaccgtcgtggcatggtgg

SEQ ID NO: 620242 - DNA, 739 bp, Homo sapiens
ggcggtgggaaatgctggcgcgcgcggcgcgggcactggggccctttgctgaggggctctctactggttctggccggctcggccggcctcctctggatgtgccccgaaacacgggtgtactgttcggtgccgcagcaaggaagcgctggtgttggtggcagcgattgggccgattccaccgggatccttggagcgtggtttggaacatcctcatccttgtgtaagaccggatccgatatgtgcagagtctcacggaattgggtcatcagggtgccttgagcagtcggggtgtgactctcgacaagtgtaacctctggcaaatcggatggaggtccctttaccgtgcgcattcgtggacccctttacagggggcaaggctaggggtggtgagagggaccctgagttatgccggtcaccacaggcttagcttcaaaacaacccatggaggatcagagctcggcaaaactctctctggaccaaaggtctccccggggacgcggggagtccttgaagtgccaggctttgtgtgcggattgccattcaaaccaggtctgttgacgtggggggggatatcccggcgtgcctcccgctatctggagatccggggatatcacatggtgccaccccgggttgaagaagtctttgcccgatgcctggtggagggcgcagggggggaaaagggccacagttctcagactctgagggaaccggaaatttcgccattccatggggccgagga

SEQ ID NO: 620243 - DNA, 152 bp, Homo sapiens
agaggagagtgagtagagcataagagtctgagatggggaaagctatagagggggtgggggaggtgtctgagagttgaaggatgagaaagaatttgccagggaggacgatgctggcgatagacgaagtccacaagcgaggcaagtaggcactg

SEQ ID NO: 620244 - DNA, 281 bp, Homo sapiens
ggaacatcgtattacttgggttgtggtgtcggtgacagcggactctactgacggcacgtaggtgaacctctcaagcgggagcatccgctcatgacgccctaccaaggggtcggaccagcgtctatgcccctctgggactaccagggcagcactatgctcacgagccagtacgtacgtctgacccctgaccgacgcgcacgcaaacgcgggctctctctggaaccaccagccgtgcttcctcaaagacctgggaaactgacacgtccacattcaacagtcca

SEQ ID NO: 620245 - DNA, 286 bp, Homo sapiens
taaaaaaaaattttggctggaaccaaaccgggggtgcaggggataatcttgggccacgggaacccccaccccccaggttcaagtgattgtcccccctcagggttttaaataggggggataaaaggtgtgaccaacacgcttggctaaattttggggtctttagtaaaaacgggtgtttccccacttttggccaggctggtctcagatttctggcctcgtagatctgcccaccaaggcctcccaaagggctgggattacaggcaaaagccattatgcccagccggga

SEQ ID NO: 620246 - DNA, 633 bp, Homo sapiens
  misc_feature (44)..(45): n is a, c, g, or t
  misc_feature (47)..(47): n is a, c, g, or t
  misc_feature (50)..(50): n is a, c, g, or t
  misc_feature (61)..(61): n is a, c, g, or t
  misc_feature (64)..(64): n is a, c, g, or t
  misc_feature (66)..(67): n is a, c, g, or t
  misc_feature (74)..(74): n is a, c, g, or t
  misc_feature (77)..(77): n is a, c, g, or t
  misc_feature (81)..(81): n is a, c, g, or t
  misc_feature (87)..(87): n is a, c, g, or t
  misc_feature (99)..(99): n is a, c, g, or t
  misc_feature (103)..(103): n is a, c, g, or t
  misc_feature (120)..(120): n is a, c, g, or t
  misc_feature (123)..(123): n is a, c, g, or t
  misc_feature (127)..(127): n is a, c, g, or t
  misc_feature (153)..(153): n is a, c, g, or t
  misc_feature (190)..(190): n is a, c, g, or t
  misc_feature (217)..(217): n is a, c, g, or t
  misc_feature (256)..(256): n is a, c, g, or t
  misc_feature (270)..(270): n is a, c, g, or t
  misc_feature (279)..(279): n is a, c, g, or t
  misc_feature (298)..(298): n is a, c, g, or t
  misc_feature (309)..(309): n is a, c, g, or t
  misc_feature (311)..(311): n is a, c, g, or t
  misc_feature (340)..(340): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (356)..(356): n is a, c, g, or t
  misc_feature (364)..(364): n is a, c, g, or t
  misc_feature (375)..(375): n is a, c, g, or t
  misc_feature (382)..(382): n is a, c, g, or t
  misc_feature (403)..(403): n is a, c, g, or t
  misc_feature (413)..(413): n is a, c, g, or t
  misc_feature (425)..(425): n is a, c, g, or t
  misc_feature (434)..(434): n is a, c, g, or t
  misc_feature (439)..(440): n is a, c, g, or t
  misc_feature (442)..(442): n is a, c, g, or t
  misc_feature (452)..(452): n is a, c, g, or t
  misc_feature (485)..(485): n is a, c, g, or t
  misc_feature (489)..(489): n is a, c, g, or t
  misc_feature (504)..(504): n is a, c, g, or t
  misc_feature (507)..(507): n is a, c, g, or t
  misc_feature (521)..(521): n is a, c, g, or t
  misc_feature (523)..(523): n is a, c, g, or t
  misc_feature (526)..(526): n is a, c, g, or t
  misc_feature (542)..(542): n is a, c, g, or t
  misc_feature (544)..(544): n is a, c, g, or t
  misc_feature (548)..(548): n is a, c, g, or t
  misc_feature (550)..(550): n is a, c, g, or t
  misc_feature (564)..(564): n is a, c, g, or t
  misc_feature (624)..(624): n is a, c, g, or t
cgggctgtcatcgtggctcgtggaacaatgtcggcagctgggtnnanaanaaaaaaaaaanaanannaaaaaanaanaganaaatanaaagaaaaaatnaaanagaaaaaaaaagataanaanatanataaaaaaaaaaaaggaaaaatgganaaaaaaaaaaaaaaaatataaaaaaaataaaaaaacnaaagaaaaaaaagaaaaaaataaaaanaaaaaaaaaaaaaaaaaaaaaaaaaaaaagaatcttcgntcccttgtacaacncccacccanggggaagtctagcgccctnacccaagaatncngcaagaagacaagtttacccgcgagttcnctngngngagaaaagncctaactnaagagagactngaaacanaaactatgacataacatcacngtacagagtnagcggcatctgngaaacatangtgtnngngacacccaanagacagcctatgcggaagactatctatctcacngtgnacaaaacacaaccanacngtttgtgttcacantnacngtcacaaacagactcngngtgngngcgcctcttagcgnttcaaagtatttacaacactttgactgcacaagttcacactaaaacacatctattttttnacgttcata

SEQ ID NO: 620247 - DNA, 140 bp, Homo sapiens
ctaggaagcagaagaagagatggagacagaggcagaagcaggaatcagcagaagcagaagcggcagaatcaggaagcggagaagcaggaagcggctagaagcagagaagcagggtcttgcgtgagggcagaatgcagggt

SEQ ID NO: 620248 - DNA, 195 bp, Homo sapiens
tcagcacatggacggctgaagtgggcggatcacctgagtcccaggaggttgaggctgcagtgagccacgatcgtgccagtgcactccaaccttggtaacagagcaagatcctatctttaaatacaaaaaaacacgatccctttaataaaccaagggcttctaatttcataaacagcaaaggggaaccctagccca

SEQ ID NO: 620249 - DNA, 141 bp, Homo sapiens
ctccctacagcattttttagaatgtaccaaataagaaaaacgtggatgaagatggagaaagcatacaaaacggctacacgtggaattggaggctgacgaccgggcggaacagaaagtacaggccaagaccagtgcaggcag

SEQ ID NO: 620250 - DNA, 499 bp, Homo sapiens
ttgtaggacttacctaacctgatttcagatcccactagaaagctacagttctacaatacagtttagcacttggtagaaatgtttgtagctcaattgacatagaacagagaggatctagaaacagacccacatatgtatagtcaactaattcttatggccagaagggtaccaaccggcaatatagtatgcacctcccaattctattcggtgggccaattgcctatcatccttggtcggaatagatgttttcagtcactgcaacaccttagtcgtgtataggatttcactgtaagtactatcttcaaagtaatatctatgtttaaatagctacatacacttctgtagtcataactatcttcattgcatcaccagttaagagatttgtcctcttaactgagaatcacggttctatgagagggccatctaaaactaaatttagagatacctcaattcagtgtaacttcgatttcaataacatttaccgaacatgctgttcctt

SEQ ID NO: 620251 - DNA, 1255 bp, Homo sapiens
  misc_feature (419)..(419): n is a, c, g, or t
  misc_feature (862)..(862): n is a, c, g, or t
  misc_feature (873)..(873): n is a, c, g, or t
gtaaaacgcgggctttccaaagatgtaaactctggaaaacagttggccccgttccacaagccaacgtgtcctcgcccagaaaaacgtcccattggaaaatgggaacgcattgtaaaccgccccaactctcgggaacacttttttaattgaggaagctcgctaatttgtgccccccccacgagaaaggttggcctggctggacaccccccttctggggtgtaaaagaaaattggggaaaaagggggtttatatattgggtcccgcagaaatcacacactttggttgtgggaaaacccgaccccacacaccaaggtgtttcccccccctgggagaagcccacgcgggttttcctctggagacccacacctgggggcccgctgggtgacaccgcctcggcttatctctcgagagtaaaaagnggcgccacatttccctcgtgttacacacagagccccccaagggagagaaaccacttcgggagagagaaatagagaaaagagagagaagaaaatctcaccagctgtgtcgctggggtttggccacatctgttgggagaaatggcccacacaatttctcgagagaccgctgtgtcttcccaaacactctgggtgttatattgtgtataacaaaaataaggaagagagagaaacgagagataatttctcctcgggagactctgagctctcgagattacatcaccccacggggctctctccgcccgctctcgtgggcccgcccacacaaaagagagctttacgcccacgagatatcccccccacaacattgttgcacaaatactctctctctcaaaaaggaaagatatagatatgtgcccgccccacgtagatatgtgttgtgatangaaaaagcccncttataaatataaagagaaggtataagaaaccctcataggaacccacaagcacacccacaagaatttcacagcgtgtcttgtgtaactcccacacgtggttcctcgcacgcaccacacacacgcgcggcgtaattggcttctgaaagaaagcacgcgtatcccaagaaaaaataaaagaaagagaggctgcacgaaataatgctaaaacttttggcccaaagaagaaatgaaaggagaggctaaaggaagaagccccacaggagacccaaattgcgaaagaggaaccccagactttcctctctgcgagctttttacttctaagtctgaatcccgtccagaaataagattttttgagtaaccaaataaataagatccagactc

SEQ ID NO: 620252 - DNA, 212 bp, Homo sapiens
cgctgactctagaggatacacttcctctcctcccacctcgaagccaaggcaggcggattgcgtgaagtcagaagttcgagaccagcctggccaacatggtgaaatccgatgtctactaaaaataaaacaattagccaggcatggtggcccgcatctgtagtcccagctactggagaggctgaggcaggagagttgcttgagcccaggaggtg

SEQ ID NO: 620253 - DNA, 409 bp, Homo sapiens
ttttttgttccaaatcaatgtagcaagttatttttttctctttttcccctgatctttgacaagaataatgagaagaaggaggaggaggaataggaggagaggaaggaaggaaggaaggaaggaaggaaggaaggaaggaaggaaaggaactgcctcacaataaataaaagaccctaaaaagaaattctaaattttatattggtagattaaaatctagtttttaatgctaaactataaggaaattaacttaatatgaacttaatcatattcatcctaatggagagaaaattctccagagtagtataaaaagatttaggaggcaccagaacaaaaacagttatgaggaaaactacatttatgttcagttatgatatttccaataactctagtttgaaggtcgacgcggccg

SEQ ID NO: 620254 - DNA, 599 bp, Homo sapiens
  misc_feature (162)..(162): n is a, c, g, or t
taaaaaaagtaagcctttattcccttgttttggcaaataaaactgggctaagtgggttgcttttgggtgattagtcaaaaagaccaaactcccattatccctcgttccgactctccctccgacttcttcctttggcttcaacctttagcgtggggactgcangcagcagcaggagcagcttgttgggtggtcagcagccacgaggggcagcgagcacaaatggcagagtggaattcagcccaagaagaggccttgaacctttattcagacaagtgtgggcaagggtgttaactccggtctctcccacgagaaacagaggccgaggaacctcgttttgtgtcccccgttgtgaatgattagaaagtggggctcacgtggtgtgcaaccagtgttgtgggttacgccaatctctgtgcgagacaggacctctgtggcgaacattgtgccgggaccccctctccgaggaaggcgaagaaattgtcacgaagtttctccctcgtggtgaatcattcaaggcactttcagggggtgtggtaaattgcgtgccattgtggtcgaaacaccgtggcggggagtgtaccagccccaaaggaaaaaag

SEQ ID NO: 620255 - DNA, 966 bp, Homo sapiens
gctggttctgattactacaatctagcgtgaaactgcaatagttcgtgatatcccacgttcagtaccttgaccctgaatgggaatgagagctgaatgtgatgagacaattatcctaggtgcctgatactaaagatagatatcgccactctgtcccatcaaaaccgtctagtccatcccatgtactgacattacatgcgggactggcactctgtagtcacttcaaagtactctggccatctcaccatgcagttctctctcgcggccatgggactacatgcggttcatatccaattcggtgaatgccatgtgataagttggtacacttggtgggcgcatagtcgtggtgaaatattcccttgatctacttttcagttcaagattgtctgatctgtcacccggacgagatgaactcgtagagggttaagtgtacgtggaactctcgaggtacagattcttgaactgtaatcatttataatataaaagtggtacataatctcttataacaggtaagaaattaggggatttcttctaagttgtaaattcatatatagggaagagagtgtgagttattacgatgtctggtaggtataaatataagagatttagctgatttaccttctgtagagttcactcattgtaggctatcgaaagtactgtacatatcagcacttaccatgggcatagattcttactggtagatatgggttttctggtacggtattaatgactgcagattctgtatgtatgtactggagtgatgcatttgatcaagggttatcctattgttgtttctagtggtttgctgcagaggaattgacgatggttaaaagatgataaatgcaagattctcagtaggaatagggttagccggtagggcaaattcataaggattcctttaaaaggaaaggtgggggcggggataaccgaggataaaaatgagggaggaggaggggaagaataaaaacg

SEQ ID NO: 620256 - DNA, 863 bp, Homo sapiens
  misc_feature (734)..(734): n is a, c, g, or t
cagtcatctttaaagaacattttatttttatacaagttctttcttgcttgttttttatttttatatattttttctgactcctatttaaagaaccccttaggtttctaagtacccatttctttctgataagttatgggaagaaaaagctaattggtcttgaatagaagacttctggacaatttttcactttcacagatatgaagcttgttttactttctcacttataaatttaaaatgtggcactgggaatataccagaacatgagaccagggttataggccacaaattaggaacctatatttctggttccctctattttctcccaagttagaggttccaccatttggaaaaaagccttttgggaatagcgcccaaggggtttgggtatatttcatgtgataaatgaaatagtttatgtgtaactgggtctgagtcatctggttgaggacgccagaggaggaatggtgttgtttggagcctgaagttgttgaaatggggtaactggtgttataaaggggaatgtttggtagcgtgtgagttttgaaacacaacgtgtgataggccaggcgatggtgggtcatggctggtaatacccagcaacttggggagaggtctgcaagcgggcgggagccaaccctcgaggtcggcggaggtcggtagaaccagccctggagtcgacaacaggggggaaaagccctaagtctcctgatcaaacacttaccaaacagtatacncgaggggaggggaagacgatggcctgtgatgtccagcacaagccaaggaaggtgagagggggggaaacacttgaaacccgcgaggcgaaagttaggaaggcaagaaaaaacacaaacgggaaaggatgt

SEQ ID NO: 620257 - DNA, 123 bp, Homo sapiens
atctgatgtccaaatacacccaaggtgtggaaggtatagcatctcttggcaagttcacagtctgtccggttcctgccattccctcctcctcctgagagcagcaccaccaggacggggatcctc

SEQ ID NO: 620258 - DNA, 97 bp, Homo sapiens
  misc_feature (41)..(41): n is a, c, g, or t
cggagcagcagtgccaggccggcgcatggagtcacccatgnactgcagtttgaggagactttcccccgggacagcacctgcagtgataccagccccc

SEQ ID NO: 620259 - DNA, 882 bp, Homo sapiens
  misc_feature (46)..(46): n is a, c, g, or t
  misc_feature (67)..(67): n is a, c, g, or t
  misc_feature (135)..(135): n is a, c, g, or t
  misc_feature (152)..(152): n is a, c, g, or t
  misc_feature (166)..(166): n is a, c, g, or t
  misc_feature (177)..(177): n is a, c, g, or t
  misc_feature (181)..(181): n is a, c, g, or t
  misc_feature (188)..(188): n is a, c, g, or t
  misc_feature (206)..(206): n is a, c, g, or t
  misc_feature (226)..(226): n is a, c, g, or t
  misc_feature (240)..(240): n is a, c, g, or t
  misc_feature (246)..(246): n is a, c, g, or t
  misc_feature (248)..(248): n is a, c, g, or t
  misc_feature (254)..(254): n is a, c, g, or t
  misc_feature (259)..(259): n is a, c, g, or t
  misc_feature (279)..(279): n is a, c, g, or t
  misc_feature (284)..(285): n is a, c, g, or t
  misc_feature (288)..(289): n is a, c, g, or t
  misc_feature (295)..(295): n is a, c, g, or t
  misc_feature (297)..(298): n is a, c, g, or t
  misc_feature (307)..(307): n is a, c, g, or t
  misc_feature (309)..(309): n is a, c, g, or t
  misc_feature (317)..(317): n is a, c, g, or t
  misc_feature (325)..(326): n is a, c, g, or t
  misc_feature (343)..(344): n is a, c, g, or t
  misc_feature (348)..(349): n is a, c, g, or t
  misc_feature (359)..(360): n is a, c, g, or t
  misc_feature (364)..(364): n is a, c, g, or t
  misc_feature (368)..(370): n is a, c, g, or t
  misc_feature (377)..(377): n is a, c, g, or t
  misc_feature (379)..(379): n is a, c, g, or t
  misc_feature (388)..(388): n is a, c, g, or t
  misc_feature (392)..(393): n is a, c, g, or t
  misc_feature (396)..(396): n is a, c, g, or t
  misc_feature (398)..(398): n is a, c, g, or t
  misc_feature (426)..(427): n is a, c, g, or t
  misc_feature (436)..(436): n is a, c, g, or t
  misc_feature (445)..(445): n is a, c, g, or t
  misc_feature (451)..(451): n is a, c, g, or t
  misc_feature (474)..(474): n is a, c, g, or t
  misc_feature (491)..(491): n is a, c, g, or t
  misc_feature (502)..(502): n is a, c, g, or t
  misc_feature (522)..(522): n is a, c, g, or t
  misc_feature (543)..(543): n is a, c, g, or t
agattaaaaaaaacaaataaaagaattaaaaaaaaaacctccttcnaaaacctccctaaaacaaganaaaacccaagctccctttcgaggacttacgaatatttttgacacaggcttccaaacaattttttagcnacacgccggttgccacncccccccttctccncccttggcttnatanacccttncccagcccctcggacttncccagggtggaggtcccctnaaacacagcccctnagcttntntgcttnttttnaggccagacaggaagatttncattnnttnnaccttntnncagcagcantngcgggatnagaaactnncccccaggccgggggtnntttnngagcgctttnnaggntttnnnttccctntnccccacatncctnntcntngaccaactagaaacagggggccaccttnnggaaaattnagagcagtntttttnagagtgggtgctgcaggtttttnccctttagctttttttnaaattattttnggccgggcacggtggctcangcctgtaatcccagcactttnggaggcagaggcaggtggatcacctgaaggtcaggagttccagaccagcctggccaacatggtgaagccccatctctactaaaaatacaaaatttagctgggcgcagtggtgggcacctgtaatcccagctactgaggcgggagaatcgcttgaacctgggaggcggattgcactgagccaagattgcaccaagattgcaccactgcactccagcctgggtgacagaccgagactccgtctcaaaaaaaaaaatcttgtttccgtagagtgcctcgggggacctagtttgggaaatgctcatttagggacctgtcgtaatgtgtgcaggggtcctctca

SEQ ID NO: 620260 - DNA, 215 bp, Homo sapiens
gtaacagcccattaaacaaacttttggacgtataaaatatcagtaggccttgtaaataactaggataatttcttggaccgaatcatcacatttatctttttacttcctactaaatttagttagcacatcatcaaacaagcttagttcttgcatttttctattgtccactgtagcaagtattttacatgtgtcaacaactttcatcgtgcatgttt

SEQ ID NO: 620261 - DNA, 122 bp, Homo sapiens
ttacttactcttatagatcatctcctccagagacgaacagtggctgctgcttatggaagtcaatgcctcgcacaggaccatcatgttcatcaaacttgtcactgagagtgcacatccagata

SEQ ID NO: 620262 - DNA, 314 bp, Homo sapiens
ccatgatgtccgtttcgatcactccgggcgcaacggcattggaccggataccacgcttgccgccttcaatcgcgatcacgcgcatgagctgcgccagtgcgccttttgacgaggcgtacgcggcttgcgtcgcgaaggctacgaccgaggaaatcgaggcaaccgaaacgatcgagcctccatcggccatgaccttgatcgcttcgcgggcgtgcaggaaatttccgcgcacgttgacggcaaggatcgagtcaaagtcctctgtggtggtctcttgcaagggtttgttgagcgtgcgccccgcgttgttgacc

SEQ ID NO: 620263 - DNA, 458 bp, Homo sapiens
  misc_feature (378)..(378): n is a, c, g, or t
tgagatggagtttcactcttgttgcccaggctgcagtgcaatggtacgatcgtggctcactgcaacctccacctcccaggttccaccgattctcctgcctcagcctcccaagtagctgggattacaggcatgtaccaccatgcccagccaattttgtatttttagtagagatgggggtttcaccatgttggtcaggctggtctcgaactcccgacctcaggtgatccacctgcctcggcctccaaaagtgctgggattacaggcatgacccactgcacccagcctacatttactttttctacaaactttcattttccctgaatttaattcattgtgggtttatttgctcctttatttctttttctatgtacccatccncaaattatctatctgaagtataaatgaagtgtaaattacatctttattctctccatttcactctcaaactagcctcaaat

SEQ ID NO: 620264 - DNA, 194 bp, Homo sapiens
ggaaatggggaaaaaaattggggccccttttgttttttggcaattgggggggcgggtccttttttcaagcccttccccaaaagggggggtttccggttttttttttgggaggttcccccaaaccccccctaatggggggggggtttttgtttcggttgggtttcctaaaaaaaagggaaaaagggcccctttta

SEQ ID NO: 620265 - DNA, 780 bp, Homo sapiens
ttaatggcctgtctgacaccgcatacacgcaggagtgtccatttctgatcacattaacaagtcatgtgtaattactaagacaaactaaatgaaaaatcttgggccttggagttacttataaggtctcttatgatcctttagctgttaaagtacctcctatcctacgttatcatgagggtactacagagccactggattattaggataggcgaagagtaaacccgttttaagtgccacagctatcaaagcaactttccctttgatggtagctttataaccattcaaagtactgcaagtcttcagatggtagtagattcatcttagtcttcagaccactttgttacaatcactgtcccccatacattaaaacatactctgttaggaacatcagtacactgtgatgccagacctaatggtagaataagatatggtcaccctttacaagggcactgattggctcctgagttgggtgggattgcagggcatgcgcaacacagcgtggctaaatgaacggatagacagtaagaagatgggattcaccgagtatggcccatggctaggactacaaaatcctggatctccgagagatgcaccactgcataagctgtccaaagagtgttggaacttataggagttagccaacacaacaacggaaggccgtgtattaaacatggagaaagttgtccacaaacaagggtaagagaaactgatatgacacaaaacggaaaatactgatttaatctatcgaaacacttcctgatagagactaattcatggaac

SEQ ID NO: 620266 - DNA, 827 bp, Homo sapiens
ggacaccaggtggtggcccagcaaagaggggaaggggccgggactccgggagttgtcagccccccaaggtgctggagaggcccaaacaacgggggggtctcgggaagacccttaaacaagggcgggcgcgcccagcccccgtggaggaagtgcgtcgcgagcgagccaccccgacacgtttcaaggaatgatacggtcaaaaccgggcgcgccacaccggaagagaaagacgtcccacggaggccccgctcaaggaaacgcctttagcacacagccgggggacatcaaaggctttgtgggaagacatacaacaccgaaaggccaaataagacaagagagggaatccgcggcgactccaggggcgggacacaacacctccgggcgcgtgccacaacgcaagtcttgtcggagagcaccccgacagcagaggccgcccccaacagggggacgaacaattctgctccacacccggccctcgtgcaagagagcctccagcaaagtgcagtttcccacgacgtcttcgtgagaaatagccggccttttactcgagaggagcccacaccgccaggcaggggagataagaaaaacagagacagcaccacgacgagcaggggaaacaaaaacaaaggcgctcccccccggggcggcactattcctcaaaaagttggccaacccccaacaaaagaagtccggccagggagcacgctgcggaacaagagacaacaacaagaacaactacagccggaagcaacagggggagaaaccggacgctggctctcccaaccccggagcagcacccgccctgcaacagccaaaacatagacaca

SEQ ID NO: 620267 - DNA, 452 bp, Homo sapiens
taaactgaaaataaggtgggcttcattggggaaatggacttattgcaaatgctgtgatgttttttagaggaacttcttttacaggtgttggccatgaattttttagcaataggaatttgtactatttaagcaatctttaatggaaaatttgtgtgtaagaatgggtgctatttaggttttttaccaacccattttaagaaaattttttggtattaagcccagtttttaaaaatgtttattgtagtatatggttagctttttacccttttgacaggcatcaaaatttcattttaaagttttacttgtacaaattttgtacttctttagtggctggaatttgtgaagaaacttaatgtggatatttaattttttcaagtttttacctgcccccatccttttttgtttttgatgtgtcccgtaagttttcaataaatgttggttaccgatcctta

SEQ ID NO: 620268 - DNA, 149 bp, Homo sapiens
ccaaacgtctgactccttctccacgttcactgctcgtgctcatctcagtctcccctctcctgccttgtatcctccagtctcccctctccatacagatgggtggaggtggaaagcaaagtcatgaaaatgttcccagcttgctcagtact

SEQ ID NO: 620269 - DNA, 114 bp, Homo sapiens
ctaccggcacgcccgccagggcgaaatcactgccgtacaagccagccagcccgacaaccgcgtcgttcagccagtccaagccaaatgccagtacgccccaggacaaaatcccgg

SEQ ID NO: 620270 - DNA, 888 bp, Homo sapiens
  misc_feature (63)..(63): n is a, c, g, or t
aggagggaggtggaagggagggttattgcgaggagtgataggagggacttagatgtgcctggntagtgatcagtaatgaagaccgcatgccgtcccaagattatgtcctcacttataactatcacaggaatagggggtggggggtggtgctctgagctcctgcagtgaaaagcaggaagaggatggccttgactttttaaatacttgggaacccaaatttattacattagcagaagcatgcgcaaagagataatgtcacagcgctacaattaagtctttgtcagacattctggaggggggggaaaataatagtgtaaagttcaatttcaagaggtccggatacgatggatttttttctcagttttgaattatgctactcaccaatttatatttttaaagcaaggtgggcgttatcttttccacaaagggaaagagggtaagaacaggcaggtgggagatctcagactccaggcctgaaattaagggctctaaagcatcgtggtctttgtttttgtaccggtatttgaggttttaatgtgctggagaaatagtagcccaacaatagcttagtgattcggatagtagcattattttgggtcaggtttaggtgagaggggggaagagaagcagaagattttgggtttccctttgtgagaagggttgggagagaaactatgcatatggaggtgattcaacctggtgggggcttaaaaatggggagtccccgtcgagcctagcggatgggttcactttagagcaaaagtggtcaagggccctagactagcaattggtggtcgaagtaagtggaaagaagggagcattaagaagaggaggccggggggctagagggggaggggtggtctcttgcgttataggggtaaggaaaag

SEQ ID NO: 620271 - DNA, 477 bp, Homo sapiens
acccaaggattctagcacgaatgtcattgtttacggtgatgatgtggtaagcgccaccgcgatgcagttggcccacttgcgtgccaacttgatggccgcttcacaggcttcggcaccgctgttgagcaaataggcctggtcgctgcaggtgtggtggcacagacgatcgacaagatccagttgcgcgcggttgtgcaaacccaggccaggcttgatcacggttgtcatctgtttggggcaatggcgtcgcgtacggtctggggactgtgacccaggctgttggccccgccgccttgactgaaatccagataagcgcgggccgtccagcgtcccggaaaagccagggaaccctgccccctgtacaaacacctgggggcgggcgcgccacaggtgggcattcaggcactgggctggaaacattctgcacgcggggcatgcacaaccaggtcatccagactcggcgcgcagggacggaac

SEQ ID NO: 620272 - DNA, 248 bp, Homo sapiens
gactagaggatcccctctctccacactggattgtaaactccttgatgtctgggtcatctcagctcatgagctgagctttcagtgggtgctcagtggaacaggtgctgaatggagtccggctctagggaggccagggtgtgttggtaagtgagagactaaaatccttttaaaaagaatctttttgcccttcagttgtgtttgccatgagttaatgtgatttactctagtggaagccagtgtggagagag

SEQ ID NO: 620273 - DNA, 271 bp, Homo sapiens
gggctgtccgtcccgggaccgccgcgatgtcccctgtgcgcccaaggagtcggggactgggtacccggaccagagtcactgtggtcacggagcaccagagttgtgctccatgatgccacgtgatcccacctctgggtgctgccacctcaagcatagcacagatcgttcagataagtgggtacccaggccaaaccgtatgtgctcaaggatggtgggagttggaactgtcacattgagaatataataaaacattggagatttctctgtatga

SEQ ID NO: 620274 - DNA, 172 bp, Homo sapiens
agttacataatcatcagatgtgctccaggttcaggagactcctccagcaaacgctgacagaccctccttcgcgatggcgtctaaaatcccgtcatgctgggctgtgtcggagacacaccctcttccacttcatactataaatactttctttttaaactgactatggattcct

SEQ ID NO: 620275 - DNA, 185 bp, Homo sapiens
ctcatggaggaaacgcaggacaaactcccatgaacatcaatccccaacagacccgtttccctgatttccttgactgtcttccaagaacggggggggacttaagaactttggaatctgaagacctgatccccctcttcaatgatgtagaggctgctctgaacaaaagtgagccctttctaacctgg

SEQ ID NO: 620276 - DNA, 620 bp, Homo sapiens
ttactaccagacacccttagccaaaccacttacccaaataaatgtatagtgcgatagaaattgaaacctgagcgcaatagatatagtaccgcaagggaaagatgaaaaattatagccaagcataatatagcaatggactaacccctataccttctgcataatgaattaactagaaataacatttgcaatgtgatgatgccaaatgctaagacccccgaaaccagactgatgctacctaagaacagctaaacagatgcacaccctgtctatgtagcaaaatatgtgggacagatttatatggtagagtgcgacaaacctaccgatgcctggtgatagcatggttgtccaagatagaatcttagttcaactttcaattttgcccacagaaccctctaaatccccttgtcaatttaactgttagtccaaatgaggaacagctctttgtgacactagtgaacaaaaccttgtagagagagtaaaaaatttaacacccatagtattgcctaaaagcatgtcacaattatgaaagctgtcaagctcaaaaccccactacctaaaaatcccaaacatataacttgaactcctcacaaccaattggaccactctatcaccctatagaa

SEQ ID NO: 620277 - DNA, 300 bp, Homo sapiens
cgggcccccaaaacccggaaagggcctgtttggttcctgttttttcccaaaagcccccccgcattttcaaaggtggggggggggtcacccaccttcataaaagttgggttttgggtacgcccccccttgggcaggtgaagccccccccttttgcataagttgatcaccctgtgccccccttccctttttaggagttcaccggtttggcagggcaccaggaggctttttgggttttggccccccccggaagggtgggcaaagaaaattgggctatgtattcttaataaattgggcccccca

SEQ ID NO: 620278 - DNA, 465 bp, Homo sapiens
gccaaaaaaaaaaaaaaaaatttattggtcttgggcagatcccctgaatttattttgggttcccttctttaaattgtgatatagctgtcaaattaaagccatgaggcagcagaaacaaaatttatgcacttgttgattgtgattcatgaaatgtgggaaatttattgcactaccaccagaagcattgaaattaaattgaattttggaaacaatttaccaaccaatctctaggcatttaaattgggcaacaggaaggctcaaaggaaaactcattgagtctctggagtgtgccaagggcaatttaaaaaggattgtgacaccttgacctagactctcataaaggattggaatattttttagataggaaagcaaaaaagatggacccctttcgaaaagttagtaaaggcagaaaaagaaaagtgaccttgatgtgtttgtgacactgtgaggaaccctcttaagcaa

SEQ ID NO: 620279 - DNA, 466 bp, Homo sapiens
  misc_feature (85)..(85): n is a, c, g, or t
  misc_feature (465)..(466): n is a, c, g, or t
tcatcttgggcctgtgttatcagcggacaaacggtggatgtttccgacagaaattttttcatggctgctgctaaagggaaaaatnttgttgccgaaccgcttgtttctcgattagacggagcttttgttcttgtatttgccgttcctatttatgatgataatcacgctatcattggtgttttactggcatcagttgaagcgtcagctctttcacatgatatagaagatattattgtcggcaaaacagggtattgctatattctcggtcttacgggaactactattgcggcaaaagactttgccagagtaaaggctatggagaatgtaataaagatggccgagactgataaaagccttgcttctcttgccgcctttgaaaagatggcaagagaaatagatgagccttccatcagcttctatacctataaaggtatacataagattgcgtcttacgctacgatgaann

SEQ ID NO: 620280 - DNA, 935 bp, Homo sapiens
tcctccactccccccatatctttaaagtgtggaagcagaaaggaactgccatttgtcctacattgagagagctgacataggggtaaggtcctggagagaggtacgtgctggctccacgtgaacaagcattgcggacggaaggtaaagagtccagtcagccaccacctggaaggtcgcaatgaaaaagccagagttccacttgttgtgtactcctgttgctgaacgtgtatcctgagtaccagcaatgatccctttttgtctctcatgtggcctagcataggtatgagtccaggactcctttcccttggtcccttaagagaatcaaaacccctattgcatgcagaccaggcggttaaggatagccctccaaccacgagcttgataaaatctggaggagacactggtggcctgtggaaagcattgtatccagtgaatggcactgcaagacttggaggaactgaccgggccaggcaggaggacggaggaagccccacatatcctttccatccgtcatggttggttaccgtacatcacgacctgtggcacatcttagaaccgtagagagccggcttgaaggagaatagaggacgccgtcagggtgtgaaacaacggacataccttgatgccaccagtctagtagcgggtcccctagccttttgtttattagtaggccaccctttcccatctcctccgtgtgagaaatgacagtccgcatggccagcgaaagcacctatacctccataggtgggtttccattggcacgaatcccaaactcaaatcaaatcctcgaaaaggtaaacacctttggaaacccttgcggcaacaagatatccgggcccctggcttttgatacactcttatccaatgactaagacgtggtgactaacccacagtttgcttacagcgaatgtgccccagcggaaccccgcgcggtc

SEQ ID NO: 620281 - DNA, 190 bp, Homo sapiens
actcagaatacaacatcatgtttgaacccgacgtgtgtgaacgtggcaccaagaagttgcatgtcatcttcaactacacgggcatgaacgttgctgatgaacaaggacatacgttgcaagcgatgatgagtttacacacctagtacacactgatggtgcggccagacaacacctatgaggtgatgcattg

SEQ ID NO: 620282 - DNA, 1083 bp, Homo sapiens
  misc_feature (437)..(437): n is a, c, g, or t
ataggaatagtgatagtaagatcaaaaaatgcagatgaaagtgagcttaactacatcatgtggttgaaggagagtattcacgttttagtcttcgttggaaggatggatgagaactgataagaaatatagcaagacatgttagatcatatagcgttatatttgcatatttgcatttatgctggatatattaatgaagttcttggagagaggtactgaatctatatgatgtaatatggtcaaattgtatcatacaaaggtgccaattgaatagacaaagtgtaagaacaaatcgtgagataaataatcaatgaagtggatgagttaatattagagtacatgccgtacaatagtgaagtcaaaataattgtgtattaacttatgaggtatagcaggggaacagaagttgactatagagtcgaccggattatatttaaccnccataagatggggtccaattgctgtcatggataattgtcatgggctgggtgaaactgaaatttagttctataagccagatgttttgaaaaaagatctgttggagatagtaattccttaaagaggtaagtagaggggagaggactggtgttaggtattatagaataattaaactgtgagggtagcacttaaattaagcaattcaagtaaaaggttaccaattagtactgtctggttgggtaaactcccgacgattatggggatgaaggaacataagaaataaagtgagacgttcttgattgccataaaacaagtttgagtagattttggggtaaacgtattgggaaattttgagggtattatgttggaagggactgtgggttaccaaaggttggtgtgcttggacattagtcattataagataaaagcaaatgtttggactttggtgtgagcaggtaacagaataagataccagtaacgggcattaatagggtaaaccatgaaagatatgagaggaacacgaataaagggggaacaacagtaagaaagagacagaaaatatttagtgtaggtgcttaggagagaacacacaaagaataaaatttttaaagacagagaaaatcggtaagggaaggcagaagcgaaaaa

SEQ ID NO: 620283 - DNA, 208 bp, Homo sapiens
ctgcttcatgataggaagtatgctgttctctatcagcctctattttattagcgatttgaaattattaatgcaatttatgaacctacggaataagaatgtgaatgaatccagataaagaagatgagatttcggaggaattgaaagaaaaggccaagattgaagataagaaaaaggatgaagaacaagaagacccccaaggaattcctga

SEQ ID NO: 620284 - DNA, 1495 bp, Homo sapiens
  misc_feature (559)..(559): n is a, c, g, or t
gccgcagtatgtggtgtgccttggtgtgtagttcgccccccgtcgccttcgtggccagaagggtctgctccccctggggtgtgtgggtctgtgtatggtggggcaaaaagtgttttttttacaacagggggcggcaaccgactctttttgaaggggttggtcgcccctggctgtttcctgtgttagagtagtgcgctctgtcccccacgttgggtgcacacggtagtttgcgtctggggggggttgtgttttctcgcgaaagcccgccccccgtgtgagggggggctccactaatgggccaatatctccccacccgcagcccgcacggtgctgtccctgttggggagaggggttcctcaccggagaagggccccccacaggaggaagggtgttccctcttggggggagaaccacccacattggggggtctcgccaccaatgggggagagagtcccctctttggggaagtgagtagatataatggtagagggaagggcccgttccccgcccgccgcccaaagtatgggggagccccccccccggggggttgttccccccncgaggagggggaaagcagcccccccctgctttgggagagagtagagtgagtatatctctttccccacgggccacctccgagaggctttgggagggaatctcgtgcccacgagtgtgggtgcccccacagatcacccgccgcggtgtttgtggagaaacacgcagcgaagaatctctttcgctcctcgttggagagagacccacgagaggtgggacacacagcacacagctggtgatataggggcccccctcacataagcccctcgagaaggcctctttctctctcccgccacacccgctctttcgcgccgcccccggcgcgttgggttgatgtcgcttggccacagaaggttgggcctctcgtgtggcacatctcccgcggggagaggagatagaagtgttggcctccccactggggatttctctgtggtggggttccccgcgtgtggagaagtgttccacagaaggtgtgggcccctgtgtgtgtggaagacacacagagaggtgggctctcccctgggggtgggcccgggcgccattggagccgagaggtgttgcctttggtgtgaaggaaagaccgaaggtggcccctgtggggcgccccccgtggcacccttgtgaatggacaccaagaatgggagggaaagaaagaaggagagagaccggtggaaggcaccctggagaaaaatgtgagtaaagggccgagccccctccaggagccccagagatccgcgccctactagaatacccagagacccccccagaactcgccattgactcacccagaatttattttttaacacaccacgaaaatagttttaaatttataattcccatatttataatgttggcccacccaccttatgattattcccttgtctgtacctttagtatttttcccccctttgtgaagaaaccacttaaaaccagttaaatg

SEQ ID NO: 620285 - DNA, 1016 bp, Homo sapiens
gggagctggaggttatgccgacaatgacatcggagccgtctcaaccacagggcatggggaaagcatcctgaaggtgaacctggctagactcaccctgttccacactagcaacaaggaacagacggctacgaacgaggctgcggacctatcgcttgggttatatgaagtcaagggttaacacggttctaggtggcctcactcgtggttacgcaaacacaggagactgcggtgcgcaccagctggaccctccaactccatgccctgcggccaagccgcccaaggcaccggcaagctgcaacttcggcaattgactccctgaccgatactactaatcagccgagcactatccctaaagccgcctggaagaacttgtacttcccagactgcctacgcctctcacaagggcccacagtcaccaagtcctccctcgattcaggacataagcccttaatccacacctaagatctttagcaacttcgcgacacaacttgcgtcccccgttccttgtcactttgtttcccgtccgccctttaactacagcatccttgaacatggtctctggctctgctgcggggagccggggttccctcgcacagcgcattgcagcaagcacacattgaccccgggttatctcagcggacggcattcacctctgcagaccccgtgcggccagcgcgtccaaacagcctgcaggttgcaaagccccagtggaaattttacggtccccgacctgggccagcatccccaagggaccctgtgcagcccacacgcagacacgcccccaggggagccccctgggcttatctcgaagccaccacacagacaccctcaaacgcgagcggcgaacccccaccgcacgtccaacggcaaacaggccgacgccacgccaatggcaacgtcccctttggaaccatcttgacacccacgaacatgcgttgaggaaaagaccccccaacaaggaccccctgcaacggaaacccccctgccagcggccagccaaaaccgatcggcaccac

SEQ ID NO: 620286 - DNA, 1860 bp, Homo sapiens
acacacacacacacacacacacgtgggaatgtaaggcttattttcttggcacatggatattcaattgcttctttaccatttattgaaaagactgtccattctgcattgaattgcctttgtacctttgtcaaaaatcatttgtctctagaaaaatcaggtttccaggaaaaaaaagactaatgtgttccactagtgttcttatttttcagttgtgttggcttttgtagattctttgcatttccatataaattttagaattagcgtatcaatttcttaaggcttggtgggatttccattgggattgtattgagtctatataaataaataaaactgagagagaattaacattttattttatttttttgagatggagtctcactctgttgcctaggctgtcgtgcggtggtgcggtctcggctcactgcaacctctgcctccgagattcaagcaattctcctgcctcagtctcccaagtagctgggattacaaatgcctgccactacactcagcttaatttttttatttttaatacagacagggtttcaccaggttggccaggctgttctcgagctcttgacttcaagtgatcagccctcctcagcctcccaaagtgctgagattacgggtgtgagcccccgcgcctgactgagaattaacattttaatattgagtgttttgattaaagtcttctctaatttccttcataaatgttttgtagcttttgtacagtcttgcacatcttttatccaatttatcccggagtgtttcatattgtgatgcttttgtaaaatgatttagtttttaaaatttcagtatctgttcattgctattatatagaaatgtaattgatttttgtgtcttggtcttacattctataaccttcctaaattcttttattagttttagtaactttttaatagatttcatcaggttttccctgtaggttatcttattgtcagcaaataaagaaatttttacttgtttctttctgacttggatgccttttattttcttttctggtgctgctgactgggtcatacggtaggtgtgtgtttaactttttgagaaactgccagctgggtgcggtggctcacgcctgtaatcccagcacttttggaggccgaggcgggcggatcacgaggtcaggagatcgagaccatcctggctaacacggtgaaactccgtctctactaaaaatacaaaaaattagctgcgcgtggctcctgtagtctcagctactcgagaggctgaggcaggagaatggcatgaacccgggaggcggagctttcagtgagccgagatagcgccactgcagtccggcctgggcgaaagagcgagactctgtctcaaaaaaaaaaaaaaaaaaaaaagaaaagaaaagaaactgccaaactgttcccaagtagttgtaccgtttttcatttctattagcagttgtatgaattccggttgcccccagccttaccaacaattgggtatggtcactattttaaaatgtttcccccaactttttaattataaaatacacataatatacacataaccatctttttaaaacctctttataaaaacgttttggctgggtgcagtggctcacgcctgtaatcccagcactttgggaggctggggtgggcagatcacctgaggtcaggagttcaagaccagcctggccaacgtggtgaaaccccgtctctactaaaaatacaaaaattaaccaggcgtggtggcaggtgcctgcaatcccagctactctggaggctgaggcaggagaatcgctggaacccaggaggcagaggttgcagtgagctgagatcatgccattgcacttcagcctgggtgacaagagtgaaactccgtctc

SEQ ID NO: 620287 - DNA, 895 bp, Homo sapiens
gctggttctggttcggaggtcgtgagcggagtccaaaaagaattacctgctgctgctccctatattcccaatgcggggcggcagtgggccaaggtgtgcgctgtcaagcgccacaatgctgtgagcctctcaccaacctctctttggtctgcttggagttcagcctctgtccccccgtagcgtggctagtcatgcagacatcggcttgtggagcacggtagactactggtgacctggacatagtcggggcctggggaacctactggagcatgtatgtggactgggctcgcagatggggaccccgctggatgaaactcaactgggtccggattccccctgggaaccgtctaagtgctctgttaccagggaatttcactgtcggggtcccctatcgaatcactgtgaccgcagtctctgcttcaggcttggctctgcatcctccgtctgggggttcagggaggaattagcacccctagtggggccaacgctttgtgcgactccaagatgcccctccaggacccccgccatagcgtggggagaggtcccaaggcaccagcttcgaggccacctcaccactacacttgtgtgcacagagtggaaccagccctccgtctgcatgaatgtgagtggcaacacacagaagtgtcacccctggcctgacttccttggggtccctgttgagcttgtggggtgacagcattcttaccatcgctggacagaggcctcctggtccatcctccggttcatctagcagataacacctgaggtgggaaagttctggccggctcctatctgtggggtgttctgtgggggttgggctgcctgcactctggaggggtcccctaggcacatgtgccctggttggggaagctcggttgcgggtggggcctgtgat

SEQ ID NO: 620288 - DNA, 295 bp, Homo sapiens
gttgcacacaagcatgggaccctggacccaatcacaaaaccactttttatcctgggcctccacacctgtgatgggaggggctgccatgaagttctctgatatggcctggagacattttcccaatggtcttgggaattaacattaggctccttgctgcttatgcaaatttctgcagcgagcttgaatttctcccccagaaaatggattttttttttctatcacatagtcaggctgcaaattttccaaacttttatgctctgcttcccttataaaactgaatgcctttaacaacaaa

SEQ ID NO: 620289 - DNA, 324 bp, Homo sapiens
caccgcacgctatccggtcaatgacacccttcacgagatgaagctggtgtgtgagtcctacaaggttcaataagagcgcgcgaggctttttgaaccctggagccaggagcacacctacctcgacaagcttaagatctcctcggccagcaggacacccaaggaccagagcctgtagcacaagctggaacacgacgtcagcgtcctaaagcagtggagctcagccttccagtacagggcgacattcagaagtcttgagataccgtacggtatcagataagcgaaccgaatagcttgccggggaccatgctggaaatcgctataatc

SEQ ID NO: 620290 - DNA, 187 bp, Homo sapiens
cgttctgaagaacgtgtgcaatcaagttaggagccaacgatcaccgtcatgtataggaacccagtaattattgaggggtggtgctgtatcctgcacgatcctgatacgagtgggtgaagaagaagaaagccaggatccccacactaccaacgatcagaagtttgcccaacagggacacgaatgttca

SEQ ID NO: 620291 - DNA, 233 bp, Homo sapiens
gggtgatctagaggatcctggcaggtctctactgggccaggcccggtttcaggtctcagtccagtttctcctaacaccgggctcagccggaaggtgccacatacacggattctaaacacggaaatattaaatactggcggcagaacagctaatttatggtctggacactaactctggggtctcagaaagatctagctattacgacttttccttcttttttttttttttttttt

SEQ ID NO: 620292 - DNA, 119 bp, Homo sapiens
gactctagaggactcccctctctctgtggggggcatgtccggcgggatgcggtgagccacggcactcactccctcctccatcgagctgtcccgcagggcctccggcagggcgggcaggt

SEQ ID NO: 620293 - DNA, 817 bp, Homo sapiens
agcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaatg

SEQ ID NO: 620294 - DNA, 1228 bp, Homo sapiens
  misc_feature (817)..(817): n is a, c, g, or t
ccttctttcttacatatctggtacctgacctccactgtcccgcgcggggtggtttaacacactaaactggtgcctgatcccacatttctcaacggggaaggtccccagacgtggtcgtcgtgtgtttataatcgtccacgcgatctcgtgctcaccatatgagaccctcgccctcgtttccctgtctctactacgttctccgtctggtggatgagcccacgacgtacccttttgcccacatgtctgttgggagaatgcgttcttctcccccacgaaagaagaaaatttgttgttgaaggaatttctggcgcgatatactggggccgccacatggagactcgttgttactcgcgcctctagagaaagcttgttctcctctcctttttccatggaacgcgaatggttgtgtccacacaccccccctcagatgcacatcacattacatgccgcctttcttactaaccacagaggcggcttttttccctcctccaaaagaccccacactataggggccacccccagagggggggcgaaaaaacaagggggggctcccatattatccgcgccccttcttatttcaccgtgccccccgtgcggttgtaaaaaaatagtgggtgtatagtaccacacatcttatgagtgtgcgctttttggtatcactcatggtgctcggtgccacacacatttttggtgtacctttcgtgggggctattcccccccacacatttctcaggcttttctctctgtcccgcacactattctccttctcatttgtacattgggggcgtcccacagaggaaaaaggatattcttgtgngagagctccacagagaggctgtgccaacctgagacagcgcccattgccagcgcgtcttcagtaggggcccaccaccggcctggcgcatatttgttgaccccctgtcccctgcgttgcctgttccccctgcgcatcttctgtctctggtggtgcccccgaggtggtccgcggggacacctgcctcggcgtggcttaagaggggcctggggtctaagggcctggcgatgaacactggcctccccgggggaacttcagaacttagggtccccagaccaccagaccccagaaaacccttggcgccccaccagaaagatggggtccacatccagaggcttgggcacggggtcaccccccatttgggatggttgaaaaccgtatttttcttaaaaattaaaaattttttaatcccca

SEQ ID NO: 620295 - DNA, 249 bp, Homo sapiens
tcctaaaaaaacccaaaacccccaattttggttttgaggaccggaatatcccggaaaaaaattttaaacaggtttgttttcagccctcaagggaaaaaccagtggtgggtttttttttagttgccaacagttggaagtttgctgattatttatgacccgaaaaaaaaaatttttttttttaaaaaaacattttgttacataaggaagacttttttaaacaatggaataaattatggcatttttattgga

SEQ ID NO: 620296 - DNA, 1601 bp, Homo sapiens
  misc_feature (501)..(501): n is a, c, g, or t
  misc_feature (682)..(682): n is a, c, g, or t
tggacctggggcaaaccgtttcaattggtgtaccagtaggccaaggggggaggacaaggccccaaaacccagccttttctctccgtgatgtgccccgggacctgtgtggttgcctgtgggccagtccccatgtgccgtgccccaagcccgtgaggcccacaaggctcccaaagaaggaggtgggaacaaaaagtgggggtggttgtgcagctctcacccccagagaagtctctcagggagaggaaaaaacacaggggcctagttgtgaattttagccctttggagaaaatctccattctctcgcgggagtgttgtgcaccccgtgtggaacctttcttctcagaaatctcctcctgtggttctctcttcggtggtccggctccgtagaagtgtgtggacacgccccccgtgtggaacttctcttgggtcggcgtggtcccatataccctctcatctcttttttctcccacccatgtgtcgtgtgcggaggtctctctcacncctgtgtgtccccacagggtctctgtcgacacagcagtctgtgtgggaaaaatctcctctcagagggcgtggtttaactcctctctctgtgaggggggtgtgtaggaaactctctccgaggggggctccccacgctgtgtgggcacccaccccaagagaccgggggttctccccagcacanaactctccccatgctctcttttatgtgtgacactcctatatctctccccgagagatggtgctcccgcgaggtcgtcacaccccacaactcctgttgtggtgcggcgcggcgtcacctcttctccaattgtgtgaacgccccccaccgaggggaaggagcccttcctctctgctcttctcaccacccctctttttcgcactgttcttcgagacttcgttcggcgttaggagaagaggcgtctccccccgccgcagatctcctacatggtaggcatctcctcgacctagtggaggacgtagtagccgcccccccctttttgttgtagaaggcgccccccccataccaccaccccgccgtgggagctagtgggttttgccccccaggcaccgctcgcgcctcagtcggcagagagtagttggtcgtctctccactgcacagacccactatgtggtgtgtccctctgtcttgccgccgctttgtttttttcacgaacgcccgccgggcggaagaagagctgtctttccaccacccaccgggcagcgaacaacctgggggggcggcaccgcccgtgccccgcaaggtgtggtccccacatgagtgctttcccccagcaacaccggagggcggggatctctataaggagggagcctcaccccacagcgaggcgggggctacacacatttcgtgggccgcgccccgtgggtgtctttttcccccccccccgattgttttgcccccccatcaaacgggggtggggggggggggcctcatcacgaaggaagttaattcccccccccttgatgtggggcagcactccttcttctaacagtctattttccacgcccaccgtcccacgaatttatctttcgccctcgcgaaggaatatatacactgtcgggcgttcaacaccccaccggag

SEQ ID NO: 620297 - DNA, 237 bp, Homo sapiens
tacaaatgacataaacctagccatctacagctacttatataacttcatacagatacatgaattaggctaaaatgcactataatatatggtagactatcaggaccagtctccttcgtacatcacaaaatacattttgatatcccaaagaagcaagaatagcacgtaggcgttataaacctaactaatctacagctacaaagttctactcttgatagcatttattttactggggagtct

SEQ ID NO: 620298 - DNA, 703 bp, Homo sapiens
tggtaaagcaagttgcaaggtaggggttgacatcaaagtccatgcttttgccataaaaaagaaggaaatcatgtgctttacagcaatacagatggagctggaggccatgattctaagcaaattaacacaagtacagaaaaccaaatatcatatgttctcactcataaatgggagctaaacattgcatacacgtggacaccaagaagacatggatacacattcgggcctacttgagagtgaagggtaggaggagggtaaagattgaaaaactacctatcaggtattatactgattaactgggggacaaaattatctacataccaagcccccaagacacacaatttacccacggaacaaacccgcatgtgtacctcttgaacctaaaagttggaaagaaaaaaaacaaacaacaacagcaacaacaacaaataaagtctatgcttttaacataaggttatatgcatgtaacagacatttactgaggcactggggagagtaagacaaggtctctatcttcaattatgataaaacgccacataatgttcattttttgtttgtgcttgttttgagacagtgtctcattctgttgtccaggctggagtgcagtggcgcaatcttggcccactgcaacctctgcctcccacgctcaggtgagcctcccacctcaacctcccgagtagctggtactacagacactcaccac

SEQ ID NO: 620299 - DNA, 622 bp, Homo sapiens
  misc_feature (28)..(28): n is a, c, g, or t
  misc_feature (81)..(81): n is a, c, g, or t
  misc_feature (92)..(92): n is a, c, g, or t
  misc_feature (97)..(97): n is a, c, g, or t
  misc_feature (134)..(134): n is a, c, g, or t
  misc_feature (152)..(153): n is a, c, g, or t
  misc_feature (173)..(173): n is a, c, g, or t
  misc_feature (181)..(181): n is a, c, g, or t
  misc_feature (211)..(212): n is a, c, g, or t
  misc_feature (215)..(216): n is a, c, g, or t
  misc_feature (229)..(229): n is a, c, g, or t
  misc_feature (231)..(231): n is a, c, g, or t
  misc_feature (250)..(250): n is a, c, g, or t
  misc_feature (261)..(261): n is a, c, g, or t
  misc_feature (277)..(277): n is a, c, g, or t
  misc_feature (348)..(348): n is a, c, g, or t
  misc_feature (575)..(575): n is a, c, g, or t
tagcattattctcactcagaaacatganaccagtgtgtgaattacaacagtaaattcacattcaagatgaatatgcaatanacatttataanaaganatcaactatttacatagggctataaaatacttttaanaatatgtacatggttatnnaaaaggggggggtcaatttnagtaaganattatatgggtgggggggtgggcaccattnnggnntgggttttggggngngaggttggggcttgtggcncaggggggggngcaatggggcaatctngactcactgcaacctccacctcctgggttcaaggctattctcctggcctcgaggcatcccaaagtagctgnggattacaggcgacccgcgcaccacacccaggctaatttttttggtatattctggttggagggtgggggtttcaccatggtgtgggcgcgagggcgtgggtgcgtgtggaggctcgcgtggacttcagggtggatccacccacctcgggcctcccaaagtggctggggattacagggtggtggggccaccggcggcccgggcctatatcccccataaattttctctnttttggtggacaggagtcttggctctggacaccccagggctgggact

SEQ ID NO: 620300 - DNA, 815 bp, Homo sapiens
  misc_feature (745)..(745): n is a, c, g, or t
  misc_feature (772)..(772): n is a, c, g, or t
  misc_feature (774)..(774): n is a, c, g, or t
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgacgaggatgatgatgaacgatgatgcatgatgatgacttttgatgatgaaggaagctgaagaaaaagcgccagtgaagaatcttatagagatatcccggcaaaatggcaaaagtcatccgatgggaggtccaacctcttcaccngatcaagggagatcttcagaaaggaancntaaaccaaggcttctgtcgaattctcaccgccctttaaagg

SEQ ID NO: 620301 - DNA, 1644 bp, Homo sapiens
  misc_feature (562)..(562): n is a, c, g, or t
  misc_feature (669)..(669): n is a, c, g, or t
ggctctgtcaccccgggccacagcacagcccaggccatgctcctgttctcagtgttgctgctcctgtccctggtcacgagaactcagctcggtccacggactcctctcccagaggctggagtggctatcctaggcagggctaggggagcccaccgcctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctngctccccacgcagcccggccctgccacatggcgcgaatgctgggtggcaggttggggccagaccaatgctgtgacaaaaactctgtgaaaacggatctgatgaaagngccaatggtcatcatggactggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcatcagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttcaaaaaaaaaaaaaaaaaaaaaaaaaaaaaaaaaaaaaaaaaaaaaaaaaaaaaaaaaagaggggggggcggccataaaaaatttccccggggggggacaaaagataagggaacacccagattttgttgaaaccaagggggccccccaaaaaggggacggcataattagagagcaggaagagacggcgcgccgcgggattaagaaaagagcgggagaggagggaaaaacaacggcgaccacggaggagacacaaccttggggggaggaagcaccccacacaagaacggggggggggggggacacaaaataggtgggggagccaaaaatacatatctaggagaaatattataagatcactggcggagtggtaaaataataaaaattttgaaaagaccgatgattattgtggtggtgtaaaaacaagagagagagcatagaatatgatgggatggatgaagaaaagaagattgtggtaaaacgaggaggataattataattatgaagagaaaaatttttttacagaagggc

SEQ ID NO: 620302 - DNA, 159 bp, Homo sapiens
  misc_feature (121)..(121): n is a, c, g, or t
  misc_feature (139)..(139): n is a, c, g, or t
  misc_feature (159)..(159): n is a, c, g, or t
attcttccgtattctgttacatcaaccaaaagttttgaagtgatccaagttatccatggcaaaccgttggatatggtggggccagtacaaatacctattaccttggttgggaataagaacnacctgcatatggaaaggncgatcagttatgaagaagcn

SEQ ID NO: 620303 - DNA, 560 bp, Homo sapiens
  misc_feature (24)..(24): n is a, c, g, or t
  misc_feature (62)..(62): n is a, c, g, or t
cttgggccaccagccctaaatccncgggttgtaggagcttttgcctcaggcaaaagctcctncaccaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 620304 - DNA, 1138 bp, Homo sapiens
  misc_feature (562)..(562): n is a, c, g, or t
  misc_feature (669)..(669): n is a, c, g, or t
ggctctgtcaccccgggccacagcacagcccaggccatgctcctgttctcagtgttgctgctcctgtccctggtcacgagaactcagctcggtccacggactcctctcccagaggctggagtggctatcctaggcagggctaggggagcccaccgcctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctngctccccacgcagcccggccctgccacatggcgcgaatgctgggtggcaggttggggccagaccaatgctgtgacaaaaactctgtgaaaacggatctgatgaaagngccaatggtcatcatggactggaggagtgttcaaagatgtttccaaaacttaccaaaaatatgctgtgtgccggatacaagaatgagagctatgatgcctgcaaggtaactagggggtacctccctcaccttataggtcctcaccctctgggaactgccagtgcaagggtattctctctctgctgcaaatagacaattctgagtctggaaaatgtatgggaattagggcctgcagccatgagaatgagtatgtggatttcagatcctctggagctgtgagtgagcaccctgggagtcaatatgctgcaaccctgcttaactatttctgatcttcttcaggtacactaggtaaaaaggacgccaaggcttttctcatttctgggaattctttttaaaaatccaaggaggatttggtatctatataagaagtcattttagttcattaacttagaaacctttgttgagcata

SEQ ID NO: 620305 - DNA, 253 bp, Homo sapiens
ggcgcagtgtgctggatatcggtagctaggctacctggagccggcaatattcacaggagctgtggcatgtagcagaccgaggacccaacaggtaatgcaagaggctagagagcctgtgatgtactgcagctgaagggatagtttgcagcagttaggtggtgtgccagagcctgtgagactcagagctgacaacggcagctggggttcctaggcccctgctaggttcacagctggagctgtaggagtgcgaggg

SEQ ID NO: 620306 - DNA, 756 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 620307 - DNA, 150 bp, Homo sapiens
ctatgtactccacaaacagcaacatgtgcgtatgacccgcgtaaagaccacggggatcgaggagacacacttcaccatcaaggacctacacttacaagaatgttaagatgtagggctggtcagctggtctgacgcggaagacagtggatc

SEQ ID NO: 620308 - DNA, 936 bp, Homo sapiens
tttctggtatcgtatatagatttcttcactgggctttttcttcagcttcctcatcatcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccagaatggaaataaaactcagtattttaataaaaaaaaaacaacgaaaaagaagaacacatcaaacacgactgaaaagcaccctgaacagcactggaatgggcacgcgaaaacgaataagaccgagcaccacaccgctcgcagcccgtgccaggcacccagccgcgcccacacctcgtagcgttcccacagaggcgcacccacgagcttagcatcaggccaggagaaaagcacgaaccaaagccgccccaatagcagcgcgaagccacccacaaaagggcacatgggaggggagaaccaaagcttgcacgcaacacaagcgaaggagcacccacacctggacaaccaagatccggcgcacactccacggtgcagagaagcaacccgctccgcgcgccaatccggcaccacggcaccaaagcgatgccggacgagtatacaggacggacacagcgaagcagtaaaacacggaagaaaaag

SEQ ID NO: 620309 - DNA, 497 bp, Homo sapiens
acagtaaatatgaagaccgttctaactgtcacatgagtcgagttcagacgatgagatactacccttccacattgcttggaactatccaaatagtggggaatttgaatttacgaagctgcaggttcttaataaatacatctcaatgttctccaaggactagcaattcgctaaatatctcccagagttccagggaagaggaccttctgcagggatggctgcagggctgctggatcctacctttgctgctgtcttctcttcatttgggttcttcttgcttcgtctcatcctgaactaaccctctccatgtgccttggcctacagattctgtgtaccaaggcagagaatgccaggatggttgtgaacattgataatgccaaactggctgccgatgacttcagggccaagtgagttcagtcggggggctggagctggggaggacctgtcctcataggctctggggcaactttccattagtttcacggagggttggaaagtgc

SEQ ID NO: 620310 - DNA, 537 bp, Homo sapiens
  misc_feature (19)..(19): n is a, c, g, or t
gcgtgcgtaactccacagntctttagggtaaaacagagctgcgggacgctggaggacaaaaccaactttccagggaagccgaggagaagtcatgccttcaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 620311 - DNA, 786 bp, Homo sapiens
  misc_feature (239)..(239): n is a, c, g, or t
  misc_feature (535)..(535): n is a, c, g, or t
  misc_feature (538)..(538): n is a, c, g, or t
gttggcggcctgcaccgcggacatgaactctcagctgagtctgagactaacgagacaatacaggccgatgtcgcctgtcgattccgccttgtgctccgtctcgatgatgccgacggaggtagccattgcgtccatggagacgttctactagaggcgggcatgggccctcgatgcctgggcccctactggtcctactctgagtctgctctgattgtcctgctgtcctctgccgtggctgnattgtcgtaatgggccgtcatggcagacgttggggcaggaccgtccaaacaagcagcccctcaattttgggaaggcatggcggaacgacaggaaagataagcgcttcgatatgtggctgtaatataatcgcgacgcgagcgactgcaccattctgatcagtgcgtgagcgtcggcgtcgagaatgttccgtgggttctgccgacatagccgtacaatcttactcacgcaacggcgtttggctttgagggctgggggtccacctatcgaacccatggaatcgctccccatagtcgancantagacctaacagaggcctgcatatgcgagcgtattctactaagatagctggcaaatgtgcgcatctcaaggaggccgggtgcacaacttctcagcgccccaagagagtatttccacaagggaccgcccccggattggtgagttacctacgcattagcgatacccagagcacggcgtggattgcatcgaaagatttttacctcgagggaatttagaccgttgacttttgtacaaaggcgcaaaaggtag

SEQ ID NO: 620312 - DNA, 298 bp, Homo sapiens
aatgttgtcactctgcattataaaaaggacagccagatatcaactgttacagaaatgaaataagacggagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 620313 - DNA, 858 bp, Homo sapiens
ctgtgaaactgctggggaaaatataatacttgctggcctgaatgacgttatttttgacccgaagattggcgttgttgtcacccctggggaatgcggtgtattacaagatttttccgctgtgctcagatgaactcctggttccctactggcgggttctccccctgtccctattaggagatttcttcctgtgctccgtgtcacacactttcgctttcctgggttactacggcttagttatacccgtcgtgtgttgcgcctgaattctttgcggttaactttgtcgccaatgtgcatggccccgcctccctatttgctgagaggaagcaaagtttggctcaaacaacttttagaaaagtttcattaccgccgcctttcctgaaggagcttggtcccaccatgctggaaaactttggtctgaagtgccactgtatacgccatcgccctatagatggtcaaaagcgggcctcactatacgcggaaaacaatccccaaatgtttggagtcatgtagtactttcgccccgggcatagggtggtccttcacacaatcttggcgagagaaactctttttactcatctgtacccaggccccaccaaatgagatatataaatctaaaatggaatggttttctttcctccccagagccccttggcggcaataacttaaaaggcacagcacctagtttattatgaataactcagcccatgacaccaattgatagtgactgctcttgcagagttcgaatataccaccccctgatccccattaacatactcaaagataaattgatggaaaaaaatttttaaatagtttcaccccagtttttccccccccatatcaaagtttcccccaacatac

SEQ ID NO: 620314 - DNA, 940 bp, Homo sapiens
  misc_feature (27)..(27): n is a, c, g, or t
  misc_feature (36)..(36): n is a, c, g, or t
  misc_feature (88)..(89): n is a, c, g, or t
  misc_feature (103)..(103): n is a, c, g, or t
cagaacggaaaaccctaaacccaaggncctgtcgtngagacaagcaaatgcagcagtataaaaaggtggttctcttcccaaagtgganngccaattcatcatnatgtgaagattgcttccgatgatgaccagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgagaatggaaataaaactcagtattttaataaaaaaaaaacaacgaaaaagaagaacacatcaaacacgactgaaaagcaccctgaacagcactggaatgggcacgcgaaaacgaataagaccgagcaccacaccgctcgcagcccgtgccaggcacccagccgcgcccacacctcgtagcgttcccacagaggcgcacccacgagcttagcatcaggccaggagaaaagcacgaaccaaagccgccccaatagcagcgcgaagccacccacaaaagggcacatgggaggggagaaccaaagcttgcacgcaacacaagcgaaggagcacccacacctggacaaccaagatccggcgcacactccacggtgcagagaagcaacccgctccgcgcgccaatccggcaccacggcaccaaagcgatgccggacgagtatacaggacggacacagcgaagcagtaaaacacggaagaaaaag

SEQ ID NO: 620315 - DNA, 180 bp, Homo sapiens
ttctactgggcctctgcttatccctcttcatcgtttctttcactatccaattttgcctactgcttatctcctactctcccttctctttcgcttttcccactttcgctcattcttttctccttctctcttctccacttctttccgctcttctttttcccccgtttctcttctcgtctttcc

SEQ ID NO: 620316 - DNA, 1300 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 620317 - DNA, 1303 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgacgaggatgatgatgaacgatgatgcatgatgatgacttttgatgatgaaggaactgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 620318 - DNA, 1300 bp, Homo sapiens; identical to SEQ ID NO: 620316

SEQ ID NO: 620319 - DNA, 314 bp, Homo sapiens
  misc_feature (22)..(23): n is a, c, g, or t
  misc_feature (25)..(25): n is a, c, g, or t
  misc_feature (161)..(161): n is a, c, g, or t
  misc_feature (193)..(193): n is a, c, g, or t
  misc_feature (205)..(205): n is a, c, g, or t
ggcacgagcatcttacacctcnncnctatagctgggactataggtgtgtgccaccacacccggctaattttggtatttttcatagagatggggcccccactatgctgcccaggctagtctcaaactccggggctcaagcagtcctccggcctcagtctccnaaggtgctgagattacaggtgtgagtcaccangcccagccaganttgggattttatggcaaatgtggtctgaagtggggatggccagttggatgtgtcaacttacctatgtgacagttccagttattcaatcaaacactaatcagtgtgtgga

SEQ ID NO: 620320 - DNA, 898 bp, Homo sapiens
tatgctgtacatgcaaatcactgagtgagcagataaaagtatggacagccaacccccaaaattggtagaagatgaagatgatgatacattctcctatactgtagaatagcagctcaagacttgttgctggctgtggccacagatttccacgaatgaacagtgcagcagccctggctgctgccgccaattcgacatttacacagaagctgagcaaaccaaaaacagtggccactgagcactggtggaaagatccatgaggcatgcatgcttgcccttaggctcagtgcacggccatcatcactgaaagtgtgaaaaatggcagagatccactttatgacatgcatgggttcatgaccaaatgtcatcccttgcatgacacttcaagacctctcaaggtgtactcgctttcactactttgggccgcggcacattatgggctagtcaggcggtatcaacttgtaagctaatggtacccctgactctgatcaacagacaagttcctaaaatgggcagaatgtatacgtgggcttccaccgagacacaagccccccatcaagttccgaatttgctggccagggacagccaatctggcgggttattggtggacccaagctggaacggttctcagagcaggtacccacagtgctacacggacgttctcccacgattccattaatgggctcactttcaacataacacgaccagatcagctcaagaggtactccacctgtgtgatgggaaaacactgtgcatcgctgtacacatcgaacccgaattaacaggcggatgaacaagaacatctgccgtcaccacggtgtgtgtacagtaagcaagagcccctgaaaccaacgttcgacataacgacggacactataactattgtccatacactggctac

SEQ ID NO: 620321 - DNA, 178 bp, Homo sapiens
gtagcatcaaatcaagttccaaatctatcagctcctctagtctgtccaaggcatcattgagtttcctccttctttccttacgccaggagacaagacttgccgacatttgctcaccagtacgtttaccctaggtattttaggtatcaatttagtgtctgtgacccagagggatacaagc

SEQ ID NO: 620322 - DNA, 109 bp, Homo sapiens
gattcgtgtgagcccaatgacgagtttctcaactggcttagcgtagggctcttggtagtcgggtaggcccttcatatcgtcagtgaccaggcacattgcggtcgacgag

SEQ ID NO: 620323 - DNA, 452 bp, Homo sapiens
aaacaattcaatgcttgtagctggaggcatgggcaaggggggtccccaggtacaaaacaattcaatgctttttttttttggtccaaaataaaacctcagctagctctgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcggcaaaaaacatatacctcactgggaggccccaaaatgaccgcccacaccctatttttgatgaaaaagagagggcgcccccaagaaaggacgcggctttatataataataggaagcagaggcgccgagccattaaaaaaacgccgtgagtggagagacaaacacggacaagggcgacttttggtgaagagacacaccaccagcctgtgggcgggggacaacataaggaggacc

SEQ ID NO: 620324 - DNA, 365 bp, Homo sapiens
atggtgtaatgtgatactcgctcaactctggtgcatcacgatgaatagatagtgatcgtaacaggccattcataaggtcttcatatgttagtgacatctccagacctcatagcataggtgtcatcagatcattcatcgattctcagatgtagtgagcgcgtatagctaagtggtattaggtaatagggcagtctaagctgtctgtacaagataagggtatcttgtcctacacggtcaatgaataaccctcgtaaggatcagtatgtgccctgcggtactctagagtggttgaatctgtctaggctagtcgtagcggcagctcgcagtagagatcaatatgcgctggtgtatattcgagcatgatc

SEQ ID NO: 620325 - DNA, 245 bp, Homo sapiens
aaaatgcagttttgaaacctgtcaggctcctgagctcaagctaaggcgtggggtgccgtgacatgcacatacacatcagatggcctgaagcaactgaagatccacaaaagaagtgaaaatagccttaactgatgacattctaccattgtgatttgtttctgccccaccctaactgatcaatgtattttgtaatctcccctaccctggggagggttctttttaatctcccccacgcttaagaaggt

SEQ ID NO: 620326 - DNA, 125 bp, Homo sapiens
cggtacaaggaagggatggagctgacttcgccaaggggggtggtgtgctgaaggatgggggaacacaccccctcagccctcgccatcatggaaaatgccaaggtcctggcccgttatgccagtat

SEQ ID NO: 620327 - DNA, 127 bp, Homo sapiens
cctcccacagtgctgggatgacaggcgtgcgcccgtgccgacctatttccttagtgacagtgtcttgatctgtcacccaggctggagtgctgtgctgcgatgactcactgcagccttgacctcgtga

SEQ ID NO: 620328 - DNA, 311 bp, Homo sapiens
gctcgacactcgagggggctgaggtgggaaaatgctctattacagtacaagattgaagataagaagattctcaggtttttatggttttaggtctaacgttgatggattaaagacttaaacgttagacctaaaaccatgaaaactctagaagaaaacctaggcatcaccattcaggacataggcatgggcaaggacttcatgtctaaaacaccaaaagcaatggcaacaaaagacaaaattgacaaatgagatctaattaaactaaagagcttctgcacagcaaaagaaactaccatcagagtgaacaggca

SEQ ID NO: 620329 - DNA, 356 bp, Homo sapiens
tggattatcttgcagaatgttatcacgtgagtcatggaatcaggagtcagtttcaagatggaccttagaggttatctggtccaacatcttcagaggatacagaggcttagaggggggaattaatctctctgaggcaaagcagtgtggaccagaatctaggtctcttcatcgcccccctgtgtcacatgtttccttccaatagaacagctgtctccttgatagaccacaaaaaaactttttgttagaccacaaaaaagcttaattcagataaacagtgctaattgatcatagaattaaagtcttggcctaatgagtggctaattgttttttagggatttaattcaagtccttagctg

SEQ ID NO: 620330 - DNA, 216 bp, Homo sapiens
actagtttacgtgaacggtagcaggagttcctggccacttggtgatttctatataggtcgacagagcaatccaatcactttatagcttcatctatctaggcatcatttcacatttaggcactggtttcctgggcatcgaattaaacaaagataatgtagcaatacttccatagataactcttttccaggcagtttggtcagtacatgtattcacgt

SEQ ID NO: 620331 - DNA, 925 bp, Homo sapiens
tccccttggcccataaatttttattgggcgggtcgggaaaaaagccggggggtaggggtcccttccttcccatccctctacccaaaaaacaccctccaagggacagaaaaacgccccagagccgtgtgctgtgcctcaggaggacctttggggggcagacaaagtgggtggatagtgattcttctcccggtgctccctcgtagcgaggcgtggggtgagggtggcaactcctcctgtgctccaggccgcgattgtgagtgctccagtgagccgctgtggttacctcctggtgattcgtgccgccctcactatcagcccttcgcacatctcgcccaggctgtggggtcatctcaaatcgccggcgtggattcaggcgccctgtggtaatatttgcgccaggtgtggggacctcacaaacgcgtcgcctctccgttttcgttgccgaggtggtgttcttctccaggggcagtctctaccagtgcactcagcctgtggtgacgtgcaggccctcaatctctcaagaaccccttggagagggtgtgccggccccgaccggggtgccagtaaaccacgtggggacaccgtggctctatcgtggagacttgccctcgcggggtgtgggccaagggaaccctccccgcggatcacaatttcctctaagctccgggcgtgggttgaccccgcggtgctacagcgcattccttacagggtttcttgctcgggccaattggcccctcattattgggggctccgcatttggacccacaaggactcctgggcgaagactcggtgcgcccgggcggcgggattcacccctccaacattgcctgtggctccccatttggccccctcaggcgtcttggtttccccccccaggggtcctcgcaaggggaggcacgcctccttaatggcgtcgatctggatt

SEQ ID NO: 620332 - DNA, 306 bp, Homo sapiens
  misc_feature (155)..(155): n is a, c, g, or t
ggctccacctgcgccgcgtgctgctgccagttggaagtcatgctgatcaccgacaccggcgtgcctgaccgctttatcgataccgacgattggggcggcgaagtcatgctgcgcctggatgatggctggtgcgcggcgctggatcgcgacacgangatgtgcacgatttatgagaagcggccgctgatctgccgggagttcgagatgggcgcaccggagtgcatcgatgagcgccaggggcttgcgacggtgtatcgctgattttgaaaaaccaacgatgagcaaatgtgggagcgggcttgcacg

SEQ ID NO: 620333 - DNA, 588 bp, Homo sapiens
  misc_feature (491)..(491): n is a, c, g, or t
  misc_feature (583)..(583): n is a, c, g, or t
ccaagaattcggcacgaggagaagttatattagtctttgtctgcagttgctcaaagactctcttttaaagtgcagagactatccacctcagctatagcaccgggctcagcactgtatttccagttatggaatacagttatttcatatatgttatattattcttaattctgtccctagttcctgctgctgaggaagtccatactcagcaggacagtctcctggtctgccatgaattcgaacacgatctgtgaagacagtgaaggaagctacatctgtgcatgggggctttggagaattattggcttgaagcaataagaggaacatctgggctgagtagtcctcgaagactctcatgtgattcaaaagtccttttcttccttattatttcctatcttgctctcaagcatctcctctggcagcagcaactggaactaaaagtgatttctctataacagcgagcaagtttctcatggcctttgctattaactctntcatgcctgctgacctgcaaaagaatcaggagggctggtgctggagcagatggcgcactgtgagtgatggtttagattctgcctggactcanaccat

SEQ ID NO: 620334 - DNA, 252 bp, Homo sapiens
  misc_feature (17)..(18): n is a, c, g, or t
  misc_feature (45)..(45): n is a, c, g, or t
  misc_feature (63)..(63): n is a, c, g, or t
  misc_feature (75)..(75): n is a, c, g, or t
gaaacattagactaatnntaagacgtccctctagaactaatggcncccgcgactccaaatatnctcgagataggnaaccccttgtttatcaaaaacacaaaataaaccggcatggtggcacatgcctgtaattcccagctcttgggaaggctgaggcaggcaaatcactttaacctgggaggcgggggttgtagtgagccaactcacgccattgtaccccgcctgggccaacaaaatgcaaacctttccaaa

SEQ ID NO: 620335 - DNA, 202 bp, Homo sapiens
agcaaactagatttatctagtgacatgagtaacacagcggagcacaaccgcgagcaagtctctcgagcgagtgcgcagcatatggggagcgtgtagagtcctcctagctagacccgacatggcacggtggcatcgagcgctgagtcgcaggtcacagtcagcttgatggctcggtcatctagcaggtagctagctttagcta

SEQ ID NO: 620336 - DNA, 212 bp, Homo sapiens
ggggggtttcccctttttttttaaattcccggggggggaaaaatttgggccgggaaaggggggtgttcccctgggggggggacttgggggcccaaggtttccccttttttttttacccccggctccttttttggttttgggggtttaagggggggggggggtttgttttttccgggggttttttttaattaaagggttttgttcccccccca

SEQ ID NO: 620337 - DNA, 109 bp, Homo sapiens
  misc_feature (27)..(27): n is a, c, g, or t
  misc_feature (47)..(47): n is a, c, g, or t
tttgatgaagaactgatgtcagcctgncaggtacctgtaatttattntatcatattattatattatatatcaagtaggacagtgaaaaatgtttccttgcaaacttgta

SEQ ID NO: 620338 - DNA, 218 bp, Homo sapiens
  misc_feature (143)..(143): n is a, c, g, or t
tttcggtcatagcaaggggaaatatccagattagaaaagcattgcaaaatgctgttcagaaaaagtgaaatcctaactggggatattcacaaacccatggtggcccatgctgtgttgcttagcttgctggggaggggcctttnctcactgcactttctgtcattctcaccctctctcacagtttgaacaagaggacctatgaggtctcttccaaacct

SEQ ID NO: 620339 - DNA, 467 bp, Homo sapiens
tgcatttatccatggcgtgtatatgaacagagtatctctggatggataaaggaaataagtgctaacagctagtggtagaggtggaacagtggttgaatgtttagatgtgaacacgttacctattctacagaaatttttttattttggagaagaagttgtgctctggttgcccaggctagagtacaagggcgcaatatgggttcacggcaacctccgcttccggtgttcaagcaattctactgcctcagctaccgcgagtagctggaattacaggcatctaccaccaggccggggtactagtggtattgtcagaaaagacggggtatggccaaatggtccagggtgttctcaaactcttgacctcaagcattcctcccgcctcaccctctcaagtagcatggactacaggcacatgccatcatgcctggctaatattgaccatttgggtaaagaccgggtccccctgt

SEQ ID NO: 620340 - DNA, 320 bp, Homo sapiens
tacaagggatgccactgactttgtactttaccaagagtgccaataatggactacgtcccctaaattctcccaaccagacacagctacatggtcagcttgcacatttacctctggttttctgactcctaggccacactcctgggtggcaaatggcaaactcttcatctggcatatcatcacaaaaagcatttttagagtagttttggtcccaacatacaaaggggaaatatatttattgtagcaccagtattctgttaatggaaaacagttttcagtatttataggaattcaaaagaagtaatgacttttttatgtatctc

SEQ ID NO: 620341 - DNA, 782 bp, Homo sapiens
gaaacaaacacatccctcttcctcactagagaaaatttcatccatccttttgcatgcccctcatcgctcctaccgacagtaagaatgactgtataagtggtatgctcctaatatgctatttggtctctgtgatcctaaataatgaagtaatttttttactgctactttggctttcatatgaagtttccattagttcagtatctttttgtgtctaaaagttgcgaagttcccttagtaacagctctgatcatctctgattgttactcaggaaaagcggaaaaactttcagattcacttgcatttctaatgggaaccacaccaggtagatattgatgagaatttgaaagctcagtctctttttctcataccagaaacaaccctaatataagatgctgggttcatacaattagtagtacacactttcttttgacagtaatttttccacagcattacagacaaaattatttttcttcctgagtctccgtagtttacacgacaaaaattctacactagaaatacattagacagttctagctcttgatttttaattactatgtatatcatggggtctaacatttataaatgctataaattaggaactatcaattagatggttagcattttaaattatcctaaaagtaagagccaaggtaatcttggtcagatcctcaaatttgcttattggtaagtttaaaaatttttcaatgcagggtatatttaaaggaaaaaatatagagtttgtccaaattgcagtgaatatctgaatgagatatggataaatg

SEQ ID NO: 620342 - DNA, 120 bp, Homo sapiens
gggccgcctactactactactactgctcgaattcaagcttctaacgatgtacggggacatgatgtgaagagtctgcaaatccttcaaaataaaaagtaatgacttagaaactgcaaaaaa

SEQ ID NO: 620343 - DNA, 200 bp, Homo sapiens
gctcgacatgactgcagtatctcaagtttgagaggtatggttagaacaaaagatgagcacatagttcaaaggatacagggtagaaaaagcagaaatagaaccacacaataaagcacacctaatttatgacaaagataaaagagcagatattcagtagaggaaagacagactatcaacagtaacgctggagcaaatggaca

SEQ ID NO: 620344 - DNA, 136 bp, Homo sapiens
gtcggcctgtgatgtcgggataaaaagtgcttacaagtcatctccgttcggtagtaagggcttatggtcacaagtagctctgcatagttcacatcgagatcccctccccatacataaacaacatacaaagccattc

SEQ ID NO: 620345 - DNA, 131 bp, Homo sapiens
tcagtgttgctgcaggtgttatagaggatccccggtaagacggtcttcgagccgggctgaccagtgagtgggctttggatctgcacagatgggggaagggcattctaggtcaaaggcacagtgagagtaag

SEQ ID NO: 620346 - DNA, 131 bp, Homo sapiens
aaaattttccatttcccttttggaatcgggggctaatttttttgccccccccgggaaggttaggaaaaaaggggcccctttaaaagtttggccccggccttttaaaaaaaatttcccaaaaattggttcca

SEQ ID NO: 620347 - DNA, 444 bp, Homo sapiens
  misc_feature (138)..(138): n is a, c, g, or t
tccaggacttaaatcggcagcacacacgtatgtattcgtcgcagcaaggccctgtggcaagaccggacgctcatgatcccaggataaaaaatctgtccgcgagcggcaggggcccggcagcgggagtgcgcttcccanggcaccattcgcttaaagtgtgtaatgacttgtccagcaagtttctttaccttcccaaacccaacttctacaacgtacccccagagtcctcaggagggccttcgacctgcaaaagcctcacaggagtgcgaggggccccagctccccagggcggccgagtggagcctcacacggtcaccttctccatcacgctttcagccacgtggacttcgtctgcctggacggtgacagctgcttgactggccgcatatgtcctggtgatccttccagtccttgcgttggcagaaggtggagcagtagttgacc

SEQ ID NO: 620348 - DNA, 1097 bp, Homo sapiens
gggccaaagccactccatcttactaccagacaagcttagccaaaccatttagccaaataaagtataggcgatagcaaattgacaactggcgcaatagatatagtaccgcacgggaaagatgaaaaattataaccaagcataatatagcaaggactaaccccgtatacctgtctgcataatgaacttaactagaaataacgtttgcaaggagagccacagactaagacgccccgaagaccagcacgaggctaccgtaagaacagcgtaaaagagcacacaccgatctatgtagcaaaatagtgggaagatatactaggtagaggcgacaaacctaccgagcctggtgatagctggttgtccaagatagaatcttagttcaactttaaactttgcccacagaaccctctaaatccccttgtaaatttgaactgttagtccaacagaggaacagatctttaggacactaggaaaaaaccttgtagagagagtaacaaaatttaaacacccatagataggccgtaaaagcagccaccaatctaagaaagcgttcaagctcaagcacgcagtacctaaaaaatcccaaacatataactgaactcctcacacccaattggaccaatctatcaccctatagaagaactaatgtcagtataagtgacatgagaacattctccgtccgcataagccgtgcgtcagattaagaacactgaactgacaattaaatagcacaatatctacgatcaacccacacgtcattattagcctcaatgtaacccaacagaggcatgctcataaggaacggttaacaaactaaacggactcggcaaatgttagccgactgtttacaaagaatcactctagcatcacaagataaaggaccgctgccatgaacacatgtttaccgcacggatacctaacgtgacatgtagacatacacatgtacttaataaggacggtgcagcgaccaaaggtacaaaaccccatataaccaagaaaaaactcgacggaaagcggataacaaacaagaatttaggctcaatactgcactacaaaaccaggtaacaaacaaaaagagagcactctacaaccgtgaagtc

SEQ ID NO: 620349 - DNA, 149 bp, Homo sapiens
actctggaaacccgcctaccactgcccaagtcaacgattgaagccgagccaaaccaaagtttccaaggggaaggacgtcttctacttgtccacaatttgccccagaaatctgtgctggctaacatctgggtcacaaagtgcgcaaatga

SEQ ID NO: 620350 - DNA, 857 bp, Homo sapiens
gctgcatcctttctttgatcttgattacaaatagaaatgaaaggggaatcagtggtcttactatatacttctctagaagagattactttcaatgactaggtgtcagccccaacgtaagaatcgatatctaatcattgtattcgtaatacctatatagatatttatttttgttacaagtgtcaacgtgtgagaaatatttgtatgttgggtcatcatagtgagcatatatataacctatgtctaagcaatagtatggtcttgataatgcattagaagaatggaaattaaattggtgtatgctgtctttagaaattagccatatttaatatatctttgaaatatgctttgtgtccagatgattcttgtgattgatcttgccgtttctgtacatggtaggtcacctctgaagtgatgtcattcgagtaacccaggaaatgttgattactttatattcttaaaggagatattctatatataggttacaatatgttacaagacttactgtttataagagtttcatcctgtctgtcaagtgttgaacgggtgattattattgaactctagattagcaggtactagaaagcaaaagtcagaaaatgtttgactagtaagaattctattaaattttaaagtgttgtatgatttgttcattggggatgatgtcaagtggtagataaaccgatgacattcgatggaataggcatgcagtttgtcgcatttgtgacagttgtgtttaaataaaacattcatacacactttgattgtatgatttagaaatctaacttggaaagtctgcttgtaaacatgggcattgtccaagtaatgtaggggaagtcacagataccaaaatgggaaat

SEQ ID NO: 620351 - DNA, 409 bp, Homo sapiens
  misc_feature (78)..(78): n is a, c, g, or t
  misc_feature (101)..(101): n is a, c, g, or t
  misc_feature (159)..(159): n is a, c, g, or t
  misc_feature (165)..(165): n is a, c, g, or t
  misc_feature (222)..(222): n is a, c, g, or t
  misc_feature (242)..(242): n is a, c, g, or t
  misc_feature (396)..(397): n is a, c, g, or t
tacccgttcgttatactttacagccctcatgccatacatctgtaaagtttagacaaactcaaagtctagtctctcggnaatataatctcttttagttagtntcgtcttaggcatttttatttagtgtctgccagctctctttttgtagtagtcagctcnaccacnctactgttttaatccttttgggtgataatttggtttcactttactggtgttcccggntggctactgtggactgggcnccttggccaatgggcgggttctcaaaacttcccttgcctgggaactggggcttgccctccttctgtccccttaaacctctggggtggctgtaccgcataccgacgggatccgtgcacgtttaacgattactaggactattgcagattccagttnnagtcgtatattc

SEQ ID NO: 620352 - DNA, 110 bp, Homo sapiens
cacgaggagcattccagctaccctgattcagagggggctcctgactccctgtgggactggactgtggccccacctgtcccagccaccccctatgaagccttcgacccggc

SEQ ID NO: 620353 - DNA, 227 bp, Homo sapiens
aggcaccggtgcagctagttagacaatgcaccgggacatcatgtgagcataacacctggcgggacctcacccagctccaccctgaggggctgcgcaagccatgtgtgctgcacaatgcagaagtcgtggtgctcatcgccacttttgactgtaagttgacgacgaggctgtgaaggatccgtcactgttggggccgaaatcaccctggccggtcgcccagcggcagc

SEQ ID NO: 620354 - DNA, 483 bp, Homo sapiens
  misc_feature (330)..(330): n is a, c, g, or t
ctatacctggtcactgtcaagcatacaatgtcagggcgccacttagagggacgggctgccgcgcatggagcgcacagtaggcaaagagctggccctggcaccgctgcaggactggggtgaagagaccgatggactggtgcggtgtacagtgtcttctctgacggtgttctggagtcagcgcaggagcccggctggagggccccgggggcagccaggctcccagccccattgccaataccttcctccactatcgaaccagcaaggtgagggtgctgagtggcagcgctgcctgtgagtcgtggctgggtggggacgaggtttgcgtggtcntggggagcacccggtgcagacagggcagacacgcaggcgttacattgcacccggccgttccatgggccaccgttaccgtgacctttgtacgcaactgactgcctgctgggctttctagctgccaccaatgccaccgaccccaactcccggggt

SEQ ID NO: 620355 - DNA, 722 bp, Homo sapiens
aacaaaccctgtcctggggggggggggggtataatactaagttgagatgatatcattgtaggggggaaggcgcttggtgaagtaggccttatttctctgtgtcctttcgtacagggaggaatttgaagtagatagaaaccgaccgggattacctccggtctgaactcagatcacgtaggactttaatcgttgaacaaacgaacctttaatagcggctgcaccatgtgggatgtcctgatccaacatcgaggctcgtaaaccctatggttgatatggactctagaaataggattgcgctgttatccctagggtaactggtcccgtgggccaagttatgggatcaatggagtatagtagtccgacttttgactggtgaagtcttagcatgtactggctcggaggtggggttctgctccgaggtcgccccaaccgaaattttcaactgcaggttgggtagtataaggacctgggggttgtgtcaggtactggttggcattaataaattaaagctccatagggtctctcgatctggcaggtgtcaatgcccgcctcttcacgggcaggtcacattcccgggttacaaagttgagacggttgaaccctcggtggggccattctacggtccctattcaggaacagtgttttgcacttggcgggtaggaccgcggcgtaacttggtccggcgggggcccaaacgggagcaggtgagttggacaggggcg

SEQ ID NO: 620356 - DNA, 373 bp, Homo sapiens
agacctgttagcaccactgtctatactccctctctgtagcccctggaaaccatgaatctactttctgtctcttatgaatttgcctagtttgtacacttcatataaatgtaattgagcaggctgggcgtaatgtctcacgcctgtaatcctagcactttgggagaccaaggcgggcaaatcattgaggccaggagttcaagactgtcctgtccaacatggtgtgaaacccggtctctactaaaaatacaaaaattagcctggcgtggtggcacatggctgtaatcccagctacttgggagggtgaggcaggagaaatgcttgaactcaggaggcagaggttgcagtgagccaagatcacaccactacactccaa

SEQ ID NO: 620357 - DNA, 135 bp, Homo sapiens
attaagaagccagtgacataaggtcgcctacgtgcagctgtcccatggacagaccattcacgttcccagacctgtatccctgagaaagacgggagccctgaaggctgcgctgcgcgactgacctctacagcatgc

SEQ ID NO: 620358 - DNA, 519 bp, Homo sapiens
aggatccccgagttgaaatgtgtttgcatgtggaatgacagaaaaggtaaaactgaaaacattattcaggtggtgagattctgatgattttaaacatttactcatttaaaaatgataacgcttggcacagtggtgcacacctgtattcctagctatttgggaggccgtggcaggaggactgcccgagcccgggaggtggaggttgtgttgagctgagatgacaccattgcactccagcctgggcgacagagcaagactgtgtctcaaaaaaaaaaaaagatggttaaggataaacggttatctcaagggaaagcgggagtgacatggtaggtatcagaagggcagatttcaaggaaattgcccagagcacggagagggcctttaattagggttaaacagataggtccatcaggacttagcacccctaattatgtttgcggaaaacggacagagctgggaaattatgtgcaccggtctcggataggaattcagatagacccaaagggagaattaaccaat

SEQ ID NO: 620359 - DNA, 95 bp, Homo sapiens
gccagcaccaaccagacatctatgtacctctgtgccagcacctctgggcaggcttatggctacaccttcggttcggggaccaggttaaccgttgt

SEQ ID NO: 620360 - DNA, 115 bp, Homo sapiens
aggatcccgttcactttctacactggatgcgaattcttttcctgataggacatgagtgaggcgcaatcgggaaaagaattcgcatccaatgcctgcatgcttgtagaaattgaac

SEQ ID NO: 620361 - DNA, 467 bp, Homo sapiens
  misc_feature (96)..(96): n is a, c, g, or t
  misc_feature (116)..(116): n is a, c, g, or t
  misc_feature (214)..(214): n is a, c, g, or t
  misc_feature (235)..(235): n is a, c, g, or t
  misc_feature (257)..(257): n is a, c, g, or t
tccctgttgctttgcccaggaaccccggtcagctctctgtctgttcctgccgggtaaacaaggtttgggccagttccctgtttcctctgggccttnaagtccaaggcccacagaantcctttttccttcccctgaaagctggcagcttttgttacagaagattcctcaggatgaaggcaggggctgaggcctctgcctactggctgcccctttnccatccagtggctgctgtttncccaagacaggctaagcgtttncttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaaaaaaaaaa

SEQ ID NO: 620362 - DNA, 522 bp, Homo sapiens
taaaacacaaatttaactggtttttatttaaaaagtccggactcagcaggtgagaaggagccacccccaccagggttcccttcggcgtggaggagagcaggatgtgggcaaagccggcccccacccattctggggtacaggcatgtgcgggggacaccccaggttaagttccccacaagggcagctttccgtgtgtgtgtggccatatgtggcacagcccccgcggtaggtgagtaattgggggggctccgtgccggtggtgcgtggggggtgggtttcggtcgtgcccgtggtgtctccgtgggggtgtggcccgggagaagcccgaggtgttagacgccggtggctgtgtgtcctcgcggagaggagcgtggcacccttcgggcgtggtggaggttctctctcggtggggtgttattcggcgccaggcggaggtgcgctttatcacgcggggatctcacggggggccgtgggcggaagaatgtggaaaaggctaaagaggggaagtgcgtgtcagcaaca

SEQ ID NO: 620363 - DNA, 191 bp, Homo sapiens
ggtcgtgggcaccgtgggctgggttgggagcgcctggagtcgtggagacatttgaggagcatgtccaaatccaccaggtacgagatgacatagggcttgccattgtccagggtctccaaggccgccaggtaggtccggtcccgctcgatcagatcggccggctgctgaaccgcctggccgatctgatcgag

SEQ ID NO: 620364 - DNA, 763 bp, Homo sapiens
  misc_feature (336)..(336): n is a, c, g, or t
gcgattgtccggcaacggctctgtgggccgcaacagcaaccagcgcttccatgcagcgtggtcaaggatgaggagctctaacgaggaagtggcggctaactgctggaaggctgcagcatagaccgccgacatcgacagtgttcatcgcaggccaagagcacagggcacaaggagccccgccagctcgcggtgccacttaccagaacgtattacgactcgggaggtcaccccgctcgaccagcagccgctggacatacagcccgtcctgcggcatgataaagaggttctctggacgtgcatgcacggaagtcccaagaccacttcgttggcagcttntgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctc

SEQ ID NO: 620365 - DNA, 1055 bp, Homo sapiens
  misc_feature (336)..(336): n is a, c, g, or t
  misc_feature (838)..(838): n is a, c, g, or t
  misc_feature (889)..(889): n is a, c, g, or t
gcgattgtccggcaacggctctgtgggccgcaacagcaaccagcgcttccatgcagcgtggtcaaggatgaggagctctaacgaggaagtggcggctaactgctggaaggctgcagcatagaccgccgacatcgacagtgttcatcgcaggccaagagcacagggcacaaggagccccgccagctcgcggtgccacttaccagaacgtattacgactcgggaggtcaccccgctcgaccagcagccgctggacatacagcccgtcctgcggcatgataaagaggttctctggacgtgcatgcacggaagtcccaagaccacttcgttggcagcttntgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctctggtgtgctggggtcccgttctctttttctcctgctccagtgtccgagtgctcagttcagaggaggcaaaggaanaagggaaggagcctggatgtggagctccccaactcagccgaggcttcagcnatagttggagaagaggcctggccccagttgctaggagctcccagactgccaaggagacacattcacacctgagaacaagagaacacaggggtgcaggaggactgtggcaggggcaagaaggggctcagcaggagcatgcaacctgtcagacagtctgcggatcctc

SEQ ID NO: 620366 - DNA, 365 bp, Homo sapiens
tgctgcttcctcctcgatgatgggcgggcgggcagatggcgctcctcaccttcccagtacggggcatggcgtggcaggatgcgctgccccactttccagattgagtggcggtcgggcagaggtgctcctcatcatcccagactgggcgggtgtgtcggaggcactcctcacatcccatacgatggtcggccatgcagagatgttcctcacttcctacatggtggtggcggcctaggcatgaggctgtaatcttatgcactttggtgaggccataggcaggcgcgctgggacggtgcgaggttcgtaccagagccgatgatcattgccacttgcatctcctaggtcctgggacaacattcgtagca

SEQ ID NO: 620367 - DNA, 486 bp, Homo sapiens
  misc_feature (86)..(86): n is a, c, g, or t
ggggagaactatatgacaactgagggggatgggaggccggtccgttgggttacccccatcctgtgtcccaaggggctgccctgccnaccctgggagacatgccgcatttactgctgggtgggggaacgccaggcccctccctgcaggcccttccctgcaggcccttccaacgtcatgcgctttcaatctcttggccagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctc

SEQ ID NO: 620368 - DNA, 189 bp, Homo sapiens
cgatctatgtggggctcagctggtgctctcggtcagtgacagcaacctgcccctcccacacaatcagcaggctgatgccccaccctgcccagctccaggacctgccctgagccgggccttctagtcgtagtgcttcaggtccgagagcatcaggctcctgcagagccccatccacccggacctcaattt

SEQ ID NO: 620369 - DNA, 140 bp, Homo sapiens
gctgcttctcttgtcttaagtattcctttcctgatcactatgcatttgaaagttaaacatttattaagtatttcagatgctttatagagattttttttccatgactgcattttactgtacagattgctgcttctgctata

SEQ ID NO: 620370 - DNA, 377 bp, Homo sapiens
agtgacccatctggtgtcccttcagctgcccagtctgacacagaagcccaggagaagagccactgaggcagaggagctaatggagggatttctgagtcttgagaaaggctgcccagtttggaggtaaaatgaggtgaaatgaggttctctgagtccaagtaagcaaggaatatgaatattgggggttccaggcactttagcgctgaaccaggttctcgaacaggctttcagcctagtctcccattcatcctgaatggagagagactccatttcagggccctggtggtaactggggtcctgtccagcagctgagcaccccgcacacctaccacccagtcaccacctggcctggagtaggcagagagaccccacaagcc

SEQ ID NO: 620371 - DNA, 160 bp, Homo sapiens
agccggtccatagcgaccgtacgacaccgtacttgatgtacttctccgggttctggtgaagggcacgctgcacacttctgtagaaaggccccgtaggtctccttgacaatggtcttctgggcctggcgaatcctgtccctctgctctgtgtacggtgtcg

SEQ ID NO: 620372 - DNA, 445 bp, Homo sapiens
  misc_feature (356)..(356): n is a, c, g, or t
ctcgaaagagatgtggctacaaatgaacgatactggacgcaatggactcgatcagagctgaaacagaggttctccgtgttcggagagactgaggagtgcatcataccacttccgtgtccaaggggaccagtacggtttcagtcactatatacgctatgctgcgaggaggcatttagcagccattgacgagtgggcacaatgctgcggcaggaagattgaacagcctcgttagatctactgcttagggtgtgccgaaggcagttctgcaagagtgagctattctgtatcttgaatcgcaagcgggcaagactttgacccagtcaccttgtaaagagcaaagtttgattctgcttgantttgacgcattgttggaagcaggcccagaagaacctcaggaggtaaactatgggcccttccctgctatccttattctccttaggaggta

SEQ ID NO: 620373 - DNA, 749 bp, Homo sapiens
ccgagaagagcatgataaggaggagcggatccgtcgcggggatgacctgtcggctgcatgatggcaatcgaggagagcaagagggagactggtgggcaaggaggagtcgtccctcatggaccttgctgtacgtcttcacggcacccagactcctgtccccgaccacagacccctgggggggcccaggcacccatggactgctgccgtcgcccacgggcttgctcctcagactcggacgccctggtggcgtgccccctggtccctccagctgctgatccctggggagggatcacagccccacacgccggaacatctggaggacaccctgagaggacatgcatgacaccatgcaaggacaccatcagatggacacccaaggaggtggagaccacacagaaccgcacatggacaaggacatgagcagcagcgagggcacccaaacgcacctaggaagtcccactgggagggcgaacgatacacagagtaggagcagaggagatcaccagggatcaagaagggaagacacgaataaagacacgtccagcaatccacgtggggagcaacacggagacaaccgggggacccatatactacgacgaaatccaccctggagcagcacgggggaccacccacatggcacaaagaggcacccaaggacacccaaagtggggcacccgagaacgaggcaaggcgccgggggggagaagttcacggaagcaaccgaggagccacggaccggcaagttacac

SEQ ID NO: 620374 - DNA, 148 bp, Homo sapiens
acgttggcggtgtccgggacatcccatacatgcaggtcattctaatgctcactacagatctggctggcgcagctgacgcaagacacgggggcccctagcaaaactgctctcccaagcttatagctgagttgggtctggctaacacgga

SEQ ID NO: 620375 - DNA, 352 bp, Homo sapiens
caccgcaatctgggtgtccttccccatttttatgtttttgtttgctttgtcgaagatcagttgactgtaaggtacttgggtttatttctgcattctctattctgttctattgatacatgtgcctattttacaccagtaccatgctgttttggtgactatcgccttatagtacagtttgaaatcatgtaaagtgatacttccagatttattatttttgcttagtcttggtttggctatgtgggctcttttttggttctatatgaattttagaatttttttttttctaattctgtgaagaatgatggtggtattttgatgggaattgcactgaatttgtagattgcggtgtttg

SEQ ID NO: 620376 - DNA, 287 bp, Homo sapiens
  misc_feature (281)..(281): n is a, c, g, or t
ttcggccggggcaatcactaacctaggatgagatgtaagttttattttctaggccaactttgattaaatggtagcggtggcctgaaatgatgtcttgaaaggaatctgaggcctcattccaggctcatctaggataaatgtcataatcatttatggatgtttgctgtgggcatggaaatgggaattggcagcactcatgcgggctacttaacatttctagaaagcattttgacttatacctctccaaaaataggccactttatctcctcattggcccgggncgaata

SEQ ID NO: 620377 - DNA, 1183 bp, Homo sapiens
cgcttggccaagaagcacaatcccaaagggcctactagaatgatgcaggtccatagcaatgtccaaggtcatgagtgcacggtgccgaggctcatctaaggccctcggtcaaagcccgagatggtaggttaagtcctaaggatccctaaagggtgtctagccgcaagcgtcagatcggacttgctctacattgccctactccctaagctatgtggaagcggtgtctacgattggctcccgttcatttgcctaagggggacgtcaggtctgtgcccgggctcaaaggctcaaggtcgcaatgcgtctgcaaggacacgaatgggagtcgatagatcctaagggctcactagggctgacaggcccgctagcttcagtttccatgtctgcatggtcgtgccacaagaacgtagccacaaggacaccctagcaaagggccttacatgatgctagactagtactactggtccaagcagtgtaggacatgtagaggagctgagttgcgaagtccgcgcacatacactccgtcctcctgaggcttaccattctgcatggggctggggtcctcctgtgcttatttgtacataattaaacctgagggcaggaaaaaaaaaacgtagaacagaaaaaagaaaaataagactgaggagagcaattataaacagacgtgagcgggtgagaaaccaggaagtggtcgatcccggggacccgcgtccgatgaaaacagagacgggacaatgtgtaaacccagagaaaataaatgagggcaaacaacgcgttccaagacataggccagagtctgcccaacaaggagagaagcagagaaagaaacgcacaaaaagacccgccagagaggacacccctgggacgaaaaaaaaaactcgcgcgccaaaaacagacaaccaccaccaaaagcgaaaaaaagaacaacgacaaagaaccaaacaacagcgggaccaacgcaacaaggcaagccaccaaacaaccaccagcaaagacacacacatagacacaaccgactagaaaacaacaaaaccacccatccgccaccgggaacaacaaggatgtgcaagaggatatggaagaccaactgagacaaaagaaatggtagaagacaaaacgcacccacaaaaaaagacaaaaaagaaccacgaaggcacacgcaagaaagtgacaagaaaataag

SEQ ID NO: 620378 - DNA, 218 bp, Homo sapiens
  misc_feature (43)..(43): n is a, c, g, or t
ttgacatgatcgactcgagttcggtaccctcaaaacacaaaanaagaacacatagtaaaaactaatacaaattttttaaaaaatacagaatacagtgtaacaactatttacatagcatttacattgtcttaggtattataagtaatctctagagatgatttaaagtatacaggaagatgtatataggttatatgcaaatactatgacatttataaaag

SEQ ID NO: 620379 - DNA, 149 bp, Homo sapiens
caccagtgatcatctaatgcaacagataacaccagcgatcatcttatgcaacagccgaagacccagtgatcatctaatgcaacagcaaacacccagtgatcatctaactgccacagacaacacagacacagtgatcatcctaactgcaa

SEQ ID NO: 620380 - DNA, 140 bp, Homo sapiens
caggctccacccctaacattggaattacaagatgacatgagatctgggtggggacatatcagccactatagtgggaaaggtgatgaacagaattagttaagctaagcagtgctcctttttgatggaagcactaagcaaca

SEQ ID NO: 620381 - DNA, 173 bp, Homo sapiens
gatgcttgtgagtctctctacgagtatcccccccgcgtactctggcgtatgatatctgtgtggtttgcacacttgagtcgttattcatcctctctgcccccccctttcctcatctctcatgtaacgatgttaccacttacagtttgtgcttcagtgagacgctgtggcggtcg

SEQ ID NO: 620382 - DNA, 494 bp, Homo sapiens
atccctgagaatccaaaattctccggccacctatcacaaaaaaaaaaaaaaaaaaaaaaaaaaaaaaattggggggggccggggccccggaaaaattaaaaccatcgggggggggggggccccagtagggattagagggaaactttggtccaattagcgctgttcttccctagagagaaaactcggggcttcaggacaactagaggggcggggggtttttctctcaccaaattaaaaaaaaacggccgcgggggggcaaaacgcaggagggtctcggaaaaccaaattccagagagggggagttttctggaggggatccattagagcggggctctcctaatcacaaggcggggagagtcccaagggggaaacctcgaatatccaaaaatttaaggccccgcgccggaggtatgcacggcccataggtagactctcatactccaacgtgaaacaagtgctaaccgatcacaaagaacagcatcaacaagagcagc
